United States Patent 11,001,841 (CCCTC-BINDING FACTOR (CTCF) RNA INTERACTOME) - sequence listing, part 5

SEQ ID NO: 10405 - DNA, 1025 bp, Homo sapiens
ctgttattttttaaaaactacctttgaaactgatacctgctgactggctaaagccatcttccttttttcattactctttttgctcacatcttgtttgttaacaactgcctcatcttcctcttcacgctggtcatcctaggaatttcccaggaaactagtgtcccagcgtagaatctgagagctttggctacttagttctgcatctttgtcatcagttccatctcttccacttcacctgtccttgtcctacagtattattctgggcccagttactactgctcctccatgaccatgaactcaaacaccagctcagtgactaaaatctatgatcctcctagtttgctgcacatgtttttcatcctcagggcttaaagttcagtgacccctccaagttctcctaccacaactatcctttctcagctcagattagatgactgcaatttcattcatacccaggcagattggtgctactctaaattcacagctccatctctctgaaaccatggtattgtggttggactgtgtccccataaagatatcttaaggccgtaaacaccaggtacttgtgaatgtgggtttatttggaaatagagtgtttgcaaatataatcaagataagagcacatttatgcaatgatgcaaagaatcagatacatgggctgaagtcgaagactcaagaaaggagataattggtcatgtgagactgaaaaggtggaagaggatgagatcaagacaatacctgaacagattctcttttaataagagtaagaactaccctaggactacattcattgtaataatacactgaacatatgattgccaatgtttaagcattttttttacttttgcttacttacaaattctataggctcaactaataacaaaatatactaactggcctttatttagcactatatactcaataaattcctttagctatcatatttaattctcacaacatcccttaaggctgcagcatcaactgttgcctaagtttccagtctgcccttgccctacagatttcag

SEQ ID NO: 10406 - DNA, 1094 bp, Homo sapiens
cttcttcatgctttgtcacctctatcctgtatataaaagcagatcataatgcttccagaatattttattttgaatagataccttttcctacctctctgtccttaacattttcgttttgaatccaaaatgatttttactgtgctctacatttgtgttaacattacactttcccaaaagtaaatttaatttataaaatatttaatttttaatttatcagggctttctagtcactatcatcagaactgaagttataatttctaaagctctcagagaactaccagcctgtttcctgtttccacctgtaacttctttttgacatgtgtagatcctttttatacatgcccggcagcattttgcatggggccttaattaaaatccagatgaggattgtctgccaaatgtatcattttgaaaatttctcccaatgcatattgaaagggatctagcttatgtatgactgggacacagctggagaagaacatatctctttttaaaaaggaaagttggatgctgaaatcacagattaatttaccactgtagatagaggcattcagactgtgctgtttgaattaagactaaaaagaaacaagaaatggcaattattataacatttgaatttttgtacattcatataactttatcaataccctttattatttaccatttgtttctttgatgtgacccattcatctttagaaaaataaactgaaatatagtcagtcaactcttaatgtcattttctttctcatttaaaatctccagttccaacatttgagctgaaatataaatttacaagcatttataatcttgtaaatttgtaagttataagcatctcaccctgtatattttcgtttccccaaatacacaatgcatgccagaatcaaattcattagctgtcttctctcatacctgtaaatcatcttctctctgcagggacaccatttgtatcaggttgcttggaaattttagatgtatctttgagtcttttgccttcattctatacaagttgttgaccaagtcatgtattttctcctgctgatgcctcagaacagcctccttcaatctcacatgtagtccttagcatggaggcatgt

SEQ ID NO: 10407 - DNA, 1060 bp, Homo sapiens
tccaagattttcaagcttatttaaaaatagtacataacaagtcattctgcttttctctttacatcgttaatacttttcttcccacctaaatataattacctaggttatatgtattacagacatcaagtaattcagtgtaaatgatattcaaaattcaaattaagtatttttccccaaacgacgcagaaagcttttaagaaatatttagacaaattgccacaaagtagaagtcaatactgaaaattgcttttctctttgctcttagtttgaaattgaggaggaggaagaaatgttgtcatccgtcataccagattccaggagagaaaatgaacttcccgatttcccccacattgatgagttttttacccttaactcaacaccatctagatctgcatatgatgagcctcatttgctcgtaaatattgagaaacagaaactagagttggaaaaacgacgactggatatcgaggccgaaaggctgcaggtagaaaaggaacgcctacaaatcgagaaagagaggctgcggcatttagacatggaacatgagcggcttcagctagagaaggagcggctgcagattgaaagagaaaagttgaggttacagatagtcaattcagagaaaccgtccttggaaaatgaacttggtcaaggagaaaaatccatgcttcaaccacaggacatagaaacagagaagttaaaacttgagcgagaacgcttgcaactggaaaaggataggctgcagtttttgaagtttgaatctgagaagctgcagattgaaaaggaacgcttacaggtagagaaagacagacttcgaattcagaaagaaggacacttgcagtgatttttccaggcttccatttagcaaatgtttgaaaactctagatttttctcatatcaggtgatataatgatggttgctggattagctgtggtttcttgtctaatgtcagtgttcagtaggaaaaagttatatgtggataactgtatgcctaagtagtatataaaagctgtgccctagcgtaaacagtatagcagaaacttactgtgctggactctttacc

SEQ ID NO: 10408 - DNA, 1060 bp, Homo sapiens
tcccaggccccaccgcagacctgaatcagagtctgcattttaatggggttcccaggtgattcatatacatgctatagtttgagagacacagctctagcaacatctaaaaaatgtttttcaattgtataatttttcttcatttcttattatttttcactgtggattccaacttcggctcttcatttgtcatttagaatcattcatatgcacgtcatttctctgttttcagtaaattctcttaaatttttttatcgcttaacattttcaacagacatagctttttaatgtatgtgatggaattagtatgtattcatgtaatacatataatttgtccataaatatttacatactattataaacgatttttctggaaagaatttcaagaaattgctaatagtagttacattggtggtagaaatttttcacttcattgtgaatttacattcttatttagattttctaactatatgtatattttgctgttttaaaaaaatgggactttaaataatgtagttctctataataaaaatttcttataagtagatttttaatataatgttgatcacctcaaagtaaaataaaataaatgtgctgtgggctaagaagcagccatatggctgagacagaaatgactgtgcacatgatccccaggttggtggtagacagagttaatgaacctgttgtagagcataggatgttctgtgtctgcgaatgttcctaagttgatctgtgaacatgtacacacacagacagatgcatttcctttgccaattttgttggcttgcatcaactatagcatctacgtggggattatgtgctaagacatccatactctaacatgacatttattgcatatattccattatgtgacttaatagtttattcatccagtccccttttgataaatatttctatttttaccatgcttttaccttaaaaatgtgatagtgatttttaaatggctcaaaaggctatgtaaatgctctgaaacattctgtgtattttggaaaccaaaatttatctttatcacatgtaggcatttgatttggtgggatgtgat

SEQ ID NO: 10409 - DNA, 1050 bp, Homo sapiens
cccagtctaactcgattcttcccaggggctctttttggacggtcccaaaggaggcagcgggagggaggtgaaagatactttgataaccgtcgacccataagtatacttgttatgcacctaccacgagttttagagaagaacatactttttggcagggaagtgaatcccctataagaatataggggaggggaaagccacactttaaagagaatttgggtagggtttgatattgtagatttgtgatgcttttcttcttgaactgcttaactaatttaccctcaaatttttttgatccggaacttgccgtctggtttttctcagacttcttaattctgacttatcatgaagtatctaggaacttcattctcaagttttagtgcttgtaaaaagttgcctggttatattatgccattggcagtacatcatcttcacaaggattacgtaagtgaactacatctcattcctgtttccaactagtgaagaacgattgtgaaatgggattttagaaaatggctgttctctgtgattgggcatagaaggtttgtaagttttagagactgcagctgttgaatcctttctgctaagagagcgatgacaggcaatagaaaagggatagtgtttgacatctaaaatgacatattttcacattttatgaggtgttatatccccagcaccaaaaatagtgcctttcacacagtaggagctcagtaagtattttttgaggaaattattggggaatgaatggatggtagaaaacccaagcttctgttacttggataccggcatataaaggagaggacaggaagacaaacatttctggaaatggcttttatccaggtaagcatatctacagaacttcaacaactcaagatgcatcaatgctggcactttcttgcacttaatcagaaaatatcaaggttttagaagaagattttcacacaattaagccaagactgggtatctaaggtgcatcccaatatcaatttcagtcaggttaaaaatgtattaaagcccatttgattaaatgaaatagttcatcagttcagaata

SEQ ID NO: 10410 - DNA, 1075 bp, Homo sapiens
cagctaatcccatattctaaaatagttttataaagtgattaatatttttagtttgtgtgtatgcatctgtgtttattgaatgtagatgtttcatgattgaaagaagtaagtttctttggaaggacttgggaatgcagagaagtaaagtttgtgtctttatttctaatatgttataaccagatcacggtttcagttaagtacctcattgccatcccatccttaagaaatgacctagttcagtggttcagctgatctgcttggaagtatctggctggcttcataagaattccgtagggagttttaggaatacagaagactagtctttaccttcagagatttggattcagtaggtctcaggtagggcctaggaatctgtgtttagaaaatcactctaagtaatgctaatatacagccagacttgggaatcattgaaaagtattcaaataatcccaattactaggaataaatacaagttgactgggatagtgatgttatttcatttgtagttattttgaaaagttaaatactctaggcctcataccattatttctttcacaaattttaattttagctttgatttccaatttgtggtcttctttctgagcatgaatcttcaaacttagagacagacgtcaacactgataagcatgagggatgaatattgctcactatagggctattaggcatactagatacagtaccattttcttagttactgccagagctgtgcagtatattacaacatttgctaatcctcaccaccgaggtaaaaactatgacctttgggacacagaagcaaatatcaaagtgacagccttacttctgaatgctttgatttttatgtcatgaaaagacatcaacttaatacttagtctcactatgtacttttcatattgaattgtacattatctgaaaactgatttccaagcaataccgtgtaacaacctttcaagcaataatttaagccatggtgatgatgccatatgaagcttgcacttctttgcatttcatagagcctttgtgaaaacagaaacatgttttatacaagcaataatatagctggtgtggacttttt

SEQ ID NO: 10411 - DNA, 1019 bp, Homo sapiens
gctgcattatgatttggttatgacataactcagttaaggaatatatttactaatttccaatgtagtctatgaggttcatttaatgtttttaaattttctatgtgtgtggctagaaggcatttgtagatatgcaaatatttgttataatcctgatcccttttataatttgagttattttcttgccctgggggtttacaaggacacgagtgcaacactctttatatggagaagacaggaaatagaccttgagctctaaacctttgcctgaccccctcttctgtgggcctgtgtttctggacaatggggaggtttacagccagtatgagcagagcagactgggagcacctcaatcctcatgcttatattagaaaatgccttagcaatgttgatgggctccttgtagcactggagcatggggagggaacaagctcactgatgtcatttatgcctattgtcttcagtaacttagaacttattatggtatattaaatcaataaaatgttggtgatgaacaatgtgttttgtaaccataaggctgaaagggacttccaggaatatccaatctatttctctcactttttataaagatttgtctaagcaactactctaaacacatatttattatctccatacttaagaatatctacgggaagcatatttgaaaagcatcattggaaatccacctcaatactagtgataggcctggagagaagtattgtatttatatatctcaatttatcagaagaatcacaaattctgtattagtttatatgattttacttagagaataagtatccatttacattgccataaatgtcacgatgaagaacgtgccagagatttcttatttatcactgacaggatgtcaactacatttttcatacattataacctaagtgtattttcacagctatagtccgagataatggtccaatttgttatcattttgctaatctattatagttgattattgtagttacaatgttgctatatatgtttatgaggtactatataaaatg

SEQ ID NO: 10412 - DNA, 1069 bp, Homo sapiens
aaatcatgctactataaagacatatgcacacgtatgtttattgtggcactgttcacaatagcaaagtcttggaaccaacccaaatgtccatcagtaatagactgcataaagaaaatgtggcacatatgcaccaaggaatactatgcagccataaaaaggatgacttcatgtcctttgcagggacatggatgaagctggaaaccatcattctcagcaaactatcacaaggacggaaaaccaacactgcatattctcactcataagtgggagttgaacaatgagaacacatgggcacagggaggggaacatcacacaccagggcctgctggggggtcggggcttgggggaaggatagcattaggagaaatacctaatgtaaataagttgatgggtgcagcacaccaacatggcacatgtatacctatgtaacaaaactgcatgttgtgcacatgtaccccagaacttaaagtataataaaactatattctattgaataaacctttttgaaccataatatggcattaaacattccagattattgccattctgtacattgctatctctttaccatattcaccaagtttaccttagccatgttgttaattggtttgttatatttatattaggttttgttacgtttatattttgtttattttcttattctatccatctttcttggccagctcaaatcctaagaagtcatctccaacactcactatctccttagtagcaattacttccttcttccttaggaaactgataactttgtcacaatttactgttggtatttaacatattgtaacttgcaaataaattgtgtgtgtaaattcctgtgttgtatgtactaggctgtgagaactttcctgtttgggactatgtcctgttcatctttgtatatcatagtgcaaggaatttattatttgtgaattaaacagatttatcaatgtagaaatatataaaattctgcagcaaaatatggaaaattatatcctgatatacgtttgttaattctttattcatttttcatacattggttttacatataaaatattatcaagacactaccatg

SEQ ID NO: 10413 - DNA, 1072 bp, Homo sapiens
aaagctttcctgtgatattagagaagagtaagatattgttcttgataacatcctgcaactcatcatttatagcataataagcccttccactctgattctgttagacaggcccatccatggcaagatattaaacaaaacaggatttattgaaaacatgtctgataatagcaatgatattgaaaaagagcaaaacagtacaatcctggtttttatgtttctgctttgaccacaggcttaaaatgtgtatttcaagcctataaatattgattgtgagacacaagaaacataatataaatattttgaaggaatagtaattaagagcagtgagtcacaggtagctaccagatgaaaataataaacccaactttgtcagggcttcagatcagagtaaggtttcaattttgatatccacggagaagagccaaattgaagatgaatatgagtaaatattgatgatccatactactgaatttgtctggtgataaatgtttcttaggtattgcacatattccgaactcataaatacatatactacataaaaacatggaaaaaacccttcagaaatgttttcctgtattatattttcagaaagtcacaagttttagagaaatcatataagcagaatggcagacagcatgggccatatttccatgtcaaaagtaaattgaaaatctaaattagtacctgaggttaaaaatacttatgtccacagattccagaatacaaaggaaaagtaatgccagccaaatctgaaacataaacaactataagttttctttgtatttgaaaatatggccttggaactctgtataagaagatgcttacttcataaacatacatgtgcaagtgtctttttcatataatgacttctttaagagtgccctccaatgatatgacaagatgctgaccgatgttatacctcatttcctgaaagtttctaagtgctctatgatggatcctatggtggtgagagtcaacaacctttgtcataataaataggagatttttctcacaattttcgaagtaatgtgacattaaaaataaggataggaaggagacaaggaaagaagaa

SEQ ID NO: 10414 - DNA, 1035 bp, Homo sapiens
aaattatcacaaacttaatgtcttaaaacatcacaaattatcttattgttctgtaggtcagaagtctgaaatgagttttacaaagccagaattaaggaattggcagagctgcattacttctggaagctccagggaaaaatccatttgcttcccctttccaacttcttcttttttttttttttttttaacttttaagttgaaaggtacacgtgcaggtttgctatataggtaaactcatatcatgggggatttgttgtacagattattttcttgaccatgtattaggcctagtacccattagttatttttccagatcctctccctcttcccaccttctaccctccagtaggccccagtgtttggtgttcccatctatgtttccatgtgttttgatcttttggctcccacttaaaagtgagaacatgcagtatttgattttctgttcctgcattagtttgttaagtataatgacctccaggtccatctgtgttcctgcaaaggacaagatctcattcttttttatggttatatggtattctatggtatatatgtaccatattttctttatccagtctaccattgatgggcatttaggttggttctatttgctactatgaatagtgaggaaatgaacatagatgttccttgtgtccttatgacagaacaatttgtattcctttgggtatacatacaatgatgagatggctaggtcgaatggttatttatgtttttaggtctttgaggaatcgccacattgttttccacaatggttgaactgatttacactcccactcacagtgtataagtgcttttattcttcataaccgtgccagcacctgttattttttgactttttaataatagccattcttatttgtgtgagatgatatttcattgtggttttgatttgcatttctttaatgatcagtaattttgagttttttttcatatattgttagctgcttgtataccttttttgaaaagtgtctgtttatgtcctttgtccactttttaatgggtttgtttgggtttttc

SEQ ID NO: 10415 - DNA, 1067 bp, Homo sapiens
tatttatgtgctgcaggattgggtggtggcaggttttgaaaaactgatgactaatatactcgatgattataatagaaatagtgcctgctgcttggtaggtacttagatttttatcaaaagaataaatttatgcatgaaatcgtaagaaggggcaacaagcagatgcatgtggaagagtgtcatggaaagacactcagaggagataagatttgagttgaacttgaaaggatagttagccatcagcaaggtagatataggggctggagtgaggaatttgaagcaaaagagatatgcctctctgtacaaaggcagagatgcagggtgaggctggagtacaggatgcatgcagaggaggaataaaagtgcgcccttagcaacccagaattattatttggactttgtcctgaaggaaatagaaagccattggaggactctaagatggactgtgataagatcaaatttagaaatatgatttctggtgactatctttttgacagtttagagattttgaagagggtaatactgtgggccttttggagtattccacgttgaaagtgtctgtcctactagacagttgaatagtcatggtcttttattttgtttttgttttatttcaaattaaacatgaacaaatttatatttcatatagtataaatatttgtatatatttatgtttataaacagttgtacagatcattgtagataacataagcacacactttgtatatgtgtatacaaatacatatacaaatatcatatacatatgtggtatccagataggatgaggtttgtgcatgagtcactgaagacccaaaataacagaagtttgtatttctttcatgagaaagaaatatgtaggcagtctagagttgttatttgtgtttcagatatctagacaccttttatcattttgttctgcttcttatagcctgtaacttttccccattgcccaggatgtctgcttgagtttcagcattatgtatgcattccaattaacaggaaggaggaaaggatggaagactttaaggacacttttactataaagacacattcaacatgacatttta

SEQ ID NO: 10416 - DNA, 1035 bp, Homo sapiens
tatgtattttgcaaatattttctcccagtctgtggcttgtcttttcattctctttatattgttttctgtggagcatagatttttaattttaatgaagtcaagttcatcaatttttttaaatacatcatgcctttgtcatcttatctgaaaagtcattgccaaactcaagttgttctatattatcttgtatgttatcttccaggaattttatagttttgcatttaacatttggtctgtgatccattttgcattttttgtgaaagatatgaggtctgtatctagattcaatttttttttttgtaattcgatgtccagttgttctagcaccatttgttgaaaaaaggtatctttttttcattgcattgcttttgctcctttgtcaaagatcagttttactatatatatatatttgtagttctatttctggggtctttattctgttctattgatcaatttgtctattcttttgcaaataccactctattttgatttctgtggttctataataagtcttgaggttgggtaatgtcagtcctccaactttatttttctccttcaatatcgtgttgtatatttcaagtattttgcctacttcatgtaaacgtaagaatcagtttgttgatattcccaaaatagtttgctgggattttaacagagatttcattgaatctatagagcaagtggggaagaactaatattgtgataatattgtatctttctatttatgaacatagactctctctccacttatgtagtttttctttaatttctttcatcagagttttgttattttcttcataatgatcttgtacatattttttaggtctataagtattttattttggggtatgctaatgtaaatgtattgtatttttaattttaaattttacttgttcagtgctgttatacagaaaagtaatgggattttgtatattaaccctatacactgaaattttgctataatcattttattagtctcaggaatttttttgttggttcttttgaattttctacatagatattcatgtgatctct

SEQ ID NO: 10417 - DNA, 1045 bp, Homo sapiens
tagatgccattaagaacattgacgattcatgggaggtggtcaaaatgtcaatattaacagaaatttggaaggcattgatttcagttctcagagataactttgagggcttcaggattttagtggaggaagttactgcagatgctggtgaaaatagcaggaagactagagttagaagtggggcctgaagatgtgactacatagatgcactctcacagtagaacttgaacatatgaggagttgattcttatggatgaacaaagaaagtggtttcttgagatggaatccacccctggtaaagatgtgtgaacgttgttgaaatgacaacaaaggatttaggatattacataatagggcagcagcagggtttgagaggattgactccaattgtgaaagaagttcctctgtgggtaaaatgctatcaaatatcattgcatgttagagagaaatctttcataaagtaagggtcaatcaatatggcaaactttattgtttcaagaaattgtcagaactacctcaaccttcagcaacaaccctctgatcagttagcagccaacaacagaggcaaaacctacaccagcagaaggattacaagttgctgaaggctcagataatcattagcatttttagcaataaagcattttaaagtcaaagtatgtttgtcgcttttttagacataatggtattgcacacttaatagactacagtatagtgtaaacataatttgtatatgcactaggaaaccaaaaaaattcatgtgactccctttattttagtattcaggaacctaacttacaatatctctgagctatgcctgtacagaaaaactggatatatagaagatagtttcagaaattattcagaaaaggaagcttatcattagaaacacacgagtcttattcagatttactgcagatattacatgcctattcaagtataaatatgtttacttcgttaaattggcccacgcaattatgtcttttagattaataattatgtttgttttgtggctgggagaggtggctcatgcctggaatcccagtacatt

SEQ ID NO: 10418 - DNA, 1117 bp, Homo sapiens
taggctttcttctagggtttttgtagttttaggtcttacgtttaagtgtttaatccatcttgagttaatttttgtataaggtgtaagcaagtgttcttttaaaagcatcttatacgtgttgctgcagttctaaagaataactagtgataaaccttgtcacagaaatctgtacatacatgcaaaacataggtcatgaaaagcatgagctgcattaaggacatgaaggaatttctcatggggttattttaggaagtttttgagatagttcttatctcagacatgtgagcatgagctgccctcctttgtgctttcctggctctaatttgtttagaccggccatgagtgattccatcctggtatctgcaacttcacagggtcttggcttatttgggcttcttttctgtcagtgataagtgcttgatcccaattctctaagtgatatggactgagttgtgttgcccccaaaagttatgtgttgaaggcgtacccttcatgtaactgtattggagataaggactttaaagaagtgattaaggttaaatgaggtcataatgttggagccctggtctgatagaactggtgccctcactagaacctgacaatgctaccatctgatcttgtaactttcaacttccagatatgtgagaaaataagtttctgttgtttaagccacccaatctatgatattattgcagctttatctgactaagacactgtctgacattagagtgattgtcatattaattaatgctctgggagatagaattatgagtcagctttctattagaaatgattttataacagtctatttttgttctagggtgtttaggcattaaataaagtaaatgatccattggttgtatctttccatgtttgccgactcttaatgaactacatgaaatggcaactaccttttctagccacctcagtgccttacattcatggttaggcattatgcatcatttcctgtcttttctgacactcaggatatgaaattattttgccatgtaattcaattaggtcactgaaacactttgtgagttagacttctgtaatgcaaaatcgtgttgcttatatatcttcattttttttcagagcaggagtcatttcaagagtc

SEQ ID NO: 10419 - DNA, 1034 bp, Homo sapiens
cacattttatttttctgaaaataatcaaaatccaagtacagtcatacactacacattgatggtttagtcagattgactgcatatatgacagtggtcccataggattgtaaagccgtattttatcataccttttcaatgtttagacacaaaaataccattgtgttccagttcttacagtattcaggatagtcacatactgtatagatttgcagcctaggagcaataagctctaccatttagcctatgtgcattgtaggctatgcctctaggtttgtgtaagtataccctgttgttcatataatggtgaaattgcccaacagtgtgcttctgagatgtatttctcttgttgttaagtgattcatgactgtatttatgtttgaatcatacaataatcttggttcgttttccgtttttcctaatgaagacatggtggttttttttttttccttggagatacaggggggtcaaaaatctgagcatattgtaggtgacaagcagtggaagttgattccaaaactcttgctttttgaaggagaggtcaagaattatatttcttgtcagcacagactcatctgtgaagttgttgttggctgatgttaaaaatgcttgtaataacatgtgtaggttcttcaaaggattgagatttcaagcttacatgtctcaaaattttgagtgaagcagtgactcttttttggccattgaacaccagcttcagaaatccttccatccactgtagaagaggtgtgagggaatctctttctctctgtgaacatatatggagaactcatactatgatttatggcagcttgcattttcatatttttctaatttagatgttactatgaataaggtaggtgtagatctaacaatagaattgccataaacaggagttagaaattcttaacatcctacagtaaaagaattttgtgctactctgatacattttttaggtaggttataaattcttatcttactatcttaatatgactaattatgacagctatttttcagtagtttaattaccattctaccct

SEQ ID NO: 10420 - DNA, 1050 bp, Homo sapiens
atttcagtgtaactttgaggtgatataaccaacagggtcccatttgttgaaggtgttgaaatataagatgtccacaaatggtctttgttaatatcgttatgctctcctaacccccagcttgcctgagttaagattcctttcaacactatcaacagccagtgagtcaaactcacttaactaaagctcctttactcaatacattctcataacaaaattctcaaatttcttagaaactcttctatttttgttttctcaaagatagtattactgccatttaaaatctgcaaaactccttagttggataaaacaaaacagaacaaaacaaaaacacttagctctgacttggagcagaagaaatggaagcacagctaggtcaggctgcttgcatggggtcacaccattagcctctggggagggcagtgtttgaactatgaggctgtgatggtagagcctgctacattacttattgacccctcaactgcttctgttaccaaacagtaattgttattattgctttttctctgagttagaaggaagattattcttcccttactatgtgagaaacatgattgtgggcctgtaatcacttcatatgtcaaactcatagcttattttgttgccatctcatggagcagatttatagtgacttgtcacatttgctttttgaaatactgtttttttttgtctttatttctttgaatcttttagctcaagtgagcataccaccttcctttctcccccaacccttttcttttgtgttagaagacttttgttaagtaaatgaattatttcccattcatgaggctgatgtttttgtccattgtgttatctctctgctttcattgttctttgatgcataactctgactcaactacaaattttaatagcattctgtttaattcttctgacagttagtgaaaatttaagtaagattagagttaaattcaaacatcctgggttctatgctagatgagttgttgttcttactagtcttgagttcggttcttcagtcaattttaagtacttttgacagcatttctattgtaattt

SEQ ID NO: 10421 - DNA, 1050 bp, Homo sapiens
aaaccatgacctgggcattggttgtactcattgctattggggtgttttgcttctacgccctctcagctgacagagcaagagaatatatgtgtgtagactaactcatatatatatgcccatctataaacatttttatatgtattcatcatatgctaaatatgagttaatactgatgtctccaactttactccattaccatatggatcattctaacctttccctcttgcttgtctatatccttctttctaacaaggagaaacctgactccctttagccatccatttactgaattcttcaattccagtgtacgtttatagttgtttcagaattgttaacagaaactcccaggggaaacaattttatcaactaaaatacagtgcctatgggcagtttgggagtatgtagttatgtataaagctttatagtgtccactcatatccagggttacttaggtaagcacctttctaccccaccacttccagtaagatttttttcatatatttgtaatacagctagattcttttattatagtcttccatcctgtgatactttgacctcctaaacacacacacacacacacacacacatttaaatttgtatacagtaagtttagctcttctgctgtaaagttctatgggtattgaaaaatgcataatgtcatataactgccattataacatcataccaaatacttgcactcttctaaaaaaaatcccgtgtttcacttgttcaaccgcatgtcacctccaaatccctggcaagtaccgatctgtttgccatgctatagttttgccttcaccagagtgtcatataaatgtaatcatatagtatatagccttttcactggctccttttgtttagaaatgtgaatttaagattaatccatgtctttggcagagagctcattcctttccccccacccccctgaaaaatattccatttaacatgtaccacagtttgcttatccattcattaattgaaggataccttggttccttacatgtttggttattatgaattaactgctataaaacattcacttgcaagttt

SEQ ID NO: 10422 - DNA, 1046 bp, Homo sapiens
cacccctaggacttttacttttttaaagtttccgaaatgaatctgaacactgatcttgtttgattactgttgagtctctcttttgagattactactgcaaatgatggtaggggggacctaagaaggagtggaaccctgaggggactgagtacgggtaccagacaggtctacaaatattcttgtggcacttgtattaatggagaatgatttttttcttttacgagacctgattgaagatgtataaatcacttattacattatttattttgaactaatttaattcttaggaacacatattgagaaacagtcatcttcctattcttgtgtattttcgtatttgatatatctttctgccactttttctttcatcattaacctagaaaacaatcctcagaatagattggctactctttgctgttcttccctgccaatatttcccaggcagcgtaattttataaactatttgatgttgcaaattgttgaaaatatttatttacaacaggagtccaatgaccccgagcgtctgtaggcttgtgtcagtacttaaagcaacatttgtgcaataaaatagttatttagtacaacagattcttatttaatgaaatgattttgctaaagataatgattagtttggggagaattgttgatataaccttggaggtttttttttttttttttttttttttttttttttttttgcctaagagaatttacagatttctaaaaagtaatgtcaatgcctctgataatgctaatttaagctaagactattttcaacaacttacatgaggagtagataaaagaaactgagaaatgcagtattttctgctagaataagaggaaggaaatagtctctgatggttacttttataagttaaatttgaatgactggctttttgctggatgaaaagaatgtatccagagaatggttttcagaataagcaatttaaaaataattgtgatgatcaaataaatgcaacagctctatatactttccatgccatagttgttttctattatgaaaagggtctgtcaggtggacgctg

SEQ ID NO: 10423 - DNA, 1085 bp, Homo sapiens
cctggctcggtggctcacgcctgtaattccagcactttgggaggctgaggcgggcagatcacgaggtcaggagatcaaggccatcctggctaacatggtgaaaccccatctctactaaaaatacaaaaaattagcctggtgtggtggtgggcgcctgtagtcctggctactcgggaggctgaggcaggagaatggcgtgaacccgggaggcagagcttgcagtgagccgagagtgcgccactgcactccagcctgggcaacagagcgagactccgtctcaaaaaaaaaaaaagaaaaaaagaaaaatttttttttcaagtttaaatagttttactgagatgtgtcttggagttaacattcaaagtttacttttccagttaactggaaatccctttcaaaatgtagattcagatcctttttatttctgataatttttcatggattataatgttaaatattctgttccattgttttttatttcttcttcaggggttccaattatatgtgagttatttatcttttgttcaactttctctttctgaccatttttccttcttttctgtatcgtatttatttgtttatttttgcatctatccagtgtctaagttttcattagtctgttttcctttggacaccttgtaatttagtcttcatttataattcccccccttccatttctttcttgaattcaataatctttaaatttactcgtggtttttttaatctatttctgttttttatattttgaatttccaattcacggtgctttttcatatccccaaatgcttatctgaggattttattcagtttgatatgttgtgttacaattttcttctgatttaatggttgctttttggtagagaattttcatcagccaatgcatgttaattattgtttgctgatttctcatactaccattatatagatttagtccatttccttccattcatttttttgaatttgaggggttataagattcctagttcagaaggactctctctgtcagcatagaaaatacaatttctttagggggtgttttttttaactttatagtagagggagggattatgtatgttccagttttt

SEQ ID NO: 10424 - DNA, 1023 bp, Homo sapiens
aatggatctaacatatatacagaacatttcatccaatagcaacagaatacacattattttcaagctcacacagagctttctgcagaatagatcatacattaagctacaaaagaaaacttaacaaatttaagcaggttaaagtcatatccagtatctttcaaccacagtggtatgaaattaggaattaataataggaaaaatgtcagaaaattcacaatatgtagaattaaaccaaattctcctgtacaaccagtgggtcaaagacaaaagtaaaagggacattaaaaattgtcttgagacaaatgaaaatggaaacaccacatgccaaaacttgcgggtagcagccaaagcagtcccaagaggaagataatagcaataaacacctatatcgaaaaagaagaaagactgtgaaccatctaactttatatcttagggaactagaaagagaagaataaattaaggccaaagttagtaggaggaaggaaataataaagatcagagcagaaataaacacaaactagaaaaacaacagaaaagaacaaaactaacagttggtttttaagataaaatcaacaaaccttgatctaaactaagaaatgagagaaggctaaaataaaattagaaaataaagcagagacattatacatgatactacagatataccaaggatcttacgagattgccatgaacttgctaacaaattggataacctagaagaaatggatgaattcctaaaaccatagaatctatatgagccgtatactttcttaacatttctgccatcctccctatcctctttggtatagcctctcttcagactgcctccttagctctcttctggatcactataacagcctaacaattgtatcaccttcagttttgctcttccttccatatgactaaataaatgaaaaatttgatcagacattaacgagtagggagagtgaattggtaataaaaggtccacttattttgtcttacagtgagagtggcttgctattatctcccattattgatgcattt

SEQ ID NO: 10425 - DNA, 1049 bp, Homo sapiens
aaaaataaaaaatcagctgggtatggtggtacttatctgtagtttcagctatgcaggaagctgaggtgggatgatcacttgagtttaggtggatgtctgaaactgtggatggtaccaaacccctatatatgctatgttttttcctattcatacatacctatgataaattttaacttataaagtataattgatagacatagtaagagattaaccacaataatcataaaatacaagtatagcaatatgccagcattgctactctcgcagtttcaggctattattaagtaaaataagggttacttgaacacaaactctcttatgctgcaacagtcagtcataactgaaatagctactgaataactaaatagacagacaggtagcatacacagcatggttgtgctggacaaagggctgattcatgtcccctgggggggatggagtagaacagcatatttcatcacactactcagaatgccatacaatctaaaacttatgaattgtttatttctgaaattttccatgtaatattttcaaaccacagttgactgcaggtaactgcagccacaggaagtaaaaccacaggtaaaggggggttactgtattgtataggattgcttatttaatattagctgatttggcaataattgcatcttcattactttccctaaacattttacatctttgatttttttaattgacgtttagataaattgacgtttagataaattattgaatgtgcagctgatacacattcagtccagacttttaaaaaaaattttgatcaatttatatattattgaatttgtagtagtgttgtattaatatcttgacaaatgtgttatttttattcaagcaaattgttttttttttgtattatttaatggaggtgttttttctaaatatgcaaagcaatgccagttcctacctatgtgcagtggggccaatggaagtacaggttgctatggaaatgctgatttcacattgggatttttagttcatcctgcctgataattacagcagagtagcaatttgttttgtatgtttaatga

SEQ ID NO: 10426 - DNA, 1049 bp, Homo sapiens
tccaatcctaattctttaatatgttagtcctaatctgcccttccataacttgtgcctgttaataatccttcaatggagtcacattatgtatacatttaatctaaaggaatttagctttgtactttataagaaaagataacgcaggaaattaagctcaacatttgtaacaaagaatgaaataatgtttgcctaatggtgtagtagctttaaagttttgtctacactgctgataaagaggagaaatgcattttggtccctttgcatgtacgtagagggggtttatggacattctctttaaagaaattgaggaattaactaagggccatagagaaacattaataaataaacagatacattcatcattttgtatataaatcaggtacttgactagttatttgaagtatttccagtagtagtttgaccatattcaattactgctttaacactgtcttttggatctgattcttgggtgcatcgttcactgtgttcacaagttcacttgtcattggtgtgattcccagaatatgtgaactgttagactgtgtctttttttttttttaatgttttagcatcccaatccctgcagttgatcccctaagcacagtacaacagaaaaaaagttacaagactataaaaaacttgcttgtggtttacttttaatatttaaacagtgaggtttgacctttactcaatgaatactttgcagttccttctttgtagaaggcctttgcactctcaattttctaggtcaaatattttaaatctaaagtaaacattattgtagctttgcatttattctgtttaccttgccatgttactgtaggcacacttttcctgaggtatggtcttgcttgacacagagtaggtatgcaaaaatattatttccttttagtcatttagctagttttttccccagccaagtaaaaaaggtcaatggatgtacctattttctatacagttcagcttgtattttttaaccctccttaaagtatctgtcatttctgtcctgtgcagttagaaataccatcttaggcattactagagggctt

SEQ ID NO: 10427 - DNA, 1048 bp, Homo sapiens
actgagccgttcctaattttagatatcttgtttaatttttctcctttgtagtcaatggaaatatttcagtcaaaattagaagatgctgaaaaagctgcatccacgaaagaagattatagacgggaacggtggaggaaacccacatattcagataaagcacaaaattgtcaagaaagtagagaatcagacttagtaaaatatggtaacagttcaagggatagatatgctacaacagatactgcaaaaaatagcaataatgaaaaatttattggtgatgaaaaagataagagacctgggtctttagaaacgtgtagaagagaatctaacccaaggcaaaatcaagagttttcttttggcaatttgagagctaaattcttgagaccctctgatgatgaagaactgtcatttcacagcaagggcagaaaatttgaaccacttagttcatcttcagcattggtagctcagggctctttgtgtagtggttttagaaaacccaccaagaacagtgaagaaagattaacatcatggagtcgctctgatgggagaggagacaagaaacattcaaatcaaaagccatcggaaaccagtactgatgaacaccaacatgttccagaagacccaagagaaaaatcacaagatgaagtcttgagagatgaccctccaaaaaaagaacatctacgggatacaaagtctacatttgctgggtattttatcattttttaacctaataagttaagatccagagagttcaaagaacagaactgtatttttagaacatcagttattagctgtgactatgatctcacatttcttaaaattgatagaaggggtaagatatgcagatttaacaggcagtattgtggtatggattgcattttatttcataggtttttttttttttaagagctgaaagcagtagctatatttgttcaaaatatgttgctgctttgcaatttaaaaaactgaatgagttaatgttttaaatgtatgtgctgcaggagatattttggtagattttgttaccaatgccattactttctaaggaaat

SEQ ID NO: 10428 - DNA, 1029 bp, Homo sapiens
tagagttaagcaaactagtgtatcatttatcttacgtagttattctccttttttttttgtggtaaaaatacctaaaatctactctcttagcaaattttcagtatataatgtgatattattaactgtagtcctcatactgtacatcgtatctccaggcttagttatcttacataatggaaacttctgactctttgacctccatcttctcatcccctctccttccagtaaccaccttcctactttctgtttctatgtatgatgcatcttttccttgaaaattgttttaaagtttgcaactacaagaacagttatttagacttgaccattgcatttgacatttggtttttagcatctgttctttttttcagagatctttgcccgaattcattgatggtgtgtcttaatcatcttgagtaatttttttccctcagaattgctagtgatatgccctctgattccctgcatttttgaaaatgattttctttggcccataccaaggaaggataatttgactgtgaattgaattctctatatagaattatagcttaattttgttttcaaaatttaatcttcattctattatttacttattattatggatgaacagctgtaagtctgtctttcctttgtggataatttgttatttatctacccctatccatatacaggctcacacttattcactccttccctgatctagtccttgtaaaggtttttttttttttccttgagttttgagattcaggtattagggtttttttctgtgtttttcttctttctcccccacccaaggctattggatgagtccttctgagaaatcggctggggaaattttcttatatatttttaaaattaatgctctattcccatcatctttgctccatctttctggaagtactaataaatgcatattagattttctagaatcaattgttcatgtatctttttttcttataacttacatttatttactaccttttcctaaaatatagagaattcccaggttaatttagttttcagcactgtctt

SEQ ID NO: 10429 - DNA, 1029 bp, Homo sapiens
ccgaattggaatttttttacatttattttgaccatttgtattttttagtgaattgactattgatattgttttccatttttcttttgggataataatttaagactttttaataaatctgttcagatttctccccctcggcttgatgttttttacttcgttgataatttgctatggataagttttaaatatttttacctatcaaaatccctcatattattttttcatgaattagtgctcttggtataatttattgacaggccttccccaccccacaatcgtaaaaatatgcagctgtacttacttgagtgcttgttcagttttattttttatgttttatctttaatttttctggaatatatatttgtgcatggtatgaaataggcatcaaactttgcataagtcttatatagttgtttgctatatattgaatgaattattttttctcactaatttgaaatgacacatttgttatacattaaattttctcatatacatgggtctgttcctttactctcggatctgtttcattgatttttctatcttttcctggaatttgtatcatacttttctaattattgtggttttcagtaaattatgcagatagcaaataataaacacctactatgtggtagtcactatgtgataaatctcttgttagtcaccaaaaaaattagctttgctttcttatgtgtttagttttcttagtaaatttagtttaagctcaatagaaataaatatttttccaaaatttgttataaatttacgactctttttggagtttttatttaaatttaactaaatgtatagataaattaaggacaactagtatctttataatatagagtcatcccatcccaaaacactatttatttatgctcttcagtatttttctctgtgcagttattatgcatatgccattgaggttatttttatttttttatattataaattgaattttaaaaatgttttctgacttggtgttggtgctggtcggccaattctttaaacttttattatcctaattttaaa

SEQ ID NO: 10430 - DNA, 1034 bp, Homo sapiens
acctcatgccttaattttcttaacaatacttaacagttgaatagttcaaaaattttgggctatagttcatctgcctcaggaagaatgtaatttgtccactgttagccacaggtgaaggaagaaaggtgaacaggaactaagtttgattgcttgttgtgtgccaggctttgggctggatgctttagatctgttatcttgtttactctttaaaacaatcctgaaaggtagggattttataccattttatagaggagagactaaagtatagagagatttagaagcttgcttcaagttatatagccatgtaggacttgtttcaggtttgattgcctccaaagtccctgctcttattaccaagtgtttattaaattctaatcagttcagattgaaatgatgagtggatgactgttgattttatgtctttttttttaacagagggatgagtggatgactgttgattttatgtctgttaaaactgtgtcatcatcatcactcaaagctgaaaaggaaactatgaggaaaatagagcaagagaaaaaccaagcgcttgaacaggtaagagaatatttgaaatgctttaactttctaatttacctttaataaacttacaagacatttatataaatgcagtttaacttgtaaaataccattttattttttatagtatttaatacaattagtgagaacaactatgaaatacatcagtttaagaaaaataaatttcctataggaagtgagtttaaaggtttactagatttataaatctagggcatatataaagttgagtgaatattgagtttaatatcattaaattgaaagtgaactcactcaatttttgtttcagtgtacatactgaattagacaccatgaaaatacttccatttcaagacatctagaaattctggtggatataatgtaaaataagcatgcttattttatactttattgttgtcactttgctagtaaggaagcaataggaaatctgtagagaccaaaaaatgaggcaaaagcatgaatccagagaagtaaggaag

SEQ ID NO: 10431 - DNA, 1029 bp, Homo sapiens
ttttttaaatggttaccctagacatgacaacatgtatctctgacattatagtctaccttaaattggcatgattaccccttcctgacaatgtaagacttcattaataacatttaaccccttctgccctttattgcattattattatatgctactgttttattgttttaagctctcaaccttcatttatatttcttcactttatttaccctttctggtattcttccttttctcctacatcttcagagtttcagaggaagtaagtttcttttgctcgaagagttctctgtgctgttttctttagtgacacattctctcagcttgtgtgtatctgaaacctctttatgttgccttcatcttacaaattatatttttagtaggtattaaattctcgattgacactgttttctgtattttcccctctttttcatctctgtgcttcaatctgggtaacttatactgacttgaactatagtttaatacttatctttgtaaatgtatctaatttgctaaaaatttaaattcatcttgttttctagaatttccgacttcttaatgtattttatcattactgaaattcttgatcttttcctctggttttttgagcatactaaccatagttattaaaaaggctttgtctggggatttatttctatggtcttttttttttctctgtttttcagtcctttggtcctcatttttaacatacttcataatttttcactgtatgctgggcattttatgttaaaagatttgggtactttttctctgaaggaagttaaatttttctaaggagaagcagataaagtataagcagatcactttcattctgcagagaactggttttatgctttattggggatgatttatatctattttatttttgttcctacttctgtaatgtagcccttctgggtctcaagtgaaagcctggaatgtactccaaggctattttataccttggcagatcttaaattccaatgtctgtctctctaacattggctgctaaaatttttgtttagcattttaact

SEQ ID NO: 10432 - DNA, 1050 bp, Homo sapiens
tggagtttttgaaggctttgccaagtggttcaatagtggctgatattggatgtggtaatggaaagtatcttggcatcaataaggagttatatatggcaagtaatgttgcttttgactttctttttgcttaatttgcagtggttatcatcatctttcttcctcatgatataatcctgtttttttagatcattgccagaaagttataaccaacagattgaaaattaatgattttttttattctttcttattcctctaggaatttatgggcacaccatcattatataattttttttctccctttagattttgctttctaccatattattttatcagtaaaactatcttatagttataaaactctttacagattagaaaggatttttatagaaatcattttttggcttggatccccctaagtatgaagaagataaagctgatattttcatccatcttttgtaaatgaagaaattggggctcacagtgatcatattaatttcctgatgtcatataattaggggacataactggaacttgaacctatatcttctactccaaactttattcatagtagaaaaaaattttctatttattggtatcttactgttgaggaaaggaagtctcaaacagattaaaaacttgaccaaggttacagtgctagacccagaatttgaacccatttctgtctgattccagaatgtctgttttcagttactatttttttctatgagccattttttttctgctgtgctaagaagtaggatattcttgttttagtgtattgttgtaagtaatcattttttaacattgctctgtgaggactggagcttccgtttctctagattaggggatttaggatgagagtaagggagtaggtaaaaagaacgagagcagctgacattcctgggttgttggagtatgtcagattacttctcatctttatttttactccatcctagatattgtgcacctacatgaagaaagttactacaattgtcccttggtatataaaattgaagctaaatcaaataataaataaaatgcatatttaat

SEQ ID NO: 10433 - DNA, 1055 bp, Homo sapiens
tgtggatgaaataccttttttttgtcattcagttgattctcatgtacagtaaagtttgagaaccactgtgctatgcttttctgcaagcattattatgttttaatctctgttagcctagaaaaatagccaaactctattaatcattcttatccttggagtatatgaaattttggattgatctttatgcttttatctttgcttcaagattgtcatggattttaagcacccagatggcattgcagtgccagttatgttgcctcgtcggagtttgctggtgatgacaggagaatctagatacctttggacccatgggtatgtattgaaatatgacaggattctttttctttatgagacttctcattcttctgtgtttgagccacggggaccatgccctgtgcctgcagattgaggcttctgggttcagaactcctaggggcatctatctagtttcgtttttgttaaacattacctttttacttggaaaaaattcttaatttatagcaaacttgcaagcatagtacagtgaactcccttcacctttcaccttcatttactaattttgaatatttgggacattttttatttctctctcacatatgttatcattattatttttactgaatcattttagagtaagttatagacatcatggcttactcttccatgcttcattgtgtatttcctaagaacaaggacattgtgtatgtcagggattggcaagctatggctagtgggccacattcagctctcaggctgtttttgtacagctcttgagctaagaatggtttttacatttttaaaggttgtaagacaaaaaaacaatgaagaatatttgacagagactatgtgtggccctcagtgcctgaaatattcactctctggccccttacagaaaaagttggccaagctctgttctataaaaccacagtgcagtgctcaaattcaggaaattcaacattgataaaatactcttattatactcttatacaatccatattcaaatattgctagttgtatgttatagtgctttaagcattctttctgatcgaggattc

SEQ ID NO: 10434 - DNA, 1038 bp, Homo sapiens
gttgtacagcctagagtgcagtggcaccatcacagctcactgcatccttgaactccgggctcaagtgatcctctcaccttagcctcccaagtagctgggactacaggagtgcaccaccacacccaaggtttttttttgttgttgtttttttttttttttgtacagacagggtttcaccatgttgcccaggctgatatcgaactcctggactcaagcagtctgcccgccacagcctcccaaagtgctaagattacaggcgtgagccaccgtgcccagctgtcatcccatttttaactatgtgtttttggcaactcatttcacctctctgtatcttcattttctcatgtataaaattggattgtaatttcagtctcatggaattgtgaggattaaatgagtgaatccaggtaaagctcttagtacagggctggcaataataaatgctcaataaatactgactcctattataaatactgactcctattatttcttaattacccatcttttagctaatgagagatatgttttaaactgttgattctctttccatgcagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcaggtgagacggtgtcacatgtttgtgcttcaatcacagcaaatttgtttatgttttcacttttatatcaacaaagaaacttgtttactggagtatttctttttaagtcactgtgtaggtgagaacactttgccacactttgtgttgaattcagttgatagtataaaatctaattgaggtctatgaattcatccaatcttcaagtgagttaaacgtctccttggattgagagagaaaattacagttgatactataaaatctaattaaggtccatgaattcacccagtctacaagtgagttaagtgtctctttggattgagagagaaa

SEQ ID NO: 10435 - DNA, 1135 bp, Homo sapiens
tctatgtgctagtaagttacaataaacagaaaagacagactaattcatcacatagttgtataaaacccaatgttgtgggggagtttttaaaaatagctcttatagtcatggtcttcagggaattcatcatctttttggagaaattttcaagaaaaacttgaatttcagccggttatggtggctcacgcctgtaatcccagcactttgggaggccgaggtgggccgatcgatcacctgaggtcaggagtttgagaccagcctcgagaacatggtgaaacctcatttctactaaaaatacaaaaaaatgagccaggcatggtggcaggtgcctgtaattacagctacttgggaggctgaggcaggagaatctcgtgaacccaggagacagaggtttcagtgagccaagatcatgccattgcacttcagcctgggcaacaagagcgagactctgtctcaaaaaaaaaaaaaaacttgaatttcttcctttataaaatcctttctaattgatctctgtctttaaaatcctttgtttatggctgggctcagtggctcatgactgtaatcccagcactttgggaggccgaggcgggcagatcacccgaggtcaggagttcaagaccagcctggccaacatggtgaaaccccgtatctactaaaaatacaaaaattggcatggtggtgggcacctgtaatcccagctgcttgggaggctgagacagaagaatctaaagctgggaggcagaggttgcagtgagccaagatcgcaccactgcacttcagcctgggtgacagagtaagactctgtctccaaaaaaaaaaaaaaaaaaaaaaatccttttttcataggggctcttgtggcatttattgcgtgctgtgttatatgtagttagtgattgatatgcctatcatattgataattttttattgtatgttcctcagagatagtgctcatggcacatttatttacatttccttatgtgttggttcccaagcttccctcttttccctttttgttacattatagacatacaataaaatttcattaaatatcaacaattagtattaaacctaatgggtctgttttacgtgctgttacaaattacataaaggagaggtcagaattaatagagaatgt

SEQ ID NO: 10436 - DNA, 1048 bp, Homo sapiens
ttataaatacatcaggtgcttaccataatcagggtactctgttaaacactgtgaaggattgtaagaaagtaaagacacaacctactgttcttggttgttcataatactgtattcgtagaaagttaagaattaagatttagctgggtgtggtggctcacgcctgtaatcccagcagtttgggaggctgaggcaggtggatcacctgagttcaggggttggagaccagccttgcccacatggcgaaaccccatctctaccaaaaattaggtaggtgtggtggcatgcacctataatcccagctacacagaaggctgaggcaagagaatcgcttgaacccgggaggcggagtttgcagtgaggcgagatcgcgccactgcactccagcgtaggcgacagagtgagactccgtttcagaactaaaaagaaaagatttaaataacagtttttaagacagtatagggaattttgtaacacagaaatcccaaaaggctcgagaagtagcaccaggacgtctgaaagtccctctgaaagctgaggctacaaacaggataataaggtgtaaaattccaggggtcatgatgcttcagcctacccagggtgtgcagggagagagctctcactcttctttgacacttagaagtcctgtgtcaatagtaccaattctatgagtggggctgtcacatatgcagactcctttctgacccccataccaaggaagatgccaaggtgacaaggggaaaaagcacactggcctggtagtgctgccctttaagaatctggctcagcctcagcctggtgaccctaaacagcaatggcagggtctgggtcagcaagacacagctctctctatgcaatgctggaatgagtgtctccagtctcttattgctgatgggaaccttgtaaaaggacctgcatatcctggacaaactgagacacaggtggcagcacaggccccaccccttgaaaagccatcacactacttgactgaccatgacagcactatggataaacttcaagctttttaggttaacttctgtctgccacagat

SEQ ID NO: 10437 - DNA, 1039 bp, Homo sapiens
ttaatgagagaattcgtttacactggtgagagaaaagctaagacgcccagcagcttacaactaaggcatctcagtggttagcaacagtaggaagccactatgctaatgagaaggataaggagagaggaagcaatcaagaggctggtttgactgcggaacgtggaagacttgtctgatgagggagtggtagtcttagaggagactctactgaggcagaaagggaatgggggaaaaatatggctgcttcctcctgccctccagcctcccaccagtgcttcctatttactgagcccagccagtagcaggccgacagaagagcttggggaacattgcctatatagagtcaagctttatgtcatacagtagagagcgacagaagggtcaagaacgtgtttgaggtcaaacaggaccaaaactgacacacccctaacaggtcaagagctgctggttctattcacctttatatcaccaaaacatagatatttaataaaacatttgcaaaagtatggctctgattatgacactcctttgtttatttaataatatatgtactcattgctgtctaaaacttttcatgatccttacccattttgtcttttctgttgtatctccaactgttacccttcataaaccttgtgctgcatccaaactggacatgttccccaaatatgattgcatatatactttctgtcagcttctttgggattcccaaccatccttcagtactcatctgcaccttcaaacatcacataatttccaagcttagtagtggtttctccagcccctcccttcccatgaagtgagtcagctctattttcttaccatttttgctttgcattacagttatttgtgtatatatcttctatctccaagtaaattgtaactttatagacagaaaccttgtccctgttatttgtggatctagtaatataagacaacataaggtacggcttcctaagaattatttgcatgcttaacgaacattaaattactaatctttctaggaaataataaaatatgtgaaggagatgttttcaca

SEQ ID NO: 10438 - DNA, 1086 bp, Homo sapiens
caaatctccctgaagctttcacactataccttttagtctgaaagttgagataattctattcttactaaaaatttcagatgggcaggagtatacaatacaaaaaagcctccccatgcctaatgctcttacttttgtcgtttatcattttacatcttaaatagatacatatcgtgtatatctttctcatatgaggtttattatttactcatgattcttttcctatcagtaccccctcgccatcttcagctcctcttgttattggtcccttcataatgttttttttctagcaaatctttgggtgcctagtatgttccaaacactgtgccaattgctgaacatagagaagttaagttttctccccttagtgttcagataattaggttttttttaaattcttaaacatacacacaaaaaaacacttttctggaccccactagacattagacacccattaaacagaacattctgtcttatgttctgtgtcaccctttcacaagtcaaatttattcaaagaacaatgaattccacttagttgctgttcttcacctaccttttatccttcaggatactgcactctgacttttgcatctcactactccacttaagtagcccttattgccttgctgggattttacaaaatgttgtgtgggccagaatacatcaaagtgtttgttgcctctgggccatcagttcagtttttatctatttattcaaggtgctctgtggaactgatcctacctacctctccaacttgatctcaacttcctaacatctgttttatgctgcagacatgccaaacgaattgaagtttctttgaaaattcttgtatgtattctacttctctttgtcttcctagtacacttctattcaaggttcaggtcatgcctgatctctgaaacttcattcagcaagtacagtcagtacttcttaaatgttgccatagcattgtacttctgttacaaccttatcatgtctcattgtagatgtgtgtttacttttttttgataaaatatactaacaaaattcaacacttaaaaatgtatagttcttaaagcccaaaacaatgagtttgttgttgttgttgtt

SEQ ID NO: 10439 - DNA, 1088 bp, Homo sapiens
taatgaatttgtgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaattcttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgctctttttaaatctatgtttagaactttatatcttgggacttatgtatatatataccttttaaataaaataaattttctaaataaaaagttgaaaaagataccttttgttttttaagaaagaggttgtaaccacttatagccctggtatttctgtaactgcattggtctaattttgattctattatgtcttcatgagtaaatgaaccaaaatcaccactcagtccctaaagggcagaaatctataataacattagaagaaagaaaaggccagtcacggtggctcacacctcagcactttgggaggccgaggcaggaggatcacttgagcccaggagtttaagactagccctggcaacatagtgagaccctcaactttacaaaagaaaaaatttaaaaattagctggacatggtggtgaacacctgtagtcccaactacttggtagactggggtgggatgactgcttgaccccaggagtt

SEQ ID NO: 10440 - DNA, 1091 bp, Homo sapiens
agtggaggaacattacacagacctgttgccattcaaaaatgcgtgtgactataggcctaaaagaaagaatgtgtgagactgccaacttttcagatggttatcttgtttgtttgctggcttgagtattcaacaaagttaattattcaataacaagtggaaaataaatgctgagagctgctgtttgtttcaggtagggacgtctggcttggcatcccttttgtagaggcttccaaccaacacataaaattgtggattggggtttcttgctagattatgaattataactagtgcctgtgatagctaaagttaaaatgtaactttaggactggaataaaccagacctttggttttagtctgcagacacacagcaactagaaaagatggcgtgactgcggatgggagtgggtgggggagtcaacagaatgcagtgtgaactaacctttcagttccctttaaacccacgtttcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactgcaccaagtggactagttctcccggtggctttatatatgtagatggatatagcagtactggttgagtatccctcatctgaaatgcttaggaccaggagtgtttcaggcttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctg

SEQ ID NO: 10441 - DNA, 1050 bp, Homo sapiens
cctcattctttcatttatttatttattagtttatttatttatttatttatttatttttgagacagagtttcactctgtcgcccaggctggaatgcagtggcacgatctccactcactgcaacctctgcctcccgggttcaaggaatttcgtgcctcagcctcctgagtagctgggattacaggtacccgccaccacacccagctaatttttgtatttttagtagagatggggtttcaccatgttggccagactgatctcgaactcttgaccttaagtgatcttctagctttgggcccccaaagtactgggattacaggtgtgagccaccatgtccggcccctgtagcctcattcttaagttataattccattatgttctggctttcccatgctgttcactttcaaccccacatctgtcccacctcacacttaaccctctctttgtgggtcgcagtagtaattttcattcatttttattttttttaacctttcaggaaaatgatgaagaagccaagaagattgcaaaagaaggacagttgatggctagggacctactacagccacacaggctttactgctactattaccaagtactgcaggtcagttcagagtgtccgtccacactgctgggtcgggtgtcctcagactacccgcttggcctgtacacttcctgcctggcttcctgaaggactcacagtcaagcctatggaccactggctaagccaaggcacttgcctagggaaagatagtgctaagtcttcatttggtggcccccttttttttgttttttgtttgtttgtttgttttgagatgaagtctcactctgtcatgcaggctggagtgcagtgtctcaatctcagctcactgcagcctctgccttccaggttcaagcaattctgcctcagactcccaagtagctgggattacaggtacacgccaccatgcccagctaatttttgtatttttagtagaaacggagtttcgccatgttggccaggctggtcttgaactcctggcctcaggtgatctgccttgccttggcctcctgaa

SEQ ID NO: 10442 - DNA, 1051 bp, Homo sapiens
aaccatccaagtgatttaaatttcatcaaatttagaaaaattatggccattattgcttcaaatatgttttctgttccattccaccttaccttcaaggatactaattacccatatattgggcttgaaactatcctgtggttcatcgatacccttttcattttttaaattcttttttctctttgtttcatttcgtatagtttctattactgtctctaagttctcttttcttctgcaatgtacgatctgttgtcaatcctatacagtgtagttttcacctcttgatgctttttcatcttcttgagctcttttctggggtgcagttaaatcactgggaaatagtttaatccttccaagttttgcttttacagtttgttaggtgggactagagccatgtgtagtctagggctaattattccccgctactgaggtaatacccttctgcatactttacccaagccctgtgaattaggaggctttccaatctggctggtacccaccgataagtactgttctctctggtcattttggatgggttcttcccctgtcttccccaagaacatatgaacactcaggtggcaaatatcttagatgtccatttctcagcctgaaatctgttttcatcctttgtcattatcattctaaatatttaaatgttatacctaaataattaaactgtattatttttagaatcaatacaggggaagaacccatccaaaatgcactgatcatatgctctgctcaatatgtgaagaggaccttctatagatctctaacgttctctctgtgcagtgcttcctttttagatactctgtcctacaaagtctagagctgccttggtctccctggactgccagctctgtctcctcaactcagtgaggctgcctggctttgcctacagtccccctccctgtactacaacctcaaagctcccttaagcagtaggctgtaggaattgtagggcttaccttatttgttccccatctctcagactcactgtccttcattgcctaatacctagtgccttaaaaactattgtttaaggccaggtgcg

SEQ ID NO: 10443 - DNA, 1024 bp, Homo sapiens
tgggcaacacagcaagaccccctccaacccatcccgccccccaccatctctacaaaaaatttcaaaaattagctgggcatggtggcacactcctatagtcccagctactcatggggctgatgcaggttgaggcaggaggttcatgagcccaggaggttggagctgtaatgagctaggattctgcctctgcactcctagctggatgacagagcaagaccctgtctcaaaaaagaaaaaaaaaaaaaaaagaatgcatgaaccagacatgacagttcctggcctcaaagatcttccaaaggaaatgatttttttttaaccaccaatgctgcaggaaaaagcaacatatttaagttatccaataacacctatccaataattgtaaatcattatcatgacatggtagagttgtttatatttcttttccttttaggtgaaacaccattcaaagtcgtagtcaaatctctttcacctaaagagttggtccggatacatgtccctaaacctttggacaggaatgatggaacatttttgatgagatataggatgtatgaaactgtcgatgaaggcctgaagatagaggtcctttatggtgatgaacatgtggctcagtctccctatattttgaaaggtaagtgattattatatactccagagtcagccttgtgtgtaggtcccatgcctttcagaatggcctaaacctgatgacctcaaagtcatgtgcagtaaagtaaacattgtatacatacctcctggagctcaatttaaattttaagggaaagaaaattaagtaaagagatttaaatgataagaaaaaaatcttgtgtatttacatccatgtagttactatttgcgaaactcttcattcctttgtgtagatccatatttccatctagtaacatttgccttctgcttaaaggatttttattaatatttattttactgtgagaatgctggtgatgaattcttccagcttttgaatgtctgaaaaaactttattttgccttttgtttgtttgatttgtttt

SEQ ID NO: 10444 - DNA, 1028 bp, Homo sapiens
agatctataatcttcattctgggtatcatgtttttcggttatagaccaaactggaaaaaattaaaactcttgcaacattctgtttagcaaatgtccttcttagatatcaaaatacttgcagctctcttttaacaggaagaattgaaacatagacacaacatgcagaaataaaataaatttcatcatttaaatatatttatgtgtgtttagcagttttcagaacttgtcatcttcaaatacgttttactttcaaaacataaatgggaatatttaacatttatcttgttattattgatattgataagtatttattaattctgctggtgcagaatataattaaaggcactgggttttgctcctaagaggtttcagaagatgaaatataaaagcatgtcgtttttatttttaaatttgaatgtgacctaaatatttggatatgaatcctatatgtgggaaaagaagtgtttattaaagggggcattgtattacgacaggtgatataaatcaggtcatacattctgaagggctctataatctcaggtagaacctaactttctttggcagtgttgatctgaaatagaaaatcaatctgcaaaatggactgtgattcaggacctcctccttacctacgagcaccctgggagggactgactaatggcccagggacacacagtcatcctctgcaggcaacagtcaggcttctacttgctgaagccgtcaagggcttgactgtcacactcagtgttctggaaaacaaatcagtaaagcaatttagaggatcttttgcaaatcagagaaaaagaatcaatacaaggcgaaagaattctgatcagcactttaaaacgtgcttatcagaaacttttcttctctcttttaagctttggttctaactgagaaatgcactggataataggtaaccctccccagaagaacatggacttcatcatttcaccagattcacttgttccctttaaggcccagccaataaaagtatatggtatcttcaagctctgatttcctaatatcag

SEQ ID NO: 10445 - DNA, 1028 bp, Homo sapiens
accggagctgttcctattcggccatcttccgcattatattttttaaaagtattactttgagacagagttttgctcttgttgcccaggctagagtgtaatgacgtgatctctgctcaatgcaacctctgcctcctgggttcaaatgattcttctgcctcagcctccggagtagctgtgattacaggtggccgccactacccccaggtaatttttgtatttttatagagaaggggtttcatcatgttggccagggtggtcttgaactcctggcctcaagtgatccgcctgacagcctcccaaagtgttgggattataggcgttaacctccacacctggctatttttttaaattaataaatgattgttaaagccctagaaatcaaagaagagtctgtgctcaagaaatattcaaaatctagaggaaagttgaaattggagaagtgaagatggatgtggatagaaggctttttaagccacccaataggtgttgaataaaataattcaggaactcagtgagcaagtcttcagtgataagaactgaactcagtctggagaaaattcgaggttgaggatcaaagggaagaaggctcttggtgagttttagcatgtagaagagagccagcgaggagggtggccactgtgagagctgaaaaatgaagttatcaggcagcatttgagacaggcttatagtttgagttaacctcccgaataaatgccagaggagaacgctacattcgttttcagaactgaatgagtatttcattgaaatgtaccagtcaattctttgtgcaattctttgtcatttattagaaatttgaagagagaaagcgttagtaacatttttcagatgctctgtgtgggttatttgaatggctttgtagataaaaatagatctgggccgggcatggtggctcatgcctgtaaccccagcactttggtaggccaaggcgggagaccacctgagcccaggagtttgagaccagcctgggcaatatggtgccccgtctctattaaaaaaaaaaaaaaaat

SEQ ID NO: 10446 - DNA, 1029 bp, Homo sapiens
tttttggaatgttttcaagcattgggaagactgtgcgagtaagtatgtcttctagataactagtgagatgtatacagataggaaaatgttgtctgccacctcttatttttcaaccattatgctttagctcttaaaaattagatatttaaaatatttttggtttaatagtactattaaaggaatgctgaattaggagaaaagaaggcatgatgtttattcccttttccatgaaataagacatatatagacataatatacatttgcattcagaatcatttaatcagtgattttcagagcaattgctgtttgtgcactgttggaattatgggagatagatgaatagatgagactttgcaactctgccaagaaaattgtggttaatcggggagttgagtcctggactcaaattgaggtatagaaagtatggtagttaagtgccagaagaaaaactgagataaaatgtgcaggagatacagaaatgagaggccacttagttcaactttaggtcactttgattcagtgtttattcatgtgatatttcttgatgaagctaaggaaatgttctttgattttagagcttaggttttagatattgttcttgtgcctataaactttgatcttcgtgtgtgtgtgtgtgtgtgtgtgtgtgtgtgtgtgtgtgtgtgttttggagacagggtcttgctctgttgcccaggctggagaacagtggtgcactcttggctcactgcagcttccacctcctgggttcaagcgatccttctgcctcagccacctgaatagctgggagcacaggcatgtgccaccacacctggctaatttttgtatttttagtagagatggggtttcaccatgttggccagcctggtctcaaacttctggcctcaagtgatctgcccacctcagcctcccaaagtgctgggattacaggcatgagctaccacacccagcctgatcttagttcttaaatgattttcttgcaccacaagtattttggggggggtacagcctaggatttgtctcaaaagt

SEQ ID NO: 10447 - DNA, 1050 bp, Homo sapiens
tcattgcatttacctaattatttacttttaaattttagctattttcataaaaacagttttgagatgaaggaaacttacacaataaaaggaagatcaataagcaggaaaattagtaactgacagggaatatgaatgaatactcagtatacgtttcggtatgcttgttttctgataaattacttaattttcatttcataggccaaattttaaacaccagttaataaagttatcctaaaagagtctctaatttgaaaagtttttctaacctaggaagactcattttagacccaactgaccagtcaaatatgagtaatttataatatctgtattaaatattgagaagattaataaagttaaaagtttacagttgaatctttttttatcatggtaaaatatacataaaattgatcattttaaccattttttaagtgtacagttcagtgccattaagtacattcacattgttgtgtaaccatcaccaccatccatctccaggatgttctcatcttcccggactgaagcctgtacccattaaatggtaatgccccattccccctcctccccagtccttggtgaccactgttctactttctgtctctataaatttgatgtttctcagtacctcataaaagtgaactcatacaatatttgtcctttcgtgtctggtttatttcacttagcatgtttgcaaggttcatttattttgtggtatgtatcagaattttattcctttttaaggctaagcaatattccattgtatgcatataccatattttatccatttatctgttattgatggacgcttaaattaccgctatcatttgactactctgaatattgctgctttgaacattggtgtacaaatatcttagagtccctgctttcagttctttggggtacatacccagaaatggaattgtttggtcatatgttaattctgtgtttaatttttttttttttttttttgagatggagttttgctcttgttgcccaggctggagtgcagtgatgcgattttggctcactgcaacctgtgcctcctgggttcaa

SEQ ID NO: 10448 - DNA, 1043 bp, Homo sapiens
ggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaag

SEQ ID NO: 10449 - DNA, 1053 bp, Homo sapiens
gtacaaaataccatggttgataaatgtggaaaggccatgtgtattcctcccttaccactgccaccactattactaaaacaaacttatacctaaagaaaaaggtttcacagtggaaatgatttggtatatgtatttttgcatcttaaagccattttcataaatttttttaaatctaagaaaaaaataatagttgtactttttattttttaaataggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcat

SEQ ID NO: 10450 - DNA, 1077 bp, Homo sapiens
aaataaaatctattgggtgtgagattcttaggcattatatgaatatctatttctcatcaactatttgcacaacagttttagcaaacaattgataatccttgccagaattaatagttctttttttgcatgtatgcttgtttttcttttaatctgtcactttgaagctcacagagtaattctaatagggtttgcataataatgtttttgattttctcttttacctgttgacattcttttatgaaaatagaggtttcataaatagggcctattttcattaccttgaaatacagtttctattaaaaagggagtataacttgattgttttgattattaatttttgaagtaagttgctcataaacgtatttttaatgttcaggcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggtatttaaaatttgcagttgtatgtgcatttgaaatatagtttgcattttccccatcttagacaaacttagttaaaaagaatatagaagttttaatactggctgcccttgtgattggtttgtgggtgtttggcctatagtcatgttatttcatttcttccgttgtgtgaacccattagcaaatacctgttagctttgtataatcagaccttaactagtgagttatttaattacagcttgacccattttaaaaggtagaaagtattctaatgtcatgttgaaaaacgtgaatttagtttttgatcagtaatatgtacattgagggccaggcgcagtggctcacacctgtaatcccagcactctgggaggccgaggcaggtggactgcctgaggccaggagttcaagaccagcctggccaacatggtgaaactctgcctctaccaaaaatacaaaaatta

SEQ ID NO: 10451 - DNA, 1030 bp, Homo sapiens
gcggtcactcccatttcttctcagtaccccttctctctgctgtagacaaccacgaatctttctctaaagttttgtctgttctagaccatcatatgaatggaatcatgcaaaatgtggtcttttgtgactggcttcttttgtttaacataatattctaaagtttcgttcatattgtggcatttatcagcactccactctctttttttttttttttttttttttttgagccagaatctcactctgttgccccaggttggagtgcaaatggcgtgatcttggctcactgcaaccttcgcctcccaggttcaggcaattcttctgtctcagcctcctgagtagctgggattacaggcgtccaccaccacacccagctaatttttatatttttagtagagacggggtttcgccatgttggtcaggctggtctcaaactcattttatggatatggtatattttatttatttgtttgaaatctgatgttttttattgtttccactatttgactaaggtgactaatgctgttatgaacattcattgtgtaggtttttgttgttcatatgtcctcatttcttttgggtgtaacctaaggagtggaattgctgggtcatgtggtaactgtatttaactttttgaggaactgccacattggtttctaaagtgactgtaccatattaccctgccaccagcaaatttgatttctccacatttcaccaatacttgttaatgtttgtcttttggattatagtcatcttaatgggtgtgaagtggtattttatagtttttattgcatatctctaatacctggtgacgttgagtgtctttctatgtgctttttggacatttatattgcatgtatttttttttttcctgagacaaggtcttgctcagtcacgcaggctggagtgcagtggcatgatcgcggttcactgcagcctcagtctctgagcttcaagcgattctcatacctcagccttctgagtagctgggattacagatgtgcaccaccacgctcggctaatttttatattt

SEQ ID NO: 10452 - DNA, 1069 bp, Homo sapiens
ttgtcatttcttcttagttgattcagttcttaggtttcacatgaatactatttccaattattattattttatttcagtagtttttggaatataggtggtttttgtttacatgaatgggttctatcattgtgtattctgagattttagtgcacctgtcactcgagcaatgtacactatacccaatatgtggtcttttgtccctcaccccattcccaaccattgcttctcaagtcaccaaagtcgattatattactctgtctttgcatcctcatagcttagctcccacttataagtgagaacatatggcatttgtatgttctgagttacttcacttagaatcatggcctccagcttcatccaagttgctgcaaaagacattattttgttactttttatggcagagtagtattccatcacatgaataatatttttgtgtattaatttgtaacagcaattgcaattccttttaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaaggtaaaagtttcttttttgaaaatggattaaaaattattattgctctgttgtcagatagtggtattttttttagtactcttaaaccttatttgttatataggacaattgtatatttaattggcaaattaatacttagtggaatcacatcataaacatgtttcactaaggcacattcatttatacagtgctgatgtttctcttaaacatgcagatatttttctttttttagttttttgttttaaacatgcaaatatttttcatatgtattcttaaataattgtaaatgtatatatgggctttataaacaaaaaacacatatgcaatacattatggcatttaaagaaaagtatgcaatgctttatggctgtataagtaaggcatttaagtaattaaagtaatttaagctattctgactatatgaacttttttggaactcaattcctaaaaatattttactttattctact

SEQ ID NO: 10453 - DNA, 1049 bp, Homo sapiens
attggtacaatctagccaccttattcagattacatcagttttacctgcactcatttctgtgtgtatgtaatttagttctatgcaatttcatcatgtgtattaattgtctgacaactaccacagtcaagttactgaaaggattctttacttttaaagtgtatgcttttgaatcttaaagtcattataatttttttttttttttggtcctcttagtgtattggaacaacacaaactaacaaaagaacagtgggaagaaagaatacagaactggcatgaagaacatagaggaatgttaaggtatttgggtagctattttctatgttttcttttttccttcaaagtattttcatgtcgtaacatttattattacattatttccaaaagattgtttgacttatgtaaagtactaatttttaattccaggtattttgcaactttagtttgatatgctcctacttaaatatattacatttagttttatttcaacagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagtaagtaaattagttgcatagtgaactagtcattgttcagtggtctaaatgacgttaatcttatgtcctgtttttcaaagtagtttcttgtcttgattacccttactattttcaaactaaaagatgaattaatgacacatagacttgtagatattttacctccattttcttatcaccttgcagtttcagagttctacttttcagtgtatttatcaaatgagatgattgacttttatttgaattgtgctgcttttagctcttgtgagttatgtctagtaacttaattaaaatttgctccctcgataggtgagaaataattctttaaaatgctattatgcttgacaaatagattgaaattgaacatacataagaaatcaggagcaatgagagaatggatttaataaatatgtcta

SEQ ID NO: 10454 - DNA, 1052 bp, Homo sapiens
tcaagtgatccgcctccctcggcctcccaaagtgccaggattacaggcgtgagccaccgtccagcctggtctagattattgagtattgttatctgttatggactcttctcagcagttctttagtccctgttctatttcctgactgctttccttgaactcaaatgcagtgatgaactttccttgaactcaaatgcaaggatcgaaaaatgcagactttacttttgtatgtagtgtgtgtgggataagctggcaggttcaggtcaagccaggggtaaactgggtcctctaaaatgagagcacatagctacatgagtacatgtgtagtaaagccccatgtctgattatgatgttaaatcgaggccagctgctctgtgtttggggactctgagtgcttgaagtcctttggtttgcttcttgctgacttttttcttgactagccttctcctttagctgcttcttgtgggattagtgtaaagagtgttcatacccccaaagagtgtgcaagaacatctgttacggtgaaagaagtattaaaatatatttttaggctagacttggtggcccacacctgtaatcccagcactttgggaggccaaggcgggaggattacttgaggtcaggagttcaagagtgtaataccatatttttactgtaccttttcctgtccaatattgcaaaactgtctctactaaaaatgcaaacattagctgagtgtggtggtgcacacttgtaatcccagctactcaggaggctgaggtgggagaactgctgaaacccaggaggtagaggttgcggtctgcacttcagtttgggcaaaaaaataaataaattaattaaaaaaatatatatatatgtatatataatatgtatttttaaacatttttaaaaatatatgctttatagtgtattagcatgatagtatgtaacttgtaaataaatatacctatgttatagttacgtgcccaagcagattcacttctaaaagtatgtgatcagaagtttatgggagcttaaaggacagcctcactaaaatatattaattaaaaaaaaaa

SEQ ID NO: 10455 - DNA, 1032 bp, Homo sapiens
attagcctggctgagtaaagacagtaaccacagtgagaagttgttagtttgatacgtttggatcattgttattgtgcttaatattcacatagatcgttcgtgaactttctgtaccactaacctgattttgtttggaattttccagttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaagctttaactgtagtgcctcctaataagcagtatgtttgtttcattgtgagattgcagttctgtatttcgaatgagtctaagaaccacagggataatactgtgcagatttcctgttctttacctggctctgcttc

SEQ ID NO: 10456 - DNA, 1032 bp, Homo sapiens
atagcaacacagattggactaagacagttgctcttaagtgtgattcttctgtttatttcctttggattctgtaatccctttcccaatagcaggaatgcagtcatggatctgaatagagtcatatattttgatggcacagtgagaaggcccttaccagacaccagcaccttgattttgtttagtagatttattacgatatgatgtgatctttattgtatggtattatggaggaaatagattgtcctccaggggctagaagctaagggaagaaattcttggcacttacaaataagctggtcatagttttgaacagcgtggtgttggaagttgtccagcatcctggtgtggctggtcaccattctttccttccgcaaatactttttgactgcctgagatatgccaggtactgtaccaggcaccaggtgtattgtgcttataaagacagattcagttcttgccttcacagagcttacaaggttcagctataagaaggcttgggccttgctgcagttgctcacagagggatttgaggagatgtgatgaatcagaatttattatgtgtttggaaggaagacattctgaatgctgcttaaaagctaagtattaaattaataacatatgtcagccattgtggctgctggatagtctcagttatgaccaaattttacttagctgtgggcaaactgtctaaacagttttttcagctttaatcctcccacttgcctaggagtttacagggcagttgatttagattgatctttcacattatccccttggactcttagaggattcatgatgacagttgtttaccagaggattttcagtgacatatgagaaataagatctgtcttctgtgtggagatggtttctctgtgatgttccctgaacctcatgttggcccttgccagagatctctatttttacagctacttgcgtcattgtcatttccagctgatagatgattgaatgcaacttcacatccttcctgtcttaggacttgtggggctttggctcaggcagctggatagacag

SEQ ID NO: 10457 - DNA, 1035 bp, Homo sapiens
gccaagattttctgccagaatcaagatctaaatttggaagatacattcagtgtcacctctttagttcttgaaaaattcacatttttgttcactatttcaaggtgaatgatacacttccagctccaaatctagtatatgatttaggagctacctagtcaatggatgaaaccttggaggaaaaaacagctcttcaggagagagcttacagaaaaagacttttttctgactttaatttaatgcttaagcagacttgctggaagttttcctgttttctttcttttttaagagactggatcttgctctgtcacccaggctggagtgcagtggtgccatcatagctcactgtaacctcaaattcctgggttcaagtgatccttccacttcaagctcctgagtagctaggactacaggcatgcatcaccatgcacagttaatagttttattttttctagaaacagagtcttgctgtgttgcccagggtggtctcaagcaatcctcccatcttgccctctcaaagctctgggattatagacatgagccaccatgcctgtcctccatctgttatctttgaaaacatagattggtcattgatttttttcctaagcagtaatatagtcagttctgctacaataagatataaagttatgaaaaattaatatgtggtaaaaaccacaaagcttattgggaaaacggagttagggacacaatacttaaaaaactttgtcagttaaaaaagagattaaaaattagccatgcatgatggctcatgcctataattctagcactttgggaggctgaggcaggaggatagcttgaggctaggagtttgagacaacatagcgagattcagtctctacaataaaaaaaaaataaattagccaggtatggtggctcatgcctgtagtcctaactactcaaaggctgaggtgagaggactgcttgagcccaggagtttgaggctacagtgagctacagtcatgccactacactccagcctggacaacatagcaggaccctctctctgaaaaaataaaa

SEQ ID NO: 10458 - DNA, 1034 bp, Homo sapiens
agaaatctgtcccgtaaagagaacaaatttagcagttagaactaaaaataccaactcatggaatgtcatcatagttgtatctactgctggtgtcttatactgtcatgctactgtgaagtaattccgtattacacatcaggaaagtaaggccaggaaggtgaacttacctgctctgggcctcctcataaccaatgagtggcagaaccaagaccgaaagtctgagttttcaagctttttactcagcccattaagtgacaaccaggaaaaaataatacgtcacttgatctttcttcccacagtgaaaaaatgcacttgcgttctgccagccttctttcagtgatatgttggtttcttaagaattaacatactaaggatcacagtatagcaaagggaattaatgtggtctctgcttggtgctttaatccaaaggcagactgggaagaagtggatatgtccctgagaagcctgtttcattttggaaataattcaacttagtttcagggaaaacctaaacttcatgaacagatttagaaatgaacaagacaacatttaaatggcagttgctgccctgaatccagagtaccattagacaacatgattatttcctaattcttccccatttggtacaggattatctatgacaattgaagaaataatttgaacacaagtccatttaggcaaatatacagcaatggaactagaaaaccatttactatccaattaccatgtttaggcatatactaagtatagctataggccccatccagcagggaaatttgcaaaaactctagtcccttctaataagttgtctatggatgttatcatgaagggaaaaggtttgttcttaggcccatgtcctgattaagtaaaccggaccacacctgtggggtcaaaatatagaaggatcaaagcaccaaggctaaagacaagttagttgtgacacctgctatataaacagagagcaatacagtgttgccttgtcataccatcctacatggcattagttccaatccacctcttgatcccagcccttg

SEQ ID NO: 10459 - DNA, 1047 bp, Homo sapiens
taggctgaaacagttctaagggattaggagttctcacatccttttcttgtgccccatgtatcttctggcaccccctctgtggtaatcactgctctgcatagctaaatgagaaaatgtcctttggaaacactttttaatttttttttgagctgcatgctagctattgttgatttggggaataatggaaaggtttttgttggctaaagtattgcctcttttccaataaacagcaagatctgaaatttctctattagagaagtggtaactttgggttaagcattgccttctctctgaggtctcttaaatcaacaaatccttttgaaagaagttggagaagaagcgtgttatatctccagtcctttaggtcagtacctaaattgggctgctttcctcagagccctggatgcccagcatagtgtctggcacagaggaagagctcaatatacacatttgttgaattagtgaatgagtgtgggcaattcagagaagggaaagatcaaaaagagcaagaaggaagctaaggtactggaaggcaaagtgaagctgagttttctcctctttctaatttcgctcagggccagagaggtttcttctcttcctgggagtagttattcagcacagtgcggttccttcccgggcagggcttctcttggtctgagattttatttcccaggaatgcaggggtagctgggttgctccagagcagagaatggaccctctgcaatctagtcatctggaaagaggactaatctattcctgcctttctgaataagccaagcagagtcattgttccattctttgccaccttcactctgttcttagagcagcctatgatgagggtcagacgtctatatccacaggtggttgcagagtatttgtggtttgcaaagagggatctggtcccttttggtatcctcaggacatttttgtaggcaatagaaggagatttcttttcccagagaagagatacatgttgaaatagattctacccatctagtcagccttgcacaggatttttttgcttgtttttttgatctcccccaaccc

SEQ ID NO: 10460 - DNA, 1047 bp, Homo sapiens
agggccacctagggacctgggaacatcagcccacctcatccccactctccctctcctgattgtcccctcccctccaggtaagagttggggatcagaaggtacaatgctgtccagaggctggggcttagaataacctcattagaataaggttggagtctgtctttgactgtgtgactttgggcacattacttcttgttgcttctgtttccttctccataaaatggaaatataaatatttactgcacaaattgtttaaggataaaacaaactaatctaagaaaagatatcagcacagaacttgtgtagtagtctgtttggtttgccatgactaagtaccacagaccgggtggtttaaaccacatttattttctcaccgttctggtggctagaagtccaagatcaaggtgctgtggaattcggtttcaggagagagctcttttcctggattgtagatggctgtcttctgcctgtgtactccccgggcctttcctctgctcttgaggagagagggagctctctggtgtctcttcctcttcttataaggacactggctctattggatcagggcgtcaccctcgtgacctcatttaaccttaatcaccttcttaaaggccctgtctccaaatacagtcacattgagggttggggctttaacatatgaatttgtgtgtgtgtgtttgggggcggggacatgagtcagtccataatagcctggaaaaagcatacactcaacaactggtaattattattatcacaagatttgaaatcagaagacctggatctaagtcctggatccatcatttcctgacactgtgatcttggggaagttgcttaaactccatgccttagttctccttctgcagaatggagaggatggcagtactcattgcacagggctgctgtgacaatgaatggtagaccacgcttaaaaacacatggttaaaatagaaaactgaaatgctctaccaaaaggggtgatactgctcttgggactggtctcactctccggggagcagggaacttggcactgggtgatccagatgctgt

SEQ ID NO: 10461 - DNA, 1030 bp, Homo sapiens
catgcatcaaagatctgctgccctttccccacttctgagctggcccaattctattctattgtgtttcctctgtgcaaaaccaggacatatctactgaagatggtgataggttatattccttatgcaaaacagtgatggatgaaggaccccaagtatttgcacctttatctgaagaaagcaagaacaagaaatatcaagaagaggttccagtctatgtgccaaaatggatgccattcaaggaattgatgatgatgctacaagccagcttgcaagaaattggggatcggtatgtataacccttctatagaggcatataactctccatagctacaagagagtaatagtgcccttgatagcagggcttttccctgtttcctgatgttagtcatgcaagactttcatattgagtagcagtagctggggccttttcatgatctatcataatgcagatctcattaccactttcccatatttgatagcataaagacttctcatccatattattttggtcttgagtatgtggtttggcatgctgtacaagtgatctggcaactgtaagaattatagccttctgacatctggatggaaattgttgctcactttaaggagcagtggatgcttttttttttttgagacatggtcttactctgtcacccaggttggagtgcagtggctcaatcattcctcactgcagcctcaaactcgtgggctcaagggatcctcccacctcagcctcctgagtagctgggattacaggtgcctaccaccacacctggctaatttattttattttattattttatttattatttatttgttttgttttgttttagagacgaggtttctctgtgttgtccaggctggtctcaaactcctggcctcccaaagtgctaggattacaggcatgagccactgcagccagcctggatgcattttcagaattactttgatatattaacagagaagtgacttttacctgtctgaaatattgagcatcagactactgtttgattgacctgcagtctttctg

SEQ ID NO: 10462 - DNA, 1030 bp, Homo sapiens
taccttaatttaaaaatatattattattaaaaagtgccaacgatcatctgagccttcagtgagtcataatctttttgttggtgaagggtcttgcctcaatgttgatggctgctgactgatcaggatggtggttgctgaaggttggatggctgcgtcaatttcttaaaataagacaacaatgaagcttgcctcatcaattgacttcccttcatgaaagatttctcagtagcatgcagtgctgtttgatagcattttacccctagtagaacttttttcaaaattggagtcagtcttctcaccctgccactgctttatcaactaaatttatggactgttctaaatcctttgttgtcatataaacaatgttcacagcatcttcaccagcagtagattctgtctcaagaaaccactttctttgttcatccactagaaacaacttatcatacattcgggttttatcatgagattgcagcaatttagttatatcttcaggctctatttctgattctagctctcttgccatttctagtacattggcagttccttctttaactgaagtcttaaacccctcaaagtcatgagggttggaatcaacttcttccaaactcctgttaattttgctattttgacctcctcccatgaatcatgaatgcttttaatgacatgtagaatggtgaatcctttctagaagattttcattttattttgctcagatccatcagaggaatcactgtagcagctattttatttcttgaataataagacttgaaagtcaaaatcactccttgattcataggctacagatggatggtgttagcaggcatcaaaacatattaatctccttgtttatctccatcagagttcttgggcgtccaggtgcattgccagtaagcagtaatattttgaaagaaatctttttttctgagcagtaggtctcaacagagaccttaaaatattcagtaaaccatgctattggctgggcatggtagctcacacctgtaatccaagagctttggaaggccacggtaag

SEQ ID NO: 10463 - DNA, 1069 bp, Homo sapiens
catcacaggactactctacatcacaaggtatctgagaaggcatttatgccagtgatccagtaacatctcatgctgtactcccctagccagccctatacccttcagctggctaggtgatgccacagtcttcacagtatatttcatatacagttggtatgccaggtacaacctgatggaatgaattgtggcattagaatgtgatttctgatgaacagaagcagtatcagaaagactaactacctgtgaccttcactgtgtatatagttttgcttatttcccaggttatgggagaaactatgatagggttaataggtagactttatgaaaaccattctccaaaggtgatcttcctaaaagatgcttgtttgtagaaagttttcttaatggatagaaatatgacaaagttgggagtgcattaaattttacagaatcatctgtgggttcaaagtttacagactttatcaatagagttcttgctgaagtagccatttcttatagttattaatttctagggaaaatctgcataggcttttgtaaaaagctgtgttaacagggttgtatattaaactgtatacattctgcttgctttttatctgagtgttctagactatttatcattagatgctaagacctttgttcaattctttatcagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgaggtgagaatgactgggaagcccaagttcaggagagccgggctttcagcagcgatggccagttttctcacatttctattattctgtgtctctgctgcctttaaccaacccctatttatttctcctgttttttcttactctttctccccactctgctgccacagcttaaagaagctgaacccaagaagcccatgccccaggaaacaaaccttgcagagcagtcagaacagcccccaaaggctaatgatgcagagtctactgcccagcctaattctgaggt

SEQ ID NO: 10464 - DNA, 1031 bp, Homo sapiens
tttgctagtgtggttggggattagggaatggagagaatgataaatgaacagtaagtaatcttcacaattgtatatttatgctgcgaaggaatgaatagctgcttgaatgtactagctgttgttaatatataggagccttgttattgcatgcatggtttatttttctattatagaaacaaacaagtggaaactgtcatttgcttagtgaaaaggctgattaatggcaaccagtaagtgaatgtgttaatctgctatagactttttttgtttgttttggtcacagggttagaaaatgaaattttatatgtcattgatatccttgccattaaagccaggtattattgaccatttcaccattgtatcaaattgctttctcatagtactgaattgtatgaaagttggtggtataaatgtcttgaaattcatctctaacctttttgaaatggacattcttatccgccaaatgcagtggttaaatggataaaactgtttatcttgaaatttttattggctctaatgattttctgaatttccctgaaatgattggtatatccagtgattgacagtgaccagtttccaaatctttttttttttttttttttttttgagatggagtctcactctgtctcccaggctggagcgcagtggcgcaacctcagcttactgcaacctcctcctcccaggttcaagcgattctcccacttcagccttctaagtagctgggattacaggcatgcgccaccacgcttgactaatttttgtattttttttagtagagacagggtttcaccatgttggccaggctggtcttgaactcctacctcaagtgattggcctgccttggcctcccaaagtgctgggattacaggcgtgagccactgcacccggcccactttccatatctttaactctgtgttattcattcacttagcagatgtttaatgagtgcctactaaatgtcaggcactgttatcaattgttgcccttacattgtccatacaggttgagcatcccacatgtgaatatccaaa

SEQ ID NO: 10465 - DNA, 1035 bp, Homo sapiens
agcctcagcagtgacccactgcgcccggcccaggttttttacctctttggtcaaatttattcctaagtattttattctttaggatgctattgtaaatgtaatttttttttaatttcctttttgatttcttattgctgttttataaaaacacaactgaattttgcctgtttaccttgaagctgctgaatttgtttaccagctctggtaacttttttgcagaatctttgggattttgtatatataggatcatgtcattttgtgaatactgttttacttttttatactttataatttaggtgccatttattttttattcttgcctggttgctctggcttaaacttccagtacagtgttgaatagcagtggtgaaagtgggcatctttgtcttgttcctgattttaggggtaaagctttcagcctttcaccattgaatatgatcttaactcttggtttttttataaaggccctgtatcatgttgagggaattaccttttattcctagttttctgattgtttttattatgaatgtgtgttggattttgtcagatgtttttctgtatcaatcaaggtgaccattgttttttttctccttcattctgttggtgtggtatatcacattgtttggtttccttttatgttattggcaatggcattctcttaggcatccattgcaaatgtatgactaagctttctctcttcattctttgagatgttcagagtatgtcctactttgatgttttgcctaccagcatcctgcctctctcgtcacagttcgtttactcagtagccctgtaactcaagctttcttttcctagtgtcatcccacgttgaaccagttgttcacgtgggctagattaatccacttaaatgccttttcttccttcgtatatcttccctgctgaggagcctgcagtgattatccattgttcatcagatcaaacctaaactcttcctgacatttagaaccctttgtaatccaatcccacatcacctctctgatctctgttatttatttatttgagacagagtcttgc

SEQ ID NO: 10466 - DNA, 1031 bp, Homo sapiens
atcgtaagttgatcacccaactctgtgcttaaggctttggggaaatcaagagaggtggatgatcttgtgcctgtccacagggagctttctgtctagttagagaagcaatgtgcacatgaaagggctggaggacactaaagcaagcaagtcaccaggacccagacacagatgctgtggtctactagtgagctctcactttctctagattctgagaagagtggggagttggaccaagttggaccaagactcccatggcaaaggaggctccctggggattctgggcaaagatcccagaggcagtgggggaatggctgctttctccaagtcaaggtgtgttgaggggaagttaaagctaaacataggctcctgagatggtctctccataccactggggcctgtggccaagccagtggcctcaaaaaccccagctttccctctcccaactggaaatagtgggacctcgtcaaccccaccacggacagagctctgtctcatcaggcaagtgctgtgatgaagagccacctagtgtgcatttaatactgtatataaatacactttacaatcacgaagaagactttctactcagaggagaccactggaatattttatagtgatgcagatcaagtgaaaagaaggagaataaataaaagggaagataattatccgatggagttctttcagtatatgccacagcagggcatacttacaaagaatacatattactagagagacacagcttttcaagcatcaaactaacctataaattgtcagactcgagaatgagaggaaaggaatgggagagatttgggtgcccatcacgccattagcactgggttccgtgctccaccttgcttgcaacagctctacacgccagccacagcacagtcccgcagaagggagacgccacctaataaatgtctctggaaaattacgactgtactgctacagtaaaaagatggcgccgtttatctcagcaccatctgcacaggctcatttgttgctcctgaggcagcccacacgcacccagcaag

SEQ ID NO: 10467 - DNA, 1039 bp, Homo sapiens
gtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtggcctgcatgtactgtatattacagatatttgtcatgctgggatttccaactcgaatctgtgtgaaactttcattccttcag

SEQ ID NO: 10468 - DNA, 1031 bp, Homo sapiens
tgtggtttctgcatgaagtcataacgcaattatgaaggagaattagattctgtcatcgtggtctcctgcagggagcacaaagttacttctaaagaatgttttcttaattctttacttgaaaataacctctgttcaagtagcataccagatgctcttagagaaatggagtcagtgactccccagacacaccatcaatcttgctctgaactttgtagccagcctgtgtttctcctgcagtctcctaccccgttgctgctccgggttttgccatttccagctgcagtaatcgtgtgtgtgacttgaacatgtgtttgctgttaaccattttagaatgtgttttttcttctcaacatccccctttcctccccttttgggtgcagttgatggatttcccatccccagaacggggaagcaagatgcactgtggattttccttcatttattttctagtactcacctaggagcagacgcctagcttcacttggtttaatttcatcttaaagctgacatgatgttgtgatgtaggaagacagtaaattggggtcactggttaatgctgatattatttttgatgactctaacccttaggtcttactccaccccccgcccttctatcatttgtacttaagtatttacctggtgaaaataaagcttatgccgggcacggtgcctcacgcctgtaatcccagcactttgggaggccaaggcagtggatcacctgaggtctggagtttgagaccagcctgaccaacatggggaagccccgtctccactaaaaatacaaaattagccaggcgtggtggcacatgccagtaatcccagctactcgggaggctgaggcaggagaatcgcttgaatgcaggaaccagaggttgcggtgagccaagatcacgccgttgctctccagcctgggcaacaagagcgaaactccatctcaaaaaaaaaagaaaagaaaagaaagcacattagaagagctactacaaaaataatgagccagagtgttgattgcttttttgtaattttggaaagga

SEQ ID NO: 10469 - DNA, 1071 bp, Homo sapiens
caaaaatgagagaatttaaattttttacaattaagctctggttttgagtagattgtgggttatcacaccgtgcatttttttaatgtacaccttactcaaacacaccctaaaatgcaggcttgcagtctgcgcattgtaaagcaggagcaccgcagatcaattgggggaaaaaatatttaaggttgtaaatttaattttgttctaggattttcattttcatttatggcacccgttgtgtttgagaacatggaccaatttatggattagttttaaacccccagtctgtcacactcaatgaacaattctaagttggagagaatccatatgaaaggattagaatgtgccacagtggagcttacacatgactgtttcaactaaatattgcccagctgcctctcctgcagtattattttttttttttgctacttagttaaattgctagtgtctctaatttcacacattgtcagagctttttttattttgtaaatatactgccacaataaatgtatgtgatgtttcatttattcaagatggggtctgataaactgtaggactaggagactaagaagagaagtcaattttgagtagaatgtgcatctttcaaataatattgctgggcccttctttggataccttgtttgactgtactcataaaatagccagagagtgactgttaagaccgtacacacttaatgggttttcaagaagatgggattgttttttcttggccatataatataaatgtataataaatttgctctctttgtaattaaaattaagagacagtagctcagctaggccttttaaatgtctatataacccaacaccaccataagtccagctcaattttttgtgacctgtttttctcatgggctagctcaaagattttttttttttaaggcagcagcaagatgaggttttaaaaaggctttgttagggcaattagacattttcatttttcaagctgattatagcatttatcacttacattgaaatttagtatttgcattttgcctctacgcttagaatgttacccaacaatatggtcaccacacaagttgattcacaggg

SEQ ID NO: 10470 - DNA, 1034 bp, Homo sapiens
gtagtctctaaagtactgaaaggaatacaaacagtccctgatttatgatggttcatcttacaattttttgactttaggatggtccaaaagcaatacgtattcaacagaaaccgtacccatacagcctttcactttcagtacagtattcaataaattccataagatcttcaacaccttataaaataggctttgtgttagatggttttacccaactataggctaatgtaagtgtcctgtgcatgtttaagggaggctatgctaagctgtgatgtttggtaggttaggtgtctcagatggatttccagcttacaatgttttcaacttagggtgcgttgattgggacatagccccatcgaaagtcaaggagcatctgtatttgatgtcaacttgccgtatcaacttgttgtggctttaaaaccattaagccattatagtaccattaaattttttttccaactataaaacagttttagattgggagccattcagagcctcactatgatttgccacgaggttccttggagtctgttttctttcctgtgtattgatagtctgaccatatatttctgtttcaactattgctattggcaagcccctgttccttttttttattgtgtcaaattgtccgtgtggtttcattcatgaagacatatgctgtcatgtggaagcataaattgcataatttaaattgtccctggaatcctttgtgaaaaagtggagacagccagccattaccccgggtaagagtccttcacacagattcctgtcaaaaactagaatagaagaaaaccctgatgccatgctggggtggcgggaggaggtgggggagtgtgagtgagtagggagtgtttgttctgtcttgtttttaactttctttgtaattagttgactttgtgtgttaggtgtacataaacttacccatttctgtgatagtattagcccctgtcttccagttggatcaaactttttcctgtaatcatctcaggaaagcatgttgtgtttcccttcctagttagcgtggctgttgttttgtt

SEQ ID NO: 10471 - DNA, 1049 bp, Homo sapiens
tgtttacagggacttaacacaaaaacatgtgaaagtaattattctgtgagaaaaaaatatctcttgaaagagtaacttttccgctgcattttgttagctggtgagactgcaaggtatctgaaccgtgtgccctggtacccacccctgtctctggacttctttatgaacactgagtatttgactccccacccttcatggtcagctccttttaacaccctagatatcattgctgtccttttcattgacatgctagagacatttccaattttcatgggagtcagtaagatagagatgatgaaaattcagagtgttcaaagaaagaggaggcctcatcagttgatagaatatacaacagattgtctaatctcagttttcttcacttttctacccattacagtggaaaaaagaacccttaaggaagccagtgcttctcaacattggttacaaaaccatcagtgccagcacttaatttaaaatcttctgaaaatccatcagttggttttcatgtctcactctaaactcagctccaaccaggctgcttcctagattcttgtctgtgtgtgtttctgttttggctctttgttacttccttctgtaaacttaagtaaactcagtttgttgacctagtgaattgattctttccattttctatactattcaccagcatatcaaagatgcttcttcctaactctgatttccagagtaactgtgctatcagcttttcatactaagaactaggtttttaccttttcacatttcttgcctgctacccagttcgtaagccaaattagactcgtactcttgtgaagtgccctttagatactagtgtaaaatatactgcgtaattctccattgccctacatatattaaccctttaagaaaatatatcaccagtctattttatcttcgcagaacttgcccaggtatgagccagcatttattaccactcattctagaaggtgccagttaggtagctatccaggtttacattttaaggcagtcgagaccttattcacgtggtatataaacaaccacatttctcttttata

SEQ ID NO: 10472 - DNA, 1021 bp, Homo sapiens
tattgtattgtggacatcacacactttatgtcaacacttttagaataggtgcagaaataggattataggctgggcgtggtggctcacgcctgtaatctcagcactttgggaggccgaggtgggtggatcacaaggtcaggagtttgagaccagcctggccaatatggtgaaaccccgtctctactaaaaaaaaaaaaaaaatacaaaaattagctgggtgtggtggcgcatgcctgtagtcccagctactcgggaggctgaggcagaagaattgcttgaacccgggaagcggagattgcagtgagctgagatcatgccactgcactccagcctgggcgacaaagcaagactccgtctaaaaaaaaaaaaaaaaaaaaaaagaaataggattatagtatatcaggggaaatctcccaggaacaaatgttccttttcagtagtagatatagtaattgaagcaaaacagaaaaatcacattaactgaccctgtgctgggcagcaggcacctctctggatatagtttagttgtgtagtggagggagcgggacgtctttagtgctgggctcaggggtcagtgcacttggttcatttatatctatgctgacacctgcagcaggtgtgtaggtgcatccaaatgagtttccaggtcacaaaatgcttccctacctgtggcctccataaaaagtgtgaaggagcaagactgaacacatggcctgaatcaccgtatttctcattctgcctttcttttaaaaaggtagtttaaaatcactaacttaaccatttttacctcttggaggagaatgagattttttttaaacgacatccttttttggactcacgtgaggctgctttaaatgaaagtgtaaactgcttgtatccccatcttaaaggaacggagcctcccattgaacagaacagttgattcttctctgttaatttcatccaagtgtgtttgtgtgagagaagcaatttgtgaggaaaattaaaagctcagattgttgatcgatggtagatatcattt

SEQ ID NO: 10473 - DNA, 1023 bp, Homo sapiens
ccctgtatagaagcatagaacagagaaaattggaagacagcaagcttttgtgcaatttgtcatttatttcattttgtcttagtctcagtgtttaaagagaggtttagttatatggaaagctgacttttgtgaaacaccgtattccctcaagatgtttggcatctgaaatattgatttttttttttaggttttacagggagaagggtgcattgcattatcagcctaacactaggcacccttcacaccctttgaatatggtgattgctctctgaactacttatgggcttatacagaaagggaggaaacccagacgataagtcatgtttttaatgctgtagattgcaattccaaatgtctggtcctctgccctcatctgctatttaccttatatgtttcatacttgtggtttttaatttgcaattcaatataaatgtttgataaagatattttaatttgctctctgctttttagttagccttagaattaaaacaattatagctaaacctctgaaataaaaaaaaattcagcagattatggaagatcataagaaggtcctaataaaatagacagagagtgcatagatggtggtgatgctgatgaagaatatggaagagaaggtcatagttctctatttagcatttttggagcttaaatactttcataggcattacttcactcaattctcataataatccttttggagagataacatttatccattttaaaatatagaaacattcagaatttcagaggttttcctgttttcaccaccagtaagctcagaactacaacaaaaattcctgttttccaagtgcgatggtctcatttcttcttagctgccccctattagtgaaaaataagtcataggtaatgttcttctcacttatctctaatttcagtgatgattaatcagcagcccacacttagatgatactaatcaagttattgttataatggcaccagtttgtgtagttactgtgcataattgtctgacataggctttgcactggggagtcagcaggc

SEQ ID NO: 10474 - DNA, 1027 bp, Homo sapiens
ctgtgagcttactaggcatgcaaacgcctgggccccacctcgcacctgctgaatctgaaaccctgggaagggcccagcagacaggccctccaggtgatgctgatgcatgtgacaacgtttgagaatgcagatgtatgcaaaacaaccaacaaacacccttaaaagggtggcctggcatagagctaaggttcaaagcagcagcatttaactgctgcttttattactattaatattacttggtcctgtcatttatactaataatttactctgtgtacaagccctacattcttcatacttttttcattcactggtgaattagtgataaaaataaacattttctgacagataaacatttttgacatttaaaagatgtcatagaactggatacactaactcctatgctcctctggttacagtgctagagaataccagcattctaaaggttaaggttctaatgtgtgctttggacatatttagtgcttttgacatgtcaggaagcttccagtctggacagtgaatagtgctacaatttaataacataaatggagtctgtctgattctgcaaagaaatggccttccttggggcccagaatatatagttccttctgcagttacactcacagtatttttaatcatttcatgattttattatatcccaagtataaggtgctacaaagagtccctggtgctggcagtcactcaaaaattggcaaatctaaaaagtgaatagaacagcaagtagcccattagattatttttttctttattaaaaaaaaacttttttaaaaagaaaaactaccgtataaagttggaagtgttgattttggcatcttatacatgaaaagtagtcgtaataaagtgcctcaattgttggtgcttgttctgcagaaattatggctgtgcacaattgtgagggcttaactgggtttccaggaagtacgtaattcacactctaaatgtgacaagcatgactgcccataaacctaacgacttttttaagagaccaaaattcagaatgttattctct

SEQ ID NO: 10475 - DNA, 1045 bp, Homo sapiens
cctgtgattgctaacaccattatgaagattgacagtttcatcaagaaagcaaagaagaaaatctgcaggcaataaatggaggcagtgctgggccctgctctggttaccctcaatagtgcttccagagcactgagctggggtagggtcctttccctgcttcaaggacctgtggctttttttattgagcacagagcctgagaacttctgtggcccttttcctagtacaaataggtagctttaagacttaatgaggagaaatctgaagagtgcagatagagatttggttgtggtggtgaggattggttttttccttgcctgaaaaggatgacctgaaaacaagcctctagcattgtccagcaacctttccacctcacaggctgaaatgcatatcccaaagtctgcaaatactttagtacagtggccaaactgaagaagctcaagtgtaaaaaatcaagaatgttcttctaaggacacagaatatctctgaattgttagtagttatctatagctaataattctgggcactctcttaccccaagccagctgcgtcacaaatatgtgggctgttggctacaaggccagtggtgtgaatgattcaatgcaaacccatcaacactactggaaaaacaattcttcgtaaagacttactggagatgattcagtgccatcatcagcagaagcgagcagctgtgtgaaaccactgcttctctgagcctgggatgtgttaacgatatattctcagaagtaaataatccttttgctaacaagacgaaccctatttactcactttcattcccttgaggtttgaattcagcccggtgaccgtgtcataaatatcattctgacctccaagggggctgttcctgaatctgagttcttttgcacgtgtccttctcggaggttaaactgtccacccagccatgttgccttatattcgtcatattttttaaaggaaccaaaggggttaattggtttcttcagtaaagagacttttgccgaagaaagcaattttagaaaaaaaaaaaaaaaaaaaagaaagcaattt

SEQ ID NO: 10476 - DNA, 1043 bp, Homo sapiens
aataagcaattgaaatcaaaccctaaagcttatctagatgaattcacatgctcctttacctgcagaagttggctggaattatgcacaccttatgtcaatgttgaaaagcatcgggtaggaagtgtgattttcagggaggaaaatagatcttgaaacccaccaaaatgtactgtggttgggggacttttctggagagaacacaacttctatttaatgggtatgaagaccaacactctagtatgtaatgtcagtgtgtgtttactgtgacactcctttgtcatgtatcttcaaagatggcattgaatttatcatgagctatagccatctcattctttctccaggcgatgttttgataaatgttgatgagtttataactgtaaaaccaaatgacatttatagtgtgatacacactttacccattgcataattatatctaatggcttcgcatgtagaaaggcatttaccatttgcttttgtataaaatgacaatctaaaccccagggctaaatttttttttttaaacacgatgataaagacttaattaagaaccaaatacaatttatttttgtaactggcatttaaggtacctagttctttggttaaatatgtgataaaaatcatgatacttctagtaacaaagatcagtgggtttcatttatttccctctgtctgaaatattggtgaactcacttaattatcgaactgatatctggtatgacttcttgtttctcatttctagctaaaagagctattttgaaaggtagcacagaatcgaataatgtgttcagttaatgaggaacatttaagagatgtttctgaatttaatatgatggaaaaaaaataaaccaccactgtagtatagacattctttatctagacagtgatgatgtcttaggcctcttggttgtggtcaagcaaggttttatttttagccatttagacattttggaatgtttatcatcatacagtaggtcacttaatagatcaaaacagttttattcttagtcttcatgtcagaaatagctcttagtatcttgttagga

SEQ ID NO: 10477 - DNA, 1044 bp, Homo sapiens
ctctattttattaccttataagaaccctcagaagaatagccacatttaatgggcaggaagcaaaggaggaattggaggtgggtgtggtacaaaaaaatgaaaaaagccagaggaagaggaaggcccttcccaaagttaaagggagagtgctgaggtgggagtgggtcagcacagtattaaatactagaagagatggcggtagatgagaacgggctattgagtgtaatgtttaagaagaaattgtttcaagagagtagtttcagtagttcagttgcattaaaatggtaagagctgaaggaaggagggtttggtgaggaagtggaggctgtaggtgtacacacaccaccactggagaacaggctgtgtttctcagtggtgctagcagaggcctcctctggcaaatgcatgacttgagaaggcagcccaggttccttgtgaagagtctagaggggtgtggtaggggtcaccagaggctacgtctggagaggcaggctcatcctgatcatgtttcctggccagtagccatctgagcattgtcctggttattacctgcactgctgagatacttcaccccacctaatactccaaactgaacagtggtgggtatcaggaagccatcatgaatctcaatatctgattcttgcttgtgaaataacttaagatatgttgttttaatttccttatttacctctctaaatcacagaatctgaaccctgtgagttcagaccgtagagtaccttcagattctaaatcatagagtctgaagatcatttatatagaataactggccttatgcctgagaaataaaaagtttgcttcttattctgtttctgtgcttgaatttgggacttaaactacagttgttgattactaactgaagtctgctaaatccttggcttaggcagcataataacacaactaatcatagccaataataataaatattattaagcaataatgagacaaaaactactgtggttgtctcattcaataatactggctccagggcatttacagtataacattttgtatgtttgcttcaaa

SEQ ID NO: 10478 - DNA, 1035 bp, Homo sapiens
tttctttttttaggtaagaaaatgagcatttatttagaatgagaaaataaataacaacaaagtacaaactttacaaagctaacacatactataaacttcacaaaatctagaaaatataatggtttgaattgcctgatatgactccataatacctttcccactgtattttcgtaggaaaaatctggaaaactcccatcaagtttctttgatatatcagtttaaaaaatgcacttgctatttgtaggtttattataggtttggggttacaaacatgggaatctgagaaattctatttcacataatgactataagaaacatttctgtttttctgaactttaaattcaggaatacatgtgcaggtttgttacataggaagacttgtgtaaagggggtttgttgtacaaattatttcatcaccccagtattaagcctaatactcattagtcatttttcctgatacgctccctccttccacccttccccctccaataggccccggtgtgtgtggttcccctctatgtgtccgtgtgtagtaatgaacattttcaaattaggtactaggcaccgtggtaatgtgtttgtatgtgtgtgtgtgtctgcgtttactgaatgctttacctgatatcatttttacatgtacatatatattttcatttcattttcaaaattatacagtaacattttattttgtgtatgtatagttctgaagttttaagaaatatatatgttctcaagacacagaacaattctgtcacaacaaaaaacttcctcatgatctgtgataagcattttgagtgcattgctatttaattcttataatgttatggggtgtgtactgttatctcttttttactgttttatttttaatttctgttgaggaaggtgagacttagagaaattgaataagccaaagtcacacaccaaatgaacagcgaagtctggattggaacttggagctaagttctgtctaagcctagaattccagcttttatgcactgtatcatattactgctcacagaacatggcttgggggct

SEQ ID NO: 10479 - DNA, 1045 bp, Homo sapiens
tctttgcagtttttattcctgctggcagggtttgtgaatgaacgcttggtgggtgtttttgttaccatttgccttccactggtgctatgtctgtcatacaagctggctcagagaattccagttttaagagtgtctgagcacagaaattatgggcactctgtttactaccatatccatgacatccagcatagtaccttggaaagccacctaaaataaatctttcatatacaaacgaggaatgagcactttctacatagtcatactgcatagtcttagtcatagactcttgattctgagggctcacttatctactctgcttatgtttctcagaaattagtaaggctcacttgtattacttatagtgaagcatgtcctttgaagttgaagggcaggggcaattattttatgcgtgtgaactttttatattcatagaagaaataatttactggggatgagaagaaaaggcaaccatgttgatgcataatagggacccgagctcattaacttaattgtttagtggctcctgactgttcttctctcccccagtgtccccccatgtgccctttcacagtatttccccatgagctttgagtgaagaatcctgagaagggcttctactcttgcctttccctctgctaatacgagcatagtggtggcgtttgtacaggttttcctggggtactagttccccagtggactcacttgttgaccttgaagatgcatggtcactcatgactagtcagttgagaacattatccataatattgttatcaatatcttgcatctctatcagcagttctctgggattgtgttagtgaggatagagagcttcacatttacaatagcttgaatgtttggaaattttcttaccttcactcactagtctagggtgggtggtccagatctatggatgggttggcttcatctagttgttcagtgacctaagttaatggcagctctgccaccttttgcatgtcactctggaggcactctggtgttactgtttcagcttcccagaaggaggaaggagaaagtacaggaggag

SEQ ID NO: 10480 - DNA, 1039 bp, Homo sapiens
atgttatgtacgcattttgctttcaaattaaaaaaaataagtagggaaggttagctttacttttattgtgtgtgtgtgtgtgtgtgtgtgtgtgtgtgtagtgtgtaataggatgtataatgtaatttcaaagccctctgatgcaatattttgaaactaagttggtagtacaattaaaacatatctttggtcatagattacttggccttatgccattttcataggcaatgtcctacttatatagcctggattggctgagaaaaataattgctgctatgaaataattttgcaattaccactgtaattaagggcagtttgttaatgaaagtgcttggtgaataatgactgcagggcactccatcttgcagcttcagccagatgattggttcatgtggtggaggtagttagggaattagtgacacagctgtcatggttacaggatggatgtaaatatcctttgcagttgatgatgaagaacagtcattagcctcctgccccttgggaactggtcagaggaacaaaaataaacttaacacgtgatggtaaaagccattccttatgtctccttttcttcagtatgaacaattaacgttctaatagaagctgcagagagcatgtggatgaaccctctccactttacaggcgtgttagtgtgataaatgttccttcgtgtagggcattggttgttcacagtttataaccactcttattagcttataggccagttaaaaactgctctttagagacccacaggccctatttaaatttttcgtgttcatctccaggtgttgtgtattcagtttgaccctttaaagactgtccacggttggatttttgcatgctgtctgcaaggctgcaggggcaattgaagatcaattttctgtatctgggcttacttgcttgtgtaaaatatatattgttatgaagaagacctagatgcttatctgatcctcctttatagtttttaaaagtcattgaaggttgaggagccgttttttccgccttcttaaaataaatgtcctaggtgtttaagtgtgct

SEQ ID NO: 10481 - DNA, 1079 bp, Homo sapiens
tgaccagtgcatgattttaaaacatcatgagtggctaaaagatccattcaaagtgcaggattgactaatgaattttaatgtgacagagtatgagaagttctttgatgtggtttcagattccacaatccaatttaaccatgaagaagccaccacttgttgagttttggtatagtatcaaaggagaataaaaccataattatctgaaaagactattaaaatacttttccttttacaactatatatatacatgaggctattttatttcccatatacttcaacataaacaatggatcacaacagattgaatgaagaagcaaatgtgaaaagccaattgttctctattaagccaaactttagatttgcaaaattcttttctaatttttttgctgtggaaaatgtagttattttcacaaaaacatgtcctttgtgttaacacgcgatgggtttattaagtggattcataagattctttaaaaaatattatcagttttatttttaagagtttaaagtgatcctgacattatgaactttgagaaccacacccctgacgtggtaaaattaaattttcctatgaatttttatggtttaccagtgcatgagattgccatcttgtgacaaaatagggaaatgcaagtatttttgaaaagctcatctttaaggacttggagtgatttctaatgactacttgttggaaatttatcaagagaaagatataagttcagatttccaagggctatgtcttaaaatatatgtgccaaaaatattaattttcagaaggtaagcaaaaaacagttaattaaatgcatatttctaaagggctgacattggtttggggccagtcttctgttaagaacacatttagtttttatgttcagtgtgtatatttcctattacactgagcccctttgtatgtgatgttatagactactcgaatgtgtatttactgttcaaaacactgataaatgtttgtggtgatattctggtggcatatagttgtccccctttattctcaggggatgtattccaagatccccagtggatgtctgattctgaggatagtattgaaccctatacagact

SEQ ID NO: 10482 - DNA, 1039 bp, Homo sapiens
gttgaccttttggattcaaattctaactccatcttttactagttgtttgaccttggacaattaacttaatttttctaagcttagataacagtctgtaccttatagggctgctacgagaactcagtgagataatgcagataaagtacattctcaatgcttgacttcaaataaggacacaatacaagataatcattttcattattaccatcataatcttcataatgaagaataatatgataatgaacatccatgcacataaccccttgtatctcttcatgaatgtttccttagggtaagttcttagaagtgaaattgctatcttcctcttgactttctacaaggtctttaatctttacaaagttttgtatattgaaaaagacaagctcttattgaacacatagtaggtgcaatttaccagcataggcagaggaggttatataaggttgaacatttctttgtctatattgactttgtaatctagtgtgagagttaagaaatgaaactaactgtggtaaaatatgcaatgtgagatatatctttgaaaagggacaaagtactatggaaacacatcatttgaagagagaaatttcagcagagggaaatcaggaaagacttcatgcaagagatgaaaaaattagatatctatgatgcatagtgttttgatagatgaagatagtgaagcatatccttggcatagcaaggtttgtcatatggccatttctgtcactggggccttagggtttaagtgcatatactagcccttgactttggagacttagagaccggtaaggagcttatcttctctccactcactctgttcctccatgtagaatctctttatcttccttccatctccttcaggacacaggcaatgtttggatttcctagtttctctcagaaacatgatactacatcgtgtattacttaagacagattcaggccagagtacacatacaactcttgagttggtcaaattggaattcagtttctaggttctccatgattactttaatctgatttatctgaagaaaagttaatc

SEQ ID NO: 10483 - DNA, 1029 bp, Homo sapiens
tgacaataaatacatgcactgagtctagctcacggtttctcaaacttcagaggcccatgacccttcccgatgtagttaaattgcccagatgaccctcctgtcatatatttttaattgtaaagcacttgaaattaatcatgttttatttctttttaaataagcacctcaagagcagtggtgagcagttttgctcacggcacttatccactcttaaagaaaattaaagattggaaagggccttgcgtctcagtggcagcaaagccatctacatgggggaaaacatagcagacaagagctgcgtttgatactcctctacacagtctcttgcctgtgcacttagtgaaaattggcaccggtgaatataacaaagtaaaagcattttgaattattaccgcaagccttcaagtggtcataacccaagatttcaagtacctcagtgaagggtaaggttttctacaatttgtgtggtaactgagtgcctttaatttaaactacacggagctaatctttaggagaattggaatctgcctctgaactaattatgatttacagaaattgataatttgtcttctgcatgtgtctgcaggaagaaattactattaaatttgattaacaaatgacagatttcagcctagtaatttaccatctttattagcaaacttagaaaacttcttatagtaatcttttcaatcatgtcaactctattctggtagttaaggtttatgtagaagtaacccatgtgtgtggctttagtaagaacctaccttacctttaacaaagaaatcttggtgtggtttctcttttcaataggcaagcactactcaaacgctcacactgatttcccatggtacttagaacttaataataggtaattaacttccaaaaatgaataatctgttcttttgaatacattcctgcactccctcaaaatatatgaaattgtgtaaaaggaagtagagcattatatcatatgttcgccttatttttcgtgcaccactttgtcaaatgtttttctttctcttcaaacag

SEQ ID NO: 10484 - DNA, 1846 bp, Homo sapiens
ttttctcttgaagataagacagaaaacaggatgccttgttgggtttaaaaagtaaaatacaaactgtcagttttctgatatcaaggtacatttttttgagaatcaacattccaaatggccaatctggttaactctcagtggtataagatagggcaaaggaaattgactatgttttggtacttggttttattttattttatactaagtgcttcttaggcaattctgcctcatcaatattctgtagatgtaggcatcattaacctcagtgaaaagtttattacaagccactgttaggacttgtttctgaataatatttctccagtatttaaatgaaacaaactacctttacccaaactcagtcaacagagtttaagattattcagaatatggaaaaataaggtttagggcctgggtgctgtggctctcgcctgtaatcccagcactttgagaggccgaggtgggggcatcacttgagcccagaagtttgagatcagcatgggcaacagagagagacttcaactctaccaaaacaaaacaaaacaaaacaaaacaaaaactcgggtgtggtggtgcacacccatgtcccagctacttgggcaggtgagttaggaggattacttgtgcccaggaggtcgaggctgcaataaggcatgattgtgccactgcactccagcctagggtacagagtaagaccctgtctcaaaaaaaaaaataataataataaggtttgggtgtgtgatttggggcagtgtttttggcatgcacgggtgtattgtgggtgtgcatatgcctagacagacatatgcacaatctgaagacataataggcattttcctcgaaataaatttggctcttagaattgctttcttctcagtcacatgcaaaatatggtgaagaatcataagcagtcataaatactggcttgtatacaccattcagggtcaccttcaacaaaatacaagtcactcaattttatccagcagtcacagtgctggatctactgtgggactcttaaaatgtttcaagtgagagctggatagtcataggtagaatctgagttatacattctgatttcctttatgggctatagattaactgcaactctgatactacttcattataatcctactgacttctttctggtaagagaattgccaggtacccagctctgaatgtcctgaatcctgtcagtagctctagtttataaaggatgatttgctaatgagatttcacagacaagcactagatattgacggtgattcaatgttgtatgttgtctgagtggttgttttgcttcagggtacttttttattttccatttctttagcaacctctttccccaccctgctcttgcagaatttgagatcaagaagtagggcattattaattacatatagacattatagaatgttttgggggttcttaatcaaaatgtaaatgatagtttaaaacatagtttgaatactctgaatgcctagtacctatgtagtcagtaaatagtgattgccgtgaggactacaactgtatcaagacagttttatcctagtgttcagttaaaatcttaaaaaacataaaataaaattcttgctgtattttatgagtaggttttaggaacctagtaagatttttaaggcagaggaacctttagaaggggctcaaggtcacagttggcactcctgtgaaaacgtgtgaattgccttccagacacttttattttgccttaagactgcaactatgttctgtctaggggttctgctgacagcacgaccacacaagtacagtttcctttctgtgcatcagcacaatcagagattgcaatgctgcttgtggccattaggatttagtc

SEQ ID NO: 10485 - DNA, 1065 bp, Homo sapiens
ctgtcaacgacttaagtgttactactgactgacagtgacaggattcaagaagtatcatagataccaatatgctatgtcacaagtataatatgaccagagtggatgtggtccctgctaaacaagttaaacaaaaaggcttttttttttcttcctagtgctttatattttcccccactatagaaaatgcatgaagactttttaaatggtgacatttatggccatgatagatgtgtgcttctacaagaccaagtccaggtgtttccattgggaatacatggaaggaattgatttaagcaagtgattacttaaaaaggaaaattaaaagagtggaaaatggataggagagaatgttaattgggagggtttcaagtataaaggagacttaaggatgggcataaatgtaaatgttaggaacacatttgaaataacttggccttagaaaagaggtttatagaagcatataatttaagaactgtaggttttgaaactgagacacactcattgccagacagaataagaatgaacatatctgaaatttcactgagaaagatcacagatatacagtcatgtgttgcttcacgatggaggtatgttctgagaaatgcgttgttaggcaatgtcatcataatgcaaaaatgtagattttttttttttgtggatcatagagtggatttaatcaaacctaaatggtgtagcctatgacacgcctaggctatatgctacagcttattgctcctaggctacagacctgtacagcatgttactgtaatgaatatagtaagcaattgtaacacagtggtatttgtgatctaaacatatctaaacagaaaatgtccagcaaaaatatggtattataatcttacgggatcactgttgtataagctgtacattgttgaccgaaagttgttatgtggtgcatgactgtatttaaaattataagaacacacaatcccaaggtcatttgattcaggccccaataaagcactaaaatagtccaagaatcttaccttttcccattagtgaatgaaggcattcttcagacttcctagttgaactgatgcaatg

SEQ ID NO: 10486 - DNA, 1177 bp, Homo sapiens
tttagtgttgatgcaatgtatcttttttcattattttacttttaacctattagtctttatgtttaaagtgattttcttattataagtatgtagttgggtctacttaaaaaaaaaatccattagctgggcgtggtggcaggtgcctgtagacccagctactcaggaggctgaggcaggagaatgacgtgaactcgggaggcagagcttgcagtgagcccagatcgcaccattgcactccagcctgggcaacagagcaagactctgtctcaaaaaaaaaaaaaaaaaatccagtctgacaagctctgccttttaattgcgtgtttagatcatttacttttaatgttcttactcccatgattaatttttaaattatcttactatttctttttatttgtctcatctgctctttgttctccttttcttctttttctgtcttattttgtgttgagtattgtttattattccagtttatctcctctgttggtttattagctgtaattctttgttttagtggttgttgtagagcttattgtatatatctgtaacttatcaaagtcttgcaaatgatgttataccactttatttgtagtctaagaacctcatgactgtatgtttctattttcctctctcagcctttctgttacttttgtcaaacattttacttttatgcatatgctataaaccccacaatacattattattgtttattcaatttatcttttaaaaattaaaaataatttaaaatatcttttaaataacaaaaaagtcttacatatttactatatataaagtgcattttttggtgcacttttttcctccctgtcaacctatatttctattattttccctctgcctgataacttcctttagctttgcttgaaatatgggtctgttgctgatgaagtgttgctgcttttattttgcaccccatctccttttttataattgttattgttcaggcaggacagtaaatcttgtccctgttaacttcattttggtgagaaatggaagtcttcgttagttttaaatgtaggttaagttgtcggtagttaatgctgaattctttaatagctgagttgcagtaacattaggtattcactgtgggtgcctctgacttccttcagaggtcaatatatagggatcagggtggataactataaaatccaggttgtattcc

SEQ ID NO: 10487 - DNA, 1078 bp, Homo sapiens
tcccatctgcatttaatgggtcagttgtttctaacttgttcttttgaaatttttaattgaaaatctgttttttttttttttggaaagcacattttacaaataaaggctgttcagctaggtggctaggtggtaaaaactaaaatgagtatgaatgtatgttttctgtaagggttctgaaaacaataataggatctctttaagctctactgtatagggaggcgagtgatccatcaaaagcacagtcttagatttgggtcttctatttagattaggaatgttaagaaagatggatggtaaatgtcttttagctgtattgtccccaaaacatgaaatgaaatctaaagactctcaaagaaggtttcaattacactagcaaatgacttgaacaaggattgggtaaagggaggtcacgggccagtggaatgccagttgtggatttatattgtttaaaatgaaaacattatttccattaacccctttccactaacacctccaccagagttattttcagactgtacgtttgtaggtgttagtcatacttgatagaaatgccttatcacaagtgtgaattgcacagcctttccatgggtatatattttttccttgtccaatacacaatccagggtttcacttggctaatcctctagagaggtactggcatccctgtgttcttcaaacttgattttaaaatgtagcagtaagctacccagttgcaaagaagcatttgtaaatgttttaattaaaaacagaatgaatggattctgtgttgtggttttctgtgataacagccaatcgactgccaaatcacactgtgtacttgagtttagggagggaagagtctaggtttaagggtgactctcaatggatttgcccttaactgtcaatgtgggtttgagtgtggtttttgccctctcactgcaaatggagaaaagagttggtaagcagaagatgaagcatccttttaatgagtcggctatagtgtgcactcagggcagacactttaaaagagcaccattaatttgaataaaacaggagaaggtaggtactttgtacatccataaagcactgaaggggataa

SEQ ID NO: 10488 - DNA, 1034 bp, Homo sapiens
ttttgccttttctgcttgaataggaaaagctttaagaaatcattgaacttaatgaatgattcatttatttaacagacacttattgagtatctattacgtgccaggcactggagtaaatagacaaatatctccccctgcatagaacatatatttgagtggggagtaagaaataaacaattaacacaataaatgaacaaattgtatagtattttaagaatgacagcaactatggaaaaaaataagcaaggtaagaaggactaggagtactagggaaaggattacaattttaaatgggatggttaggactggctgtaatgagaatatgacatgtgaacagaaacgacttgttgtttttcttgtatagaaatatttgttctttgtggtgatattgttagtgtgggcctgatattttgtttttttaataacacagatttaattctgtgctctgtgggtgatctcctttttaggatagctaaaatgaatcaccttggtccagagccctgctgtacactgttgaaggggtctgtaagttgatcttcctgtctgcatgcatgggcgggaactctgcctttaatcaggctccaccagctgtagcaccagagcactgagtttgtggcctttgtatgtcagaatgtgcatagctgtaagagaagttttgtcagtgtgaatctgagggtggagtgagatttcttcaccacctggtgagaaataatctgtcttgcagtaagtgctagtgttgttttgttttggggaaaaaggaaaaaacatttttcatgatgcaggtgttgaaatttctggattcctctctccctcccgcatcctcctcctcttctcttttgccttttcctccttctccttttatttctacttctttttcttgcttaattttagaatttgattctgttgctggatgttatttattctctggcataaccattgcagttcgtttttggagctgtgctccacggccattcacattttagaatggaactgtgttgttttgtcattcatcactcaagtctgaaagaccattg

SEQ ID NO: 10489 - DNA, 1078 bp, Homo sapiens
catgattggcagtttttgtgttaggtacccactctgaagtgttccctatcgtttagaaggtagaagtagtcatcagtgactgaagcctaatttagattcttaaatcgaaatcattgttgaagaatactgctcctccactacagacgtcttgtgcatatcatgagtgtcttcatcagagaacaagctctcacccggtctctcataatataaaagcatttttaatccctcttaacaggtgctgccgcagtttatttataactaatgcattaaaatgaaaaatactgaaagggtcctaagtggaaggtggctattgaaatattgccatatttaaattatagaattttgtcaggctgatttgtggaaaggacgagtcaatgttggctggtaagtgatgtactcacaggtttcctgtaagttcgggtggtgctttccgcagtgtatataagtgggttgtgcaaaatctgagacctacgattcaattgattttcctttgcataatcataatcatattcatatttggtcagctttcatgctctttgatatttctgatccttatgaagcatgacaaatgttagaactcttttggccttctagacttattgcagcacaaaaactcgagatcctaattgaaagaattttgaagagtgtttcatttaacccttttcttcctcgtccaaatttgatctcacacatggggaaggtaaatgcacaccttaatattggtgcaacatgttattctgaagacacgtgctaaacatttgaaagtcttgttgatttatatttccaccatgttttctctttcctgaaaaaccttagccagcgactgaagtagttgggttgtattaatggatgtttatgttgtcctgtgacagctggttttgctaatttgtttttacagggcagtttgtagtaaatgaatggcatgctgaatattttactgagatttcagattatctaaagaatattttccggtttactaattggtagataatgctgagtacattgatgttgacatgagcaaatggatttaaaatgatttgaagtgagcttcattaaaagatgctctaatcacagccag

SEQ ID NO: 10490 - DNA, 2603 bp, Homo sapiens
ctttttctggctatgcctccagtgctgtctaatagaacttttgtgatgatggaaatagtccatatctgtgctgttcagtatagtaaccactagtcacgtgtgactatttagtacttgaaatgtggctagtgtgactaaggggctgaatttttaatcttaattaatttataggtcagtagccatgtgtgtttatcggctaccatatagggctgcatagctctagactaaaaaacatttaaaaagccaaattctcatgctcatcggtatttttaactagtgagaggaggttggaagagggttgagttatattgatattcactccaaatttagtaggtttatattgaacattggactgagctattgtgggcttgtgaatttttcttgactctcctcttgcttttcatgtctaaaagcctttggaatatcttaatagtcctttcctcatttgaagaattaccccttttggccttagatgggtgtagctcatctagtgcatagattaatagctctagctttgtccttaggaaggtaaatcttgaaggttactgttacatgactctactgccgtatgccaattcacattgttatttttgtgtgtgtgtgatgctgaaagtgagtgaaatgtgaaaaaaacattattcattttaaatagttttgactgccaggttaatgcaactcttaagcagagcttcatgaggtctggccatagtaactgcttttaacttgatttaaagttcttaaacgttctgaattgcttcacctaatctttttatactgaacgtataattttcagactcgtctttattttcaaatccataactgacagctgctcaacacctcattcaaatagttttaagagttttagagaaaagttgggacagactggatttactgacatcagttggattgagatattgtggatttaaagatgatagagaaggagagggaaaagtatgaaataattattccgtgttcactgcttgcccaatgacagtgatttaaagcctaataactaacaaaactgagagatggcagaaggacatttgaattaacttccaaatcttaatataaggaatgagtattttctttgaaaacaaaattttcatgtgtagtcctattcgttttattatatttttaaaaatattaatgcacagaaatgcatatatgccaaaacctcactacaacctttttcttggcgtatatcttccagattctgtgagattgtcagctccttaaaggagctaactctttaggggactccatgatgtctagtgcacagcaaacattttccaaacagaattaaccatcttataagagaaacacgtttataaatacctctacttccaatgacaaatgaaatcatcttgtgattcaactcaagaaggctctgggctacagtgaatatagagaagcttcaggaagtactgtttaagagttaaaattaatgtgactaaattttgtcctcatccttttgagaaaatgcatgcatgtctgtgtgtgtatgtgtttgtgtgtgtgtatcacttactatgtgctagacactgataagcactaggtttacaaagatgaattatataggctctcttccatcaaggaacttatattttagatgtttttgcaggacacagtaaaaataacaataccatgtgccaagaaccataatagatatagttcaggagtgctgtggaagcatagaagaggaatgtctaactcactatggagacttagagtcaggaaagacttctagggggtctcttgagttgagccttgaaaggtaggtaggagatagccagatagagacggtattagaggagtttttccaggtagagagataatgggcggaaagacaaaagcatgggggattctgggaactgcagatagtttgctatggctgaggggaatagcctttgaaggagcaccaaaatatgaagctggagagggtacacaattgtcaaatcatacaggaccaacttggtaataaagagaagtctgggttttattccatggagagtgtcaatgaggggagcgggagggtgcaggacgaatctggaggattagagactcaggtaggagagcagttagggagcagctgtggaaggccagctgaaattttgagggccagaacccaggtagttgctaggcagcttgggaggaagttggtttcaggatatgtttaggaaagtagaatttcataactgatcaagagagtgggaagaggaggagtctaggttaatggtcaggttctggcttggctgcctaagtaggtgatgggtgtagtaactaagacaggaaatttagaaagcagacagtgttgggattaaagaggatgtgcttgaccctgcagaagttgagctggaggcacattcaggtgaagatacctagcagcactctgtggcactcatttggagacatggccatggatgagatctcctaagaagaatgtatatggaagaggaagagaagctaaggacagaatgtcaggaacgtcaacaattaaaggtaggcagaagaagatgaactagtgagaggagtgaagaaggggctgtcaagagactttgaggaaagccaggaaagccttttgttttggcatctaagaaggtgag

SEQ ID NO: 10491 - DNA, 1029 bp, Homo sapiens
aatttaatttagtggtggtcttattatcagcttttttagggctataattcttagttgaagttgtttgttctcccataatgaatgaagagctatcaacgtgcctgacttttgtatcttgaaggaatgacttctagtgtgtttgttcatacttggttgttgggcatcattaaagagatttagtctagcagtccagataagagaatctctttccatttatttaatcacttcacagtcctgggatacctagactttgagtcattgctgaggctatatcgtcactttagagttgaagcaacaaaccaagaaacttatctctgaggtcatctgttcctcttcacctcagctttcatgagaggcttgtcttaaaactgagatatatatattcttagaagaggcatggtgaacatacggaaatttaaacctcagggtaacagttttccttgtacagtaataaagatgtatctggagtcagtggctacaggatcaaaaaatagatcacagtaatcggatcaaacctgagaaatggctttttgctgtgtttaaaaaaatgacatgggtaaggcagtctgttttgtggcgatgcttccactatttgtgtgactatacagtctgtgaaataggactggcaaagttaagcttataaagttaattgcctacaactgatctagctttaaacagaaagtaggtttccttttggtcttgtgtagaagaggggagagatttcatgtgtaggcagagagagtatgtgtttgctaacattaccttttaatttaggagaagtttggagtttgttctttcctgtgaatatagaggtggaaccactctaaccagagtttattgctgtaatattttttaaatgcgtttgtaacactgatgtatctgtgaccttgtgaaggagtttttgagaggagggggtggcaagccctttttctcactgtcataagtgatgcctactcaataactctaacttcctgacattattgggagggggaggagggcctctcataacttgtttttgtatgacttagt

SEQ ID NO: 10492 - DNA, 1331 bp, Homo sapiens
ttatggccatgattttcgtgaaaatttaaaacaatacattcatgaaaatgtattgtctccatttggtagtttgtatttgaatatggggatttcctacagcatgaaaattgtgtaattgactaaacaaattacaagctgtcaaagtaagactttcagacaaaaagtgaagtcctttagaagtaggaagactttttaagggtcacagtcagagggcctcatgtggaactgctgacttggggtgaatgagattggctcctctgaagatgatccaagagataccaccaccttagaggagtatttggtgcttgtgtctggtgcgtgtagttacctagttaccagaaaataataaataaaataaaataaatcctaaaaaatctacccagagagatggaagggaagtgctttaaaacccaggcctttattagctagtgttttcaacacgtttgactttgggagcagagctgcctggctaaatgaagttaccgccatcagtcactgccaggccagcatcgggacaggtctaggaatttagttacattttgcattttggtagataacatagagggtggattatcactggctcaagaaacaaaaaaatgaaacctttctttctcagtctacctgctaaatttgttatcgtaaggatcttttcaaagcctttatctgggagcaatatctgccagagttcttccttccttttttgcttgcctgacacccttcccttcagagttcagttcttgctagtagaaaaaggctatgcagcatgataatacagtgattttaaaagttgattatcttgaagtattttgggacagttttggggaatgggttatgtggtatatatttatttggctctttgctgaatatggctgtataaatccagcctcctggatgttacaagtcatccccttgatttcttcttttgaataaaaaaggagcattgcttcatttttcttgcagaaacccttatttaaacaatgaaaacttcaaagatagggagaaaaaaaccaagttaatttagtactaaattactgctcaaatggttttatcttttaaaaggttcaagtagagattagcttaaatacactgaatttcacttttccttgtacgtacatatcttgtgagcaaacttcattgtgaagagctctctgtcttctttagttttgttagtaatcacataattgttagttgctgtttatttccctttcctgaagcaaatctctccatctctgggccaggttggcaagtggaatacccagttaagattacaggatagtaaaacccagtgctttaatcaaactgcttactttacaagatggcaaaaataaaat

SEQ ID NO: 10493 - DNA, 1035 bp, Homo sapiens
tttcctctgtgaattcttaatttatgagttacgagataattgggttcagccgatgccggtgtggttacaacttcatttcaggtgatgcctctgactggatgggttcaataaaatgttcctgaaagagatccctcgtgctgctgcattgtaaaaagcgccagtgtcagttaaacgtgagcgtgagtaaaggctcggtaactggcgcataatagaggcaacaatagacttgtattggctgcaaaaaaaaaaaaaaaaaaaaaaaaaaaagccggggggcggtggaaagctgtggtcggggatattgctttttgactaaaaatgggagtcgtgcaatgacgcttggcagcagaagtaggattagattatgcctcccctgtcaagactgctcattgaaggcaccgggtagtagcaacggtactatatttgtaactatctcgcggtgagaagttgccttccctgcgagggatatatgctgacttaggagcggtctggaactcaaccgtgcatgtcaaagctacatgaaaattctgttgccagttaccatggaagcagcttcttgctcttgtgtacatccctgtttgtatgctggttatcagattgtgttcaaattagaaagtaattgggtatgatttgtagtgaggagatgagatgactttcttaatttttttctcttaatgcatatatatatatttcgtggtgagtttgagaggaggtcttggctcattccggggtcccataccccaggggtaaatttcaggtgggcaccaagggacttttcctcctcagttctgtttaagctttctcagaggcctccagttcccactcccagggttaaagaaacctgttggtgcatctgacttcattaggcttgtttcgtttacatccttgctgggaaagcgaattaggaccatcgtgcgtgggtcctggttctgttttctcctgtaactgaagccatccatcccccgcagaaaatctcctctcatttctcctgtgatgtttggatgaaatggatgttaatgaaatgcagtaaaaatg

SEQ ID NO: 10494 - DNA, 1034 bp, Homo sapiens
ttttactcaagaatgccctgatgtggcagtaaaaatattaattttcttaaatcttgacctttgagtacatgcctatttaatattctgtgtaataaaatgggaagtatgcaaaaacagtttatgctaaatatgttcatcttgaggaaaagcacatgtgcacttgagttgcaagctgaactagccactttcttaataaaacacccgtttacttgaaatgatgagtgatagacaatttatgactaaccagacttgagtatttggaaaatattttcttacagataaacaaagtgagactgtcacttcagggaaaatgactgacagtgtttgttgccatagataagactgaagtttttaagcatattagaatttgtgaaaatttgtattcctattgtatcagtcacgatctagtcaggagagaaaaaccacctcgcatataaatagggaaggtttaacataaagaatgaactatttgcaagaataaaagagaattctaaagaacaccgtaagactaagggagagttccaataaaggaagaaacttgagtgggggctgggagtcagaattcactggagttggtatcatggtagccccctgcatgacaggaagctactctgggccacagcccatccacagtcactaggccaggcctggcagacaggaaactgcttgtgatggtcaatggaatttgctggaagctgtcatggaggctggtgaacacgctgggaagcccagctgtggcacacacagggttcaccaagaagcccctctctgtggtcctaagaggctgcccccagggaggagctgcactgatgggtgaactttccataaagccactctccatggtgccaagggaagctggtaatgggggagatgccagctccaataaacatgacatcacttagtatcccatgcactgctggctaccatgcaccaaggagaaagctgagaagatcactggaaccaggaagaaaagccctttcctcctccagtgttcttccagtgctgtctactgacaaaaagttccaattgaccag

SEQ ID NO: 10495 - DNA, 1050 bp, Homo sapiens
actgggtgtgggggtggacagagggacagagcatttgtgggaatctgactctttgttatttgtgtttaggccacaacgaagacctaccctcaaacagacattttcgtcacgataccccggattcatctcctaggagggtccgtcatggtaccccagatccatctcctaggaaggaccgtcatgacaccccggatccatctcctaggagggcccgtcatgacaccccggatccttctcccctcagaggggctcgtcatgactcagacacatctcctcccaggaggatccgtcatgactcctcagacacttcacccccaaggagggcccgtcatgattctccagatccttctcccccaaggaggcctcagcataattcttcaggtgcatctcctaggagagtccgtcatgattcaccagatccctctcctcctaggcgagcccgtcatggttcctcagatatctcttcccccagaagggtccataacaactcccctgacacatctaggaggactcttggctcttcagacacacagcaactcagaagggcccgtcatgactcccctgatttggctcctaatgtcacttattccctgcccagaaccaaaagtggtaaagccccagaaagagcctctagcaagacttctccacattggaaggagtcaggagcctcccatttgtcattcccaaagaacagcaaatatgagtatgaccctgacatctctcctccacgaaaaaagcaagcaaaatcccattttggagacaagaagcagcttgattccaaaggtgagcatatgactgtccatgagagggatgtatgtatccctgggagctttcttttggccgtttagttgatttattaggtataagaatggaatttctttgggaaagttttgaaaagtgagaggctgggtttgggagagttgaacaattatggtggcagggaggaaggttttcatatgtctttttatgtgctcgctccaccccatataaaagtacaatttatttgttgcagaagctttggaatgtacagaagtatataaagataaaatg

SEQ ID NO: 10496 - DNA, 1029 bp, Homo sapiens
tcctctaatttttctccagaatgtcttgcattactagcaatgggcatgtcagttagctcccctccctttccatcctgcctctgcccctaagtcccagcctaaccttaatcattatagaaaaccattgaaatacagagacctgaaatcctttacccaacattcaagaagtatgctttactttcattatttaaatagatcattggaatggcacagttagcattacagctgtgtttgctattaagagcttttgttttaaacttagtcccaccaagagtcagttcatccaagataagctcagtagtttccaagaagctttaactcagaaaaccaaccaagcaaacacaacttattttcaagtcccaggcttttaaagactgaagtcaaaagtgctaccaggaggatcctgtcaacataggtgtggctttgatagtcttcttgactatccttgatcaagaagaagtactcattcctttttctctccaattctagtccatagaatggtatgctctgacaggatagtaacccatattaagagagtatttatttttattattcttttttgagatagagtctcactctgttgcccaggctggagtgcagtggcatggtcttggctcactgcaatctctgccttctgagttcaagcaattcccctgcctcagcctcctgagtagctgggactacaggtgcacaccaccacacccagctaatttttgtaattttagtagaggtggggtttcaccatgttggccaggctggtctcaaactcctgacctcaggtgatccacccgccccggcctcccaaaatgctgggattacacgcacccggcctaaagagcatttactgacatcagtgaaagagatcataatactgggtataggacaatgttctagaacactgaagattcacagacatacatgagatatagttcttgcctgcaaagaatttatagtctaatgtgaatgattaagtacataattgaacatggtaccaaggataatgttagagcaatcagagacaaagtcttt

SEQ ID NO: 10497 - DNA, 1676 bp, Homo sapiens
ctagagtgcagtggtgcaaccacggttcactgcagcctcgacctcctgggctcaagcagtcctcccacctcaacctcctgagcagctgggactacaggcgcgtgccactacacccagctaattttttttttcctttggtatagatggggtcttgctatgtcgccggggctgatcttgaactcctgggctcaaacaatcctcccttcttggcctcccaaaatgctggtattacaggcatgagccaccacacccagccatattggtattagtaaaggaaaattagatgccatcatatcagtgtccatggttacctatttccttgatggcgatttgccaccagccagtatgaggccaggcactgtgagagcactaagcaggcagcatgccaaaggtttcttcccaatttgtagaagtgtcaggatttcacatgccccatgctgtccgtaatctccctgcctgccaccctagaaggaaaaacaaggtttgtctttcttctatagtggtacacacacttgatctttttgactttgcaaataaacacagcagcataaccaatctacaccatgagattaccaactggaactcacaaagaaaaccacatcctcttctctgagctcagtcagcctcagctttattactcaggcctcatagagcagtaaaatgctgacagagtgggaggggttaccccagaacctttaaggggagtatgcagtcacgttattgctcccattttctctcaaaacccagtaagtgagtcaggacgagtcaacattgacagattcaatagagaattgtgcaggttgccccaaagttccccgggaaggtgggtggcgtgcattgtgtccatttgtgcacttttccccttgtgtgatcggacgatcatcccacctctgcactctcttagctttagtttgataaatattcgagcatgtagctcttgggaaccatctttcctccatgactttggtagctgctgaattggcataaagggttgccaaagatttgatcctgaatgtcatgttccttgggcagtgggttagtctgtttgtaccccccaaaatggtcgatagggtcttatttatagagtgtcacaaaggacttctagactcagggtcagcattcttaccaaaaatcagacttgacttatttggtcttttacagttgattaaagactctttcacatgtgttgtcttttcgagcccccaaacaaccgtcatttttcagatcaggaaccttgaggagaagctgaaagatttgccaacactttgctggtgagggagctgggtcctgacttcaagttttctgatcccctggtcatgtattttttcctttacgcctccttgcccactctgcaccctccaagcacagctgccaagtgaaagatgctagcccttccaggtctttgacctactgatgatactgaaacttgagcagacagagccctggggtatcccctgactcctattaatactctttttcatctggcttttaactgacatttgtctgtcctgaatcagaggcttctcctggaaattaaagtttccctgagtcatttgttcatttacatatgggtatattgtccctcataattctgcaagcagggttctgtgattaaatcaatttccttgtttgtttttgtcagctgactcagcacgtccttatgcactcagaaataa

SEQ ID NO: 10498 - DNA, 1025 bp, Homo sapiens
ggtatgatctcggctcactgcaacctccacctccgggttcaaatgattctcctgcctcagcctcccaagtagctgggattacaggcgcccgccaccacacccagctaatttttgtatttttagtagagacagggtttcgccatggtggccaggctggtctcgaactcctgacctcatgatccgcccacctcggcctcccaagtgctgggattacaggtgtgagccaccacgcccggcctagagtctgcatttttaaccagatgccaggccatttgtgtgcatgtgaaagttcaagaagcactgcctagatccgagttaccccatgtaatccatggaccagcttttaagggaacttgttggaaacacaaattcttaggggcccatcctgacctactgaatcagagtttgaaacagaattatatagataggacccaggaatcttctgtttaacaagttctccagacttgtcctatgctcagtgcagtttgagaagcactgttctagctggtatgtcgtctgagtattctcattagctctcattacttctggctggctggtggcctgggcacttggtcactctgaggttcctttctctccaggggctgcatcttcttcccagtttcaaggcttaccttcccgcagtgcaatctttcagcagcaacctgagaactgttcctctcctcccaacgtggcactaacctgcttgggtatgcagcagcctgctcagtcacagcaggtcaccatccaagtccaagagcctgttgacatgctcagcaacatgccaggcacagctgcaggctccagtgggcgcggcatctccatcagccccagtgctggtcagatgcagatgcagcaccgtaccaacctgatggccaccctcagctatgggcaccgtcccttgtccaagcagctgagtgctgacagtgcagaggctcacaggtaagaccgcctaacgtcacccagccatctatgcatgggatccaggtgggaggaagccccttagcagagtgagagaaaaggaggga

SEQ ID NO: 10499 - DNA, 1024 bp, Homo sapiens
attactgaaagggttctggtcatcaacatgccatttcaccagggttttgtactcttttcccttctctcttggtagtcattaagatcagatgcctatgatcactatagtgcaatctacagcctgctgtgtgatcgacataagagacataaaaccctgcgtctcggagcacttcctagcatgccccgagccctggcctttcaagcaccagtcaatatccaggtgggcaataactccagtgacctagttcaggacaagtaacaccaggggggtaaaggttagctgttgctcactaaccctaagtcgagagtttcttgctcttccttacctctgtctcctcccatttgtcatctcttcctttgtcagaggccaatcaaagatctgaaccttttttgatggagaggagggatgagcaacaatagttgtgccttttgtttttttgaagaaatagcaaatcatgaggcgatgctatcctcttcacaggatgcttccttgttgtgacttctaagggccgatgaaccaaaaactttagtaatcagggaaacatagactttagcaatcaagactacttggaaagactcattatttctctctagtgttaaaggtatgcgtgtatatgtatgtactgctttccaggcggagcaggcaggtactgctatgaacatcagcgttccccaggtgcagctgatcaacccagagaaccaaattgtggaggcaagtagcaacctgtgggagctgtcagctgaaaccactttctttgccatatccttgcttcccttccttctgatttctaactcgatggtgtttccctccacctcagccggatgggacactgaatttggacagtgatgagggtgaagagccttcccctgaagcattggtgcgctatttgtcaatgaggaggcacacagtgggtgtggctgacccacggtgagtatccggccaacagccctcactaacactggggcaaagaattgtcacctgactttcagtgtctaccatggcacatttcctactacattgtatc

SEQ ID NO: 10500 - DNA, 1035 bp, Homo sapiens
ccctaaccccctgcaactactgatcctttcactgtctccacaagtttttccttttccagaatgtcatatgggtagaaacatacaggatgcagccttttcagattggtgtttttcaaatagtaatatgcaataaggttcctccatgtctcttcatggcttgagagcccgtttctttttagcactgaataatatttccttgcctggatgtaccaccctttatcctttcacctacggatgacttggttgcttccaaattttgacaattatgaataaagctactgtaacatctttgtgcaggtttttgtgtggacataaatttttaattcatttggttaaacactaaggagcacaattcctggatcatatggtaagagcatggatagttttgtaggaaactgccaaactgtcttccaaagtggctatgctattttgcattcctgccagcaatgagtgagagcttctgctgcgccacatccttgtcagcatttggtggtgtcagcattttggattttggccactctaataggtatatagtgatatttcattgttgttttaatttttaattctctaatgatgtatgaggatgagcatcttttcttatgcttatttgccatctatatatctttgttgaggtgtctcttcaggtctattggtcgtttttaacttcaggttgttttattttcttattgttgagtcactcattacattttaaaacactttttctcattgcttctgagacgccatattctccagttttcctcctgtcctctggaagcaccttctccatcttctctaccagacttatttttctctgctcatcctttagatcttttcatctttacaacatctttctggagccatgttatttactgctgtagcttcactgatcactgtggtgatcagtcctcagttaactttttgtcccagacctctcgatctagggcgacatatccaagtatttgctaaccattatcttcactttcatgtattgaagtcagatcaatggagacatattcagaaatgaacttgacttcc

SEQ ID NO: 10501 - DNA, 1078 bp, Homo sapiens
ctgtctcaaaaaaaaaaaaaaaataaataatatatatgtatatgtatatgacagaacagtaatgggatgtagaggcgtaaacaaaaggctgtggaagcacggaggaggaagccattgacatggtgttttctggtggaaatcagttaagccttcatacaggaagtaatatttgactgggccttgaaaatgagtgatactttaaagatggaaaagaaaggaaaaggcatggtacagagaggaaatagcatgtggaaggcatgtaaacacaggatgtgaatagtctagtgatgctagcatggccagggataaattggaaacataggatggagctgggttgtgaagggccttaaatgacaatgctgagatgaagactcttctgtaagtagaagggaggcagcccatgttttttgagcgaggaggtaacaggatctggtttgtgtaactttgtgctatgaatggatagcttaggggaaaatgaaataggaagtaagcaatagcatcagtcaagctagggatgataagagtatgaactgcagtggtagaaatggaaatagaaaagaggaggtggagtcaagacacatggagttgaagcagtaagagttttattaccaggttgaaatgggaaacgagggagaaaggacttgaagatgactccagtgtttctagtaacacaggtggtgatgtcactaatgagggtaaaagcactgaaagcgcaggtatgactttggaaaatggtgggtttgaggtgtttcttcccaagcaagtattggggattcatgccaagaacttaagagtggtaccagggccagacatataaatttggggtatttatatcaaatgctggtagaagtagcgagattaaaagagttagccctgagaaaacatagagcaaggagaggcagttaaaatcagcagagcctgctgaaaaacaccttctgtagaaggtagaaagaaggaaagcaaatagcaaaaggagagttgtcaacaagagtaaaactggaaaagagagggacgggtttcagagagtaggtgggtgcttaacattttcagatgctgtgatttcagggagcatggtgtc

SEQ ID NO: 10502 - DNA, 1091 bp, Homo sapiens
ctgtaagatatcatttcacatccactgggacagctgaattgacaataataagtaataataataaagacaataagtgttggcaaagatgtggagaaattggaatccttgtacgttgctggtagggatgtataatggtacggccactttggatagcagtttggatacttcctaaaaagttaagcagagttaccatatgacccagcagttccactcccaggtatatatccaagagaaatgaaaccatatggccacacagaaactcacataaatgttcatagcagcattatttttagtcgctgcaaagtggaaacaacctgaatgttcaacagatgatgaatggataaataaaatgtggaatgtccataccatggatgttattcagcagtaaaatagactcaagtgctgacataggcaacaacatggatgaacctccaaaatattatgctcagtgaaagaagccagacactaaagcttatatattgtatgattccatttatgtgaaatgtccaaaattgacaagtctcatagagacagaaagtagaaagcctagggctgggccattggtgaaagacttgaagggtgttggggagtaactcctaattagcacagggtttctttttggggtgatgaaaatgttctaaaatttcttctttggttttttcactgccttttccttacaaggtgaaaaatgttctaaaactgattgtggtcatcgtcgcacaactctgtgaatgcgctaaaagccgctgggcattacactttcaatgcgtgaattgtatgggatatggaatacaagaaatatgttatggccaggtgcagcggctcatgcctgtaatcccagcgcttcggaaggccgaggtgggaggatcatgtgagctcaggagttcgagaccagcctgggcaacacagcaagaccctgtctctattttattctatgttttaaaatttaaaaattaaaaagaaaaaagaataacattttataagaaaatattttatgagagacttataaaagagacattaagaatatgaagtaatatatttcgtattccttatctcaataatgctgtagggaaaaaacaattgaaataaaa

SEQ ID NO: 10503 - DNA, 1037 bp, Homo sapiens
taacattattccttttggcaaatctaaataaatatatgcatatacatacacatgcatatttgtattttcccttccttcctacacaaacagaaacacactctacatatttttctacgtcttgcagtgcttcatggatataaacccatccatggaccaaaaatccatgggctaggagggaagacacacaagataagaaattactgtaatataattgtttgctgatgtcatagaggcagatagattaaatgtcattagacacaaattatggagcagtttttctagggcgggtgagtaggttagggttagcttcagagaaatgacctttaagctggactttaaaggataaccttgaattccaaagttcagctggggatggggatgagaataggagacaggcattccagcaagaagtaaaaccctgagcaaagtgtacagcatgttggtgaaacagcaagtacacatgcaggtgaactatgtttatgaattagaactatatattgtaggctgtgagattttgttgaaaagttctaagttaaatgaatgacacgaccaaagaaatgtgttagaataactggtaacaatgtaaaggatgatgggcagaaagggaaacctgaaggatagagaagaggaggcatactctttaaatgtaagtcgaaaatttagcgtattttgtaagtaattggatgttaagagtgaggaagaaagaggagttgaagatgattccaaagtttctttcatggacatctagatgatggtaatagggattcaggaggagaactaggttacagcaggaagataaagagaacgttagttcaggccaggtgctgtggctcacgcctgtaatcccagaactttgggaggctgaggtaggtgcattacttgaggtaaagagtttgagaccagcctgaccaacatggtgaaactccgtctctattaaaaatacaaaaattagctgggcatggtggcacctgttgtcccagtgacttgggaggctgagataggagaatcacttgaacctgggaggcagaggttgtgat

SEQ ID NO: 10504 - DNA, 1023 bp, Homo sapiens
catttagttgcctagctatttcattagaagttgcaaggccgggcttggtggctcacacctgtaatcccagcactttgggaggccgaggcaggtggatcacgaggtcaggattttcagaccagcctgaccaacatggtgaaaccttgtctttattgaaaatacaaaaattaaccagccatggtgatgcacacctgtagtcccagctacttgggaggctgaggcaggagaattgcttgaacccaggaggcggaggttgcagtgagctgagtccgcgccattgcactacagcctgggtgacagagtgagacttgtcttaaaaacaaaacaaaacaaaaaagaagttgcaaaatggtgattatttgaattctctcattcattcaacatttatgagttattcttcttctgtaaagaactttgccttataaactacttagaaattatagtaatgacaagataaatgcttgattctttcttttccttatgtatcagtttttagaataatgaattggttctctgcaatctccagtggagactaaggaagttggttttctattttgtaacataattatgcaattatggattttagtatattttatgtgcttcagtccattaagtcattcttcttttgaaactgaaattattccacttagccagtgggagcctggagcctcttcaggctgactcctgtgtccttttgatgtgagctcaatagtctttgatatttttgttgcttttaggcaagatgtcctatgcttatcttgaacatttcctgtaccagacatggaatcaaacatttctcctaggaattctggtttggtctcctctcctctcctctcctctcctctcctctcctctcctcccctcccctctcctctcctctcctcccctctcctctcctcccctcccctcccctcccctcccctcccctcccctcccctccccttccgtcccgtccccttcttttcattttccttttctttttctctccttctcttctcctctcctctcctctcctctcctccc

SEQ ID NO: 10505 - DNA, 1069 bp, Homo sapiens
tttcccatctatttggaataaatttataattcctactatagcctataagattatataatttggtctcctgctgtctctcaccacagctcctagcactctcctcctcacatcggcatctttctttttcattaaacccttcgctgtgctcccgctttaagaccatatattccatttcttcttcctgaattactcttttcctacatatccacatggctgtctctcctgtttcttgccagtctcttatcaaatgttatctcattagagaggtgtttgctcaccatgctgtctaaaatctcattcttcctactggcccattgctctgtagtctctgtcttgctttacttttctttttggtttttatcatgaactgacatatatttatttgtttttttactgtcttgagtcaataaaatttacgtgccattaaagactttgtcatttttgtttcctaccaaatcttcaatactcaaaatagtgcctacagggaatgcatgttccataaatatttattgataagttgaataaaatactaagtgaatgaaagaacatcactggattgctgattatggcgtttaagttttattcatctgtgtcttccttgtttaatgtagtgtctaacatatagtaggcactcagtaaatgtatttcattgtgtcataatgaaatataactaagtcaagcatggaatttgcatgttatttaataacatcttagttaaatgagtttttgacatggggaaagcaccttttttgggtaactgtatagagaaagacatattgaagattatgaattctaagcagtgtaataaatagacttcagtaattggttatttcatgaatatttactactcattcaattgacttatccagtttatttttgcatactattcagccttatattatgaaggagcagtgatgacagtgtgggtttatttaatgttacaaacagaattgagaaactggttagttttgtaaaccactaaatttataatttaaaacttccacactctgatatctttagatatatatccccaaacttcctatttgagaccatgaagtcataaatccag

SEQ ID NO: 10506 - DNA, 1044 bp, Homo sapiens
ttcctcctacatgttctctataaaagaactgctagtgacaagcattttattatattaaaaattctacttcatactgttttaagttaaaatgtatttattatgaagccaatattgtgaaatgtttttttctttttccagaatgtggtttttttttcttgtaatggactaagatgcaggcttattgtgtagaatgaggagctattgcccagatggaccttagtgaaagtaacttaaataagcaagtagattttgcttctgtttgggaaaatgatctaagacggatgctggtattttgggcaggtggagactaatgttttatctcaatgtttgcaacttaagttcagcctacttaagggctgtcccttaagggtgtccaattgtttggcttccctggccacactggaagaattgtgttgggccacatataaaaatacactaacactaacaatagctgatgagctaaaaaaaaaaaattgcaaaaaagtgtgataatgttttaagaaagtttatgaatttgtgttgggccacattcaaagccgtcctgggacgcatgtagcccacaggctgggttggacaagcttggtctagaagttttctagattttactacaatgttcaaatggcaaactttaaaagtggggaaaggaattttgggtgagataaaaagacaggtttgaaaaagcatacaagttcagggaactgcaaatggtttcttaagaccaaagcgcaatgtcagtgtgaagaagtggcaggcaatgggaaaggataaatcagtggagcccagacaatgaaggagctttgtacttgatgctgaggagtgtggatttgtttctgcagataatggggaacttctgatttttctttttttaggtggacagatagaatcaagtttgcttttgttaattcatgtgacaatgtagaaggtggactgaaggtagggagagtattgtattcattggagactcattaattgttagaagactattgtaatcattcaagcaagaaataatgacctaggccaggtacagtggttcatgcctgtaat

SEQ ID NO: 10507 - DNA, 1030 bp, Homo sapiens
acaagattaatctgggccaagggctttcctgtgaaagttactattttcattatgggagaaaaatagagcagcatggccagtgtgcatttttgttatcccatccttaggtaagtgagtttagacagcctgagctaaatacctagatttgcaaaaacacctcctacccccatgctttccttttaccatttaaaattgtttgtgaagatcttttttttctttctttctttcttttttttttaaacacagagatagggtctcactgtgttgtttgtttgggtttgcaactcctaggctaaagggttcctcccgcctctgcctcccaaagtgctgggaatacaggtgtgagccgcagtgtgcagcagcttaagtttctgatctccctcaccacctcgcactttcactcctcataccccttccttgtttaatagaaggatcctttgttttgagtagtctccaagtggagtattttggagagactttgaataaatcctggcccaagcctgatcacaacacttggacattgagcttacctgcattctgctgttgggtagatatggaatctctgcccctcttgatcaaagctacatagcccataaggaaacatccattgagcagccttctttcctttcacttaatcaatttcaatgtattgtggtagaggtctttgtgatattccattttagactatatgatctttaggaatgcttaaccctgctgtgccaaagaccaggggaaggctgtgtattcaaactcatttgttctctgcttttttctttttaattattagtagttaactctaaatgaaagtatagaactgtttagtttgagcaaggaacactatttgttggcctctgctttctgttccccttccttcccttccctccctttactgtggcatcatgattcttccttcctgtattcttggtcattctcccagcacctcactttagccctacagtggagattcttctgttcactaataactgcagtggtgtcagtttcagtagatcagccttcgtcttcctttgct

SEQ ID NO: 10508 - DNA, 1025 bp, Homo sapiens
caggcgtgagccactgtgcctgaccttatacaaagttttaaataacatggccttctgactttaacttagaaaccaaagagtggtaggagtagggggaaggtattaaataacagaaactatctttggtgattaaaaagttgggtacctactattctaataacttttaagggctcttctgtaggttagtgtaaaagtaattgtggtttttgccattaaaagtaatggcaaatggcgggcgcttgtagtcccagctactcgggaggctgaggcaggataatggtgtgaacccgggaggcagagcttgcagtgagccgagatcacgccgctgcactccagcctgggcaacagagcgagactctgtctcaaaaaaaaaaaaaaaaaaaagcagtaatggcaaaaaaaaaaaccctaagaatttcaatatattatgagtcagtgaaaatatagtatttgttgttttgtttccctaagtgcccaattgagagatctggacaattactattatagagattgtgaggatggacagagaaccttttgttgactgaggtagtcaaagaaggaaggctaccagggtgagctaggattgagcagtgagaaggattgtttctatgtatggagaaaaatgggaaagagggaattgtggacagagcagtgtaagcaaggatacggaaatagcaaagtacaggtcatttttagggacagaagatgaatcagtttagcattagaagatgatgaaaaagtagtctgaagttaaagtatggaaagccttcttcaaacataaggtcaaatacagctttggaaaagttaacagttacaagtatgatggtgtaatgaagattctagttcttctgtaagccaagcaggggccattggctttaggatgccctctatgctccaatataatggtgctgcctggcatcattgaaaacattaaaaaaacttttctaaaaagtatttgaggactgggcatggtggctcatgcctataatcccaacactttggaaggctgagatgagagaattgct

SEQ ID NO: 10509 - DNA, 1050 bp, Homo sapiens
ggcaggcctgttgttacaggtagaaggtgctcaaaagctggtttcttaactaatttatggattatttttattttttatttgttattttgttatttttaggtttttttttttttttttttttttttttttttttgtagagacagaggctcactgtgctatccagggtggtctcaaacacgttggctgaaatgatcttcctgcctcggcctcccaaagtgttgggtgtgagccactgtgcccagatttattttattttattctgtttttttagagatgacgtcttgttacgttgcccagacaggactcgagttcctaggggattctcctgcttcagcctcctgagtagctgggactataggtgcacaccatggtgcctagcttaattaatggagtttttgataatggttgacaaagatagtggtaagcaaagcagcccttatatagactttacatcttaaaacataatcccctatgtgtgaaattgagaacagctttctagaataataaacagagatctgtatgctaactaaaaggcagagagaatattggctcagccaggccctcacttttttgttcctccctatctgtaaaacatcatttacctcatcagcgtgctacggacatgggttaatgtttggaaaattctgtggaaagagtggggttctgacaatgtgctctgaccaaggcagtttagcaaatttgtactaagtggctgacctttgataagcaccactccttccccacctgacctgtgattccatttttcttttgtgcaaatagttctgaaggtttaatgtttattttttactacgatgcagtagactttcttctctcgtgtagaaactgctcgaatgactgtggatgactcctagaatataggaataacagaattggtttctcctgtactctcaacacaaaatacttctgtgaccaaatgtgtgggagtgtgtccccacacaccaagcagtcaaccagttctgcagcagctgccagctggtgtcctctaatgcagttcagttcagttcagttctgacactgtctacctggaga

SEQ ID NO: 10510 - DNA, 1054 bp, Homo sapiens
gaaattccttgaataatatgtttttacccccttacttgtattacatttaatgacatctctggctttattttctccattcttttttccatggagtttcttaatttcactgtttttgccttgccctttagacgggtgaaacaatgatgactcattttagattgatgaaagggacagcttagcagctggagagctggtagacactagagcactaaattgccagcaccagccttctcttcattgtccacgtaaggcttgtggcagaggtatgcccattcagtcatttattaatatgtaatttgtaggttagatgacttcatcaaattatatttacatctgacctggaggttcaaccatgttttgctttgggacatttttaattgttaaaaatcatagttgggttctgatcaatatgtacatgctgaagttcttatttagccacattatgggcttttttggttttcttcagcatgtcaatagtacacagcagctcagaatggtcaaaattgtttcattagtgccttaacaaccattcatgatatatcatattgtagaatgcaagtatagtcacgcactgcttagcgatggggatacattctgagaaatgcatcattaggtgattgtttccttgtgggaacatcataagagtgtacttacacagacctagatggtatagcctactacccacctagggctatgtggtatggtctgttgctcctaggctacaaacctatacagcattttcctaactcaatattgtaggcagttgtgacccaacggttaagtatttgtgtatctaaacacagctaaacaggaaaggtgcagtataaatacagcgttatcatcttacaggacctctgttggtatatggtgcacgactgtatatcctttatctacatttcccccttttggcttggatagaccatcaattccttgggtttacatttatttcatgtaatcttaaaggattttgttttatgcatggcaccattttttttcaatacaaatggttagtataaaacccaaatttgagaatttgataacaatggcttagtat

SEQ ID NO: 10511 - DNA, 1094 bp, Homo sapiens
gtatttttagcagagatggggtttcaccatgttggtcaggctggtcttgaactcctgacctcatgatctgcctgcctcagcctgccaaagtgctgggattacaggtgtgagccactgcacctggccagaggtaaaattcttaagtttaacaggatctttctggttttctagcctcatctctgtcctcttagcgccttagcttcactggccctttttcagatccttcacatgccaagctcattcttagcacagggctttgtatatgctcttttctctgctggacaccttttttcttggcatgtttaatttgtatttatcttaaggacttagcttatgtgttcctttctcaagaaagttttccctgaccttccatttgcctaaaggtagattagattccctctgaaattattaatagtaatgatggtaacaacaataatagcagcaacctttgagtgtttatgagttgcagagactgttcttagcacttacacataggaagttttttggttttcatagcaaccctatgagttgtataggtgggtaaataagtaggacctagaattatctgcatcttatagatgaggaaactgaagtgaggaatgttaagtcacttgtccaaagtcacacagccatttggtagcagagttggaatttgaacccgggcagaccccagtgcccacgttctaaactgctgtgctctactgtaatggtgagtataactgtgtaatgttttttgttaatgcctacctttgttggtaggctctaagctcctcgaggtcagaaatcatacctgtctggttaatttccatggcctaggacggagcctggcatggagtagtctgtgaccgagtacttgttcctattgaatgaatcacagcttgccagtctactaaattgaggaaatagagggtttcagtgtgatccttttcacttttcctccccactgcttccaaatattaaactcccttggttaaaagaataggtgcctgtacttatttcaaaatctaacccctctacctgtttgccttgtatattctaggagtaatttatgtacttcgtaagaaaaattagtgcagatgtacataaagtaaagg

SEQ ID NO: 10512 - DNA, 1050 bp, Homo sapiens
agaaatgattcagaattgaaactaaagtgaatttggacttactgtatttctttgcaattacttttaaacaattgctgtctgttactattaggcatattttggacctatgggttccattttgggccgatatttggtgttatgttgttaaatttcttgcctggcttagatggttcattgttgaaactaaactggaactaggtttgatcagagggccaatggaaatgcacgttgtggcccatttggggaggacaaaatttgacatatttttactttaagaattcttaggaaaatttggataacgtgagaatatatttccaaagggttaagtaattttcgagggaaaatcagaaagcttgtaattcctactgaaaatattagcctgctgaaatattagcctatttcctactgaaaatataacattagcaggccgggcacagtggagttcacgcctggctaatttttgtatttttagtagagatggggtttcaccatgttggccaggctggtcttgaactcctgacctcaaatgatctgcctacctacgcctcccaaagtgctgggattacaggcgtgaaccactgtgcctggcttgacttttttatttaaaaaaaaaaaatctatacccaattgccctatcagtttatcatttactcacttatttgaaacggtcatattaacatacactctttatttatttatgtgcctatactttgttttaattactgtatctttagaatatgtttcaaaatttcattaactattataattgattctctttttttgtaacgtatcatcagcaaataataatttggactcttctaatatttctgcttatttattgacattttcaaagaatagcttatgattgataataatcataccagcgaatacagtgcttttcaacttaaatatgcacagcaattacctgaggatcttattaaaatgaagactcagtagggctggagtggcctgagagtctgcattttgacaagctcccaggtaatgttgacttatgggttcatagaccttatgttgagttacagggaacta

SEQ ID NO: 10513 - DNA, 1100 bp, Homo sapiens
taaagtattctagtgaagaccggattccttggcataagacaccaggaattttagattgataggagtaaaaataaataaagaaatattggctcagggaataaacttcattaaaatcaatttatgggccaggtttggcggctcacacctgtaattgtgcagcactttgggagactgaggtgggcagatcacttggggccaggagttcgagaccagcctggccaacagagtgaagccctgtctctactgaaaatacaaaaattagccaggtgtggtggtgcatgcctgtaataccagctactagggtggctgaggcagatgaattgcttgaatcctggaggtagtggttgcagtgagctgagatcgtgccactacactccaacagtgtgagactctgtgtcaaaaaaaaaaaaaaatcaatttatgaaagttatttttaaatttgaagatattgaagatactaaatttgtgtttaaaaagcatttattttgatcaactccgctgtatagaatattttgtcttaagtcactgtaaagtttccatgccctcaaatgaaatacagtgccaggtttaacattcgttttcatggattgttttcaaaagttattgagttgtctgatttgctgtaaaaaaaatgaaaaattcatttcttttattaacatgatgtatttactgtgattattctaatagactaatggacttttaattttactgtttaaaatagtttataattaaaatttaatatccagtcttcacttgttctttcattttttaaaataataaagtagtttggggtttatcagaacaagggaagaaaccaagctacgtctcattttatgttgggtaagaatcactagagacgaaattattattattattattgttattattattattattattatttttgagatggagtctccctgtgtcacccaggctggagtgcagtggtgcaatctcagctcgctgcaacctctgcctgctgggttcaagcagttcttctgcctcagcctcccgagtagctgggactacaggcgtgtgccaccttgcccagctaattttttgtatttttagtggagatggggtttcaccatgctgaccgg

SEQ ID NO: 10514 - DNA, 1051 bp, Homo sapiens
agtgttttgcagatttcgggttaaattaaaaatatgacaattttaatttaatttaattaaaaatatgacaattctcaggccgggtgtggtggctcacgcctataatcccagcactttgggaggccaaggcgggcggattgcctgaggtcaggagtttgagaccagtctggccaacatggtgaaaccccatctctactaaaaatacaaaaaaattagctgggcctgtaatcccagctacttgggaggctgaggcaggagacttgcttaaccagggaggtggaggttgcagtgagccaagatcatgccactgcactacagctgggtgacaaagcaagactccgtctcaaaaaaaaaaaaaaaaaaaaggtgttatgcagatttcagtttagccaccttgatcctcccaccttgtgcatgacacgttaccttcctgtggcatgcagtatttgactgattcattggatgtgacttgcattaagttcagataacattgctgaataatcactttcttattctttagtgtagcctcctttctctgtagaacatcagaaattcttaaactctgaaatacagcattctcttgggattttctgtaatgtctttctcatgtaggaaccaacttcagggtcttgtgagcatcagagaagtttaaggtctagggaactgagctaatggaacaaggcatgcctaatgtgataaaatccttgctttctttgcaattgaaattgtttattctaaataactgctaatttacaaatgtattttcacatgattacccattctgttctcaaagagcataataggggttttgtgactttcagactttcctgaaaaagcctaaccgtggattttagaattattaagctagaaaaatacacacatacacacacaggtttgtttgggacccttagtctccaccctggaattaagtgacactgaaaataactctggaataaaaggtttttatgtagcagaatagttgacttacaggggttcttccctttgcacattttctctgggtagaaaatgagcttgtttttcttttagttgt

SEQ ID NO: 10515 - DNA, 1050 bp, Homo sapiens
ttataattttttcaactgctttattgaggtacatttcacagaccatacagttcacccaattttttttaagtgtattcatggagctgtgcgaccatcactataatacattttagaacattttcattatccttaaaagaagcatggtacccattagcagtcactgcttatttcttcaacctctcttctcagccctaagcaaccacaaattaatttttatcgatttacgtcatctggacacttcatataaatagaattatgcagtgggtgtcctgttgtattttacttctttcacttggtgtaatgccttcaaggttcatgcatgttcttacatatgttggaatctcattatttttttatggctgaataatattatgttgtatggatacgccacatttttaaaatcaattcatgaattggtgggcattgtttctacttattggcgattatgaataatatggtcttgaacatttgtgtacaaatttctgtgtgatcatgttttcatttttttcttgggcatatacctaggagtggaatcgcttggtcatgtggtgactccttgtttaaggttttgagcaacttccaaactgttttccacagtagctgccccattttatattcttacctgcaatgtatgagggtttctgttctgtctacatccaaaacttattttcttttttttgattttagccatcctagtggatgtgaagaagtattgcattgtggttttgatctacatttccctaatgaacaatggtagtgagcatcatttcatgtgccagttgatcatttgtatatttcctttggagaaatgtctattaacatcctttgcccatttttgaattggattatttgtctttttattgctgagttgtaagagttctttatgtttgggatacaagtcccttatcggatacatgatttacaaatattttctgccattctgtgggttgtcttttcagtttcttggtagtgttgtttgcagcacaagtgtctttaattttgattctctagtttcttaatttatatagttgtttaaactctgaaactata

SEQ ID NO: 10516 - DNA, 1053 bp, Homo sapiens
tgcagaacagttaccaggagagaatgttcagctgtgacatactttggttagtagctcaccctggctgtctttgtcctacctgctttgatttccttttctttggaagagccttacttagcctgaggttctctggctctgtttttttttttggtaggaaactataaagtattacagatatttttaaaaaagaatgttttctgctctcaaattgcaggtagtctgttgcctgtgcctaattataccttcactagttggatgattgggaacaaagagtagatagattttgtatgcattttttttccttttttaaaatattggggcagggtcttactctgtcacccaggctagagtgcagtgacactgccagagttcactgtaacctccaactcccaggctcaagagatcctcctgcctcagcttcctaagtagctgggactacaggcttataccaccacaccaggttaatttttaaattttttttgtagagatgggggtctcattatgttgcccaggctggtcttgaacttctggactcaagtgatcctcctgcttcagcctcccaaagtgctgggattacaggcatgagtctgtaacccaaatgcttggcccatatgcattttttaaagtatgcatgactataaaagcctttggccaaatacgtttaaactatatttcaacaaatatatatcacttgcctgttattggtttgtggtaagagttccagctttggataaagcaacctgagtttgaatcttttgctgcttaatagttggatatttttaggctgtgagaagttatttaacttctgtgtgcttgggtttcctcatctgtaaagtgggatgacagtagtacttacctcacaagtttaggtgttatgaagattaaagaagatagtgtatgtaaagctcttagagcagcatggtgccctaatagcatgacgtaaatattaccatcatcatcatcgttatcagatgttttagtaacataataatattatggacataataatagtcctcctttttttgcttctcaccccttgggcacgattcatga

SEQ ID NO: 10517 - DNA, 1997 bp, Homo sapiens
gaagatgatgaggagtggaaaaataaagacagctaaaccttcaagatcgtattgacaagggcgtgtgtgtttgtgagaatgtgggtgtgatcattcttgtttgttgatttgccatcccctcctttcctttcatagatctggacatctgtcccttacttagcatcctacgtcagtcccgtgttaaaagaaaacaaggcgattccgcagtccccccgttccctggaggtcctgtggaatggtaagtaatcagcacaaagggggttaatcttaggcctgaggtttggggccgggtgacaaggaagttaaactcgtcctccctgccagattctaccccctttcggagctgagctccagccaaacctgtggagttttctttgaccattttaggacatgttactgcttctgagttggctcccccagctgcttaaacaagacctttctcctgggttcctagtagtgaaaaggagcagcagagcaactgaggaggagggcgggtgggaggcatgggactggggcttggggaggtcaggcgagaccggggtgagagctcagagaagctcctgtgacttccatgctaagatcttgccagagaactctggtcagtcctcgggtgtctggatgaagtaaaggagttaggcatttcttcctttgattctctggcttacctaatagagagagtcagatgtggtctgctggggatggacagagggtttgtagaagtctcctaggctttagtgacccatcctctgcctccgcctccatggtggccagcatgaaccaggattgtctgaaggggttgtatcctctaagccagcgacctggttttatgttgagcgaagaggcggacgccctccctagaggagagtgcagctggatcaggatgcttgtgcagaggatgccctgtctgcacatttaccagcgttttccctacccccagctccttgggggattctttttcctggagtcatttactactttttgcaaaggaagtatgctatgcttagtgcccaaaccaaaactgtcttcactttttctgtcctcctagaaagtgatcaattgagagccatggcaggagaaggaatggccagagaaggttactcagaagggaggatgaggggtggcttccctcaggtgaaggtttcacagagaagaattgagttttctcctcctaaccacatccagcacttgcccaatttccctcaatgtggaatgaaacccctgggccagtcactgcatttcccataaaaggaatgttatcttggaaagggcataaagcgtcagccaagtcagagaagttcagaaacatttccaggaatgcagttcatttggaagcccctggctttgcacttgcgtgtcttagagatagtgtgccttcaactttaccttctatccagggctatttcctgttgcatctgtcaaatgagggcagtgacttaaaagagtaatatggtcttcccagcttcgtcatcctctgcttcctgctgaccaggggacgttgccacggaatgtctaccctaggcattgaggcatctggcaactgcttgcttgtcactaaaaagtaagagaaagaaggacagattgcctgggtggagaagagtgggaggtggcctagtggagaaagcaggattaagagaagggagggaaagatttagggagtttggctaatggagccctttacctgttggaagggcagcaagcaaaagttttaccagagttttccctacccccagctccttgggggattttttgttttgtttcatttttgtttttgtttttttgccttgagtaattttgacatgcagagttattcacaactttttgcaaagtactattttcattggcttttcagagccagtgaagttgccttctcctccaacatgaccacattttcctctgagcagacaaaaacagaacaaataagtttgtgggcttgcttggaggttgaaagaaataagtccagttaaaatgagagttgagccaggtgccctggctcatgc

SEQ ID NO: 10518 - DNA, 1049 bp, Homo sapiens
gcttgaataaacaagcccatgtgctgagcgtgacacaggtgccatggtcagcttcattttcaactgaggacagagcaagagaagattcaagccactgtaacctgtgggtgggacaaggttaaataacaggaaggacttactgtctgaccatgaaaaacaggtggcgaatagctgctgtgataccttgtggagcatgggttttccaggtgggttccgcagaggctaaaggtgctgaagagatgcctcaagagccagcacaggcaggggagggaagcagaggaaatcaaacctccccttcaaacagaacacctctgtctttttctctcttgtacactaggatcctgcatacaattggaaaaggggaaaaggattccgctgctttattttttatttttatttatttatttatttttgagacggagtctcactctgtcgcccaggctggagtgcagtggtgcgatctgggctcactgcaagctccgcctcctgggttcacgccattctcctgcttcagcctcccaagtagctgggactacaggcgcctgccatcacgcccggctaattttttgtattttttagtggagacggggtttcaccgtgttagccaggatggtctcgatctcctgactttgtgatccgtccgcctcggcctcccaaagtgctgggattacaggcgtgagccactgcgcgcggctgattctgctgctttagaaaaaaaaaagtttgaaaattactgtcataaactcttggaccatcgacatccatcattctattggagtaggaggcactggcaaatattagttgagccgggttacaggctgcggagaaatggggcatcccatccaaagggggaaaggtatactagataaggtttggggcgacccagccacattgggactccttgaaaaaccagccagaggtggggtaagtggcgccagggagcctgcttgctcccaggtaccaatggccagctacagccaggagaggcaagtggaaggcagaggaactagctgggaaaaggagtccatttgcacagggctggctgattt

SEQ ID NO: 10519 - DNA, 1031 bp, Homo sapiens
gagtgggggctgtgtgtggtggctcacgcctgtaatcccagcactttgggaggccaaggcaggtggatcacaaggtcaggagttcgagaccaacctggccaatatggtgaaaccccgtctctactaaaaatacaaaaattagctgggtgtggtggcgcgtgcctgtagttccagctactcgggaggcagaggcagaagaatctcttgaacccgggaggcagaggttgcagtgagctgagattgcgccactgcactccagcctgggtgacagagcaagactccgtctcaaaaaataaataaaaataaaaagagtaggactgaaagacacaggcacagggggctgtcacaacagtccaggtgtgaggccctctatgacaaggagggcatgaggctgcaataagatggaaagagaaaggaagggcaggatgcagagaacgtgccagggcaggtgggaaggatttggtgacattggtgtgaagggaaaggaagagggcatcaaagatggttttgagattctgatctggggtgaactggaggataacaagactgtgggaataggaaaggtggcaggaggggatggcttatagtacttgtatacaaatttatttgcttgtttattaattacagggtctctctctgttgcccaggctggagtacaggggcacaatcgtaactcctgggctcaagtgatcctcctgcctcaggctcctgagtaacttggattacaggcacatgccaccagccccagctgattttttcaaattgtctcactatgttgcccaggctggtctccaacttctgggctcaagtgatacttccaccttagcctcctattagtttttcccttacagcaattcctgcaatatataaaaggtctttacttcagtgagctgtgattgcaccactgcaatctccagcttgtcagaggatgacagagaccctgtctccaaaaaagaaaaaaaaaaaaaaaggtctttatcactcacagtgtctagcagaagaaatggggttgaaaggttaaaccactggcc

SEQ ID NO: 10520 - DNA, 1035 bp, Homo sapiens
cctgaaataatgcatacatcctgcagcccagtacttagcagagagtaattgctcaataaatgtcagttccttcctcgttcctttctagaagaggaaagtgggcttaaagttcaacaccagtccaggaagctagtgccagggagcccacaactaaagcaactgtgtggcttgcactatgatttctaactaagcctgcatcagccagtctctgctctctggtggcttggactctctccccatctgtctgtaagaaggacgccctttcttcctacctggcgcggctgttgtaagtgccaaatgagaacttggatggcattgtattctgaacaagaaaaagtaaaatttggggagcactttctctgtgctaggcaattaattggtggtgcctgggggctgatccacaaagagacaagaagacatgttttctgcccacatagagttacagtggaagtgaaagggcggaagtgacgagtacaaggtcatccatgcagatatactcaaagcgaggtcggcaaaccctcattggagtcagctaaaaatgtaaattccctggccccatccctgacctctagagacaggatctctgacagtggggccccgtagtttgtgcctcaaatttgagaaccatttatggctggacgcggtggctcacgcctgtaatcccaacactttgggaggctgaggccggcggatcacctgaggtcaggagttcgcgaccagcctggccaacgtggtgaaaccccatctctacgaaaaatgcaaaaattatctgggcatggtggcaggcgcctataatcccagctactcgggaggctgaggtaggagaattgcttgaacccaggagacagaggttgcagtgagccgagatcacgccattgcactccagcctgggtgacagagcgagactccgtctcaaaaaaaaaaagaaaagagaataatgtatttataggagtgcagagagtgagtgccacaggtgttcagaaagtgataaactcatccaggaaagccgcaccagggacatgtgctctgagcatg

SEQ ID NO: 10521 - DNA, 1033 bp, Homo sapiens
agacatggctcctgacttcagggagcttagcatctccttgggcagttaccaccaaacagtgaacccttgaaagaagatactgtggactgaggaggggctctaaatgctggaagagttcagaggaggagaagaatagagaaagataaggctggggaggtgagcaggagccagatgttgcagggcctgggtcaggttgtgaaattttacctttatcctgagaacaaggaacaactattgaagaattttatgttaggaatggcagtatcagatttgtgttttgagaagactactctcagactctcagggccaagatggaatgctcacctgtaagaggagctcgattgtatttgtagagtggacaatggccgcagtgtagagaacagatgaaagaaacagggtatgctgagcacgtggagagctagggaagaggccatttccctggtctaaggagggatgacagtggctaagcctgaggtagagatggggatggagggaagcggaaggattcaagaatgacacagaggccaggcgcggtgactcacgcctgtaatcccagcactttgggaggccaaggtgggcagatcacgaggtcaggagatcgagaccatcctggctaacacggtgaaaccccatctctactaaaaatacaaaaaaattatctgggtgtggtggcatgcgcctgtagtcccagctactccggaggctgaggcaggagaatggcacgaacccgggaggcggagcttgcagtaagccgagatcgcgccactgcactccagcctgggcgacagagcgagactccatctcaaaaaaaaaaaaaaaggaaaaaaggaatgacacagaacacaaaagctatcccacttgataaggagaaagggagaaggaagagtcaagaaattgataatggtggtgccattcaagatagaacccaggaagttgctgggtaagcagggtgtatggtcaagagttctgtcttggacaggttgagtttgaagtgtccatgaaacatccaagatgagccgtcaactaaaaactt

SEQ ID NO: 10522 - DNA, 1667 bp, Homo sapiens
gagtgcaggggataccaggtgggttgcacgtgtgactgttggaatggtggtttccatcccggcccagagccgtttgcttgtttcccaggcaccaggcatgcaccagttgggggtgggggagtccccttcttcctgggcccttttcctgctttgctcctctgccctgtacctccctcaggagccactgccttccctacagcagcacctgaaagctggaaggggctggaggggcttgcgggatcattcaaggccctttaggaacggccttgtctctcttcctacaaagagattccgtagggaagacctgtttgacctgctcctggctcttcatttttgaagtgaatatggagacagagaagacatgtccagaggacacggaggaagaagcattattaatatctattaatatgcacatgagagttttgagtgtcaaactccaagagattagggaatgatatttattcatccaggatgtaatctcctcataaatcatagccagactttaatgtaagccgactccatctctggcaacggcatctcttcctgtttatattggtcagatttggcttttggcagctccctgcattgggtaagacacacggtgtaggtatttctgctgaaaacagggagacagaaccctataagggaagtggctactgtttctgcgaatgtaaactgtgtgcagatctagcaggttggtgcctggtggtgaagaggggagagagtatttcttgtacttgggatgtttatttacctctgtaccgctagatggaagacacccttgttttctcctgtaccttggcacagatgtcatgctggtttcacagtgaccttaatgaagtgggccttagtgacgcctgaggctccttttcacagggtgggcacagcgccattccatgctacttcccctcatcccatctcagatcagcccaggtccccatggtggcaatggcaggggtaaaggatcactgaggaattcaaactcagccagtcattaaactaccccacttcacacctctggcttaccttcctgggtggtgggatgccagtcccttgtttgttagaatactcatagaaccaggcctctgtgggcaaccaagagggccctgaaaatgatgtgtgtgtgtgtgtgtgtgtgtgtgtgtgcacgtgtgtaagggggattgtaggcacagtcttggtacattgctccaggtggaagccccaccttctccaaggactgttcagctgtatagaccaggtaggggctaaggcctattgatataggtttagatgaatttctgagctaccctttgggagcccaggagaaagcagagtgacttgtaggtgggagacctgcaggccccaggactggcctcatctgctctgtcccctgcccctctggtctgcagagggactccaaccaaagtccctttggcccttgaccaggtaatactgactgagccctcacaggggcattggtctgagcttgggacatagatgacatccttgcttctcagtccagtgggggagatacagagacgactggacagccaactggaggtgttccctgggaacatcagagttggcagcaactctgggaagcagagcacagaactctcctagggatgaggaagtcatggtccagagagggatggtgacttgtctaggggctcatggccaattga

SEQ ID NO: 10523 - DNA, 2029 bp, Homo sapiens
aaagcaaaaaacaaaattaaaaaaaattgatttccatattttatttttcaaaaccctaaaatattacaaaataagtcccgcatatactttaatgttttaactcttttggacaaaggaatcaattacttgaagttgcttttttgactctgcctacttctgagcaaactatttgcgactcacccacaattgccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacttaaactatctgggacaccactactggacacggtcttgtagaggcagctgtccagttttggtgcttgactcttgaataggaattgttaaatggaaagatgctctgaggactaggtcaaagcctggtctttttttttttttttttttttttctttcttttttgggccctcataataagcattgttactattggaagttgttttcacattctttccaatattaaatatgtatttttttaagtaatgataatattttccagtggctcatttggatgagaactaccctctatttttaatattaaaactacatccaactcatcatttagcctttggttgtacagttgtgtaatgggctatggactgttacacaccttaccacctctaggcctatgttttttctttccccatatattctgatggggataaatactgttttgcctctcccataggaatggaatacatttattctaaaatgatctttcacagaagtaagagagagggaaacctaaatatacctctaaattgtttgaagttggtcccagcagcataaaatgggttggccccaaagggttggagggtgggcttggttatcagtatttgttttcagaatgagatgggagcatctttcctttgccacgtgctttgtgcttgataacatcatgcttggttcaaacgacaactcagcacaaagccttgagtataaattgttggaatcaaaacatctcattctgatgacgtggtttaattttttaatttttttttttaataggggtgggagggagggtactttgccccagaagggagggtgtctgcactaaggatttagaaacactttggaagctcataacctcatcagaaactgcctttagccacactcctgaccttctagatgagtaacaaaaaaatgaaataagttcttggaaattaagccatttattttaatttgctatttttttcaatgttctaggtatctttaaatttgttattgtggaatcattttcctgccagatacctttatcaaaattattggcctcatgagagctgaagtaagtcagctttttggtgaactttagtggacttctgtgagattgtagttgtactttgtatctctaaatctaaagatagttttttaaaactcccaaagaaaatctgctctcctttctgatctaaaaactcatctttggggtaaagagttaagtgtccaaaggttgtcacagttcatgaggtcagagggagctagcctggcacctggactctgcccatccacagctgacagattccaacagaagtgtatttaaattctccagtagacaatgctgggtaagggagggggtagggctggg

SEQ ID NO: 10524 - DNA, 1030 bp, Homo sapiens
gttgaattgctagccaagaagatttctcaactgggttattcttgcttctatattcatgctaaaatgaggcaggtgagtataaaactagaacttgcacaaatttaataagaaatctctttctttattttgttttaatgttcttttaaatgtcctgagtttaagaataaactgttccttagtagccaaaggacctttcattttgacctccctcaggttcaattttctagcaataaaatagggataatagtacatattcataacttacaaggttgttaggaaaattaagataaatgtttaaatgagtactttggaagctgtcaggcatgatacaaatgtaaaattttattcttcccttcctttccatgtttaattctctgtttaatacagtaaatagccacatgtggcaatttaaatcagttaaaattaaaataaaaagtcagtttctcaatcacagccacatttcaagtgctcagttaggcacctgttgctactggatagtgtattggaattggaagtacagacacaaatatttcctttattatagaagttttactggacagcactgctctggatttttaaatatggcccctcagctggctgatttttctttttttctttactgtttgcctttagaaaaagatacaatatctaaatttcagaatttgatttagcaaaaaataatttaaaactgtaacaaaaatgacttttttgttaactacattatgaaatttcgtaagtaaacagtttctgtagacgaagatatcaagaacttaactcatttggttttgaaagcagcttaatatcatggatcacttataaacagattttgggtagaactgatcgtctgggagaaataattatgggaaatttggggctgtatatgagtgttaatcaaatggaatacattgctttctcctaggaacatcgaaatcgtgtatttcatgatttccgaaatggcttatgccgcaatcttgtttgcactggtaagtatttttgtatttcctttacccagtgtttttctcccaagttg

SEQ ID NO: 10525 - DNA, 1026 bp, Homo sapiens
agatagcagacattaggttttaattttttagtagaggagtgaataacctcaatgccaaatttattctaagtctctttctgctctgtgattaatttttaaaagcatataatatatattgtctcttctcattttgtgcatactactttgtactgtttggtttttaatctctgttacatgtattatctcaccatgttataaatgccttttaaaaacttattaaaatctgtagtcctgggatctagccatgttttgtacatgtacagatggtccctgacttaagatggttcactttacagtttttcagtggaagtgataagctttcattagaaactgtactttgaatttttaagattgatatttttcctggttagtaatatgctatatgatactcccatgatgctgggcatcagcagcaaactgcagctcccagtcagccacatgatgattgagggcagacagccgatactctacagtatacggcgttgcaggtgattttgcccaactgtaagctaaggtaagtggagcatgtttaaaggaggctaggctgagcgatgatgttcagtaggtttgggtaatattttcaacttaggatgaatttatcagaacataatcccattgtaagtcaaggaggatctatagtgatcagcgttgttaatgttttgacatgaggttattttcacatttgggttgaggtttattattattattattatttttttttttttgagacagactcactctgtcacccagactggagtgcagtggcgtgatctcggctcactacaacctctgcctccccgcttcaagtgattcttatgcctcagccttctgagtagctgagattacaattatgtaccacccacgctcagctaattcttgtatttttagtagaggcgcggttttgcaatgttggccaggctagtctcgaactcctgacctcaggtgatcctactgcctcagcctcccaaattgctgggattacaggcatgagccaccacgcccggcctggtttgtgttttaggtaac

SEQ ID NO: 10526 - DNA, 1023 bp, Homo sapiens
attggtaaagctaaaagtattagtagacgataatgtgagtttgtggacaaataggctacattgtaaatgtgggggtgtaaacttacatctctatcatgggcaatttgggagtatattttaaaattataaatgtatatataatgtgtgtgtgtgtgtgtatattttttttttttttggagatggagtcttgctctgttgcccaggctggagtgcagaggcgcaatcttgactcactgcaatctccgcctcccaggttcaggccattctcctgtctcagtctcctgaatagctgggattacaggctcccgctaccacgccaggctaaatttttgtgtttttagtagagacggggtttcaccgtattagccaggatggtctcgatctcctgacctcgtgatccacctgcctcagcctcccaaagtgctgggattacaggcgtgagccaccgtgcccggccataaatgtatatttttaagaatctttcctgaagaaaaaagttgggtaaatgcagggctgtaggtacaaagttgtttgctatggggtggtattgtcgtgccgaaaaattggccaacttagaaggagattggctaactaaatacgttaaggtataatctgaataggattctacatagtcattaaagagtaaagttgacctgtattcattttcatgaagaggattcatgatacattgccgagtggaaaaaggtaacaaaacagcaagatgagatcactcatataaaattatatcttgattttagttagaatattatatatgataattatgtgatacattctttgtattgcataggtttttaaaaaattatcttgtttgatccttttaacaatactcggctcactgctctagattagaggcattgctcttatgtcagaagtctggtgtgccttctgctattaattgagaattatcctaagacaagaaagtatgcctactgttgaaagcagcaggtgatttaggaagctgtaccccacccaatgtagaggtgaaacaaatattttttaagc

SEQ ID NO: 10527 - DNA, 1029 bp, Homo sapiens
ctgggttactgaactgaggtatatgttttattacaacctagatcttttcacttcctacagaaaaatagcttatacaagctaccagactgtcatatagttaccgtatgtggttcactaggacctctaagaactaattttcagcagaattggttaggtcattgggagaattggtattagtgtatattctgttatttttaaggtgaatgctttaattggtatagaaatgaatactacttcagttgtagtttgtcttggcagaatgtaagtaggttagcaaaatttagactatttttaattttttttataacttttttttttttttttgagacagggtctcactttgttgcctaggctggagtatggtggcacgatcatggctcactgcagcctcaacttcccaggctcaagtgatcctcctgcctcagccctacaaatagtggggactactggcatgcaccagtagcgacggcgttttgtcatgttgcccaggctggtctggaactcctgagctcaagtgatctgcccacctcgacctctcacagtgctgggattacacatgtgagccactgcgcccagcctatttttaattttttttttttttgagatggactctcactcactctgttgcccaggctagagtgcaatggtgtgatctcgactcactgcaacctgcacctcctgggttcagttcaagccattctcctgcctctgcctcccaagtagctgggattacaggtgtccaccatcacgtctggctaatttttgtatttttagtagagatgagatttcatcatgtttgcaggctaggcttgaattcctgacctcaggtgatctgcctgcctcggcctcccagagtgctgggattacaggcgtgagccactgcacctggcctatgagaatattttctatttaaaaaattctggggctggatatgatggctcatgccgttcatcccatcactttgggaggctgaggtgggaagatcacttgaggccaggagtttgagactaacctgggcaacatagcaag

SEQ ID NO: 10528 - DNA, 1053 bp, Homo sapiens
atcccctcacctcagccccgaacctctccactgaagccaccccccaagggacaccaaggaagtggtcctgctctctactgaggaatgaaagagatggggagcattggccaggtgtggctgaacaggtgggtggggggcagggctgggactccaccctcaccggtgagtcccacttgacctttgacccccacctggggcctctcacgagcccgtggtaactcttggcaggggctctgtgctgttgtctcggtgactagccttgtgccctcctctgaccggcagggacaaggatgggtgaggaagtaacggactggagttgggcggggctgggggaggctggagaactttgctctgtcctggcaccacaggccaggccaggcgggtacctgggttgagggagtggggagcggtgctctctctctgatcttccctgggcaagccccgggcacatcaggcatggagggaggatgtgaggagtgagagggtggggcctggacacccatgctttctttcgtcatcgttcagaggactgatactgtggtgcatctggagtattgtgaaatggcccagaacccagatgccagggtgtctgaattcaaatcctgcttcttctaaaattatgggccttaggcgagttatttaacttctcggcatgtcccttttcttagtgggaaagtgaggataataagaatactttcttaccagattgttctgaggattaaactagaggatgcacgtgaagcatttaggactggtgaagttacaaagtaaatgctcaataaatgttggtgatcctcccctcatttgattagtcagagctcttcacaggaacttttgatcctcccaggggttttagcagggaaagaattgatggtgagagagggagtgtgggggtggggaagagacagcctttccacactccagattcctggattctaatacccctccagatccactgtttgctgccgccgcttccccatcgttggtgcctgctgacttcttgattgcaagtttgccaaatagccaggggcctggagaaggcccagggagctt

SEQ ID NO: 10529 - DNA, 1067 bp, Homo sapiens
aggaaccatttgggtttctttgctgtatccctaacacctggcaagggcctggtatagtgaaaatgcgtaacaaataattgttgaagtctaggcacggtggctcacacctgtaatcccaacactttgagaggctgacgtgggtggatcacttgacctcagggagggtacaagaccagcctgggcaacatggtgaaaccccatctctactaaaaatacaaaaattagcaggacgtgatggcacatgcctgtggtcccagctactcaggagactgaggcagcagaattgcttgaacctgggaggtggaggttgcagtgagccgggattgcgatcctgcctaaaaaaagaaaaataacaaaataattgataagtgaaaactaggtgcaagtataggagttgagagcaaagtgggcaaaggcagattttttcttagtaaacgctgtattgttttgtactttctttctgatctgctgcattttgggatccacttgcaacttaaacctgatgttggccaggtgtggtggctcacacctgtaatctagtactgttggaggccgaggcgagtggattgccagagctcaggagtttgagaccagcctgggccacatgatgaaacttcgtctttagtaaaatacaaaaattagccagatacggtggtgcacgcctgcagtcccagctgcttgggaggctgaggcaggagaatcgcttgaacctgggaggcggaagttgcaatgggatgagattgctccattgcactccagcctgggcaacagggtgagactccatctcaaaaaacaaaaacaaagcaaaaaaatccctgatgttaacaagaatgtgcacagcgataaggctgtatacgaagtgcagatgatggggacaaattgaggccaaatcagatgaaagcagagcttgggactcaggacccctccttcctgggagctgaatagactcgggtggcaggaaagaggctctggctgccggatagctctgggtgggcccagagcaaatgacctgacctggtccccctcacccactcctgcagtggctatcacttagaaatcagcatcca

SEQ ID NO: 10530 - DNA, 2642 bp, Homo sapiens
ggaaaacagcgctatagtatgcgtcacaactagcgcagactccggcagtatttaggcggtgcggcttgggaactagaatccacttcctgtcttccgcctcaggctagagggcgagcgcttcgccgtgggacttcttctgcctggctccgccttttgccccggaagtactcacagcggacggtggtttttgggcccgtttctgagcagcgcttcctttttgtccgacatcttgacgaggctgcggtgtctgctgctattctccgagcttcgcaatggtaagcttcaggggtgtgaagtcgccggcgttcttgggtttgaggactcagtggggagagccttcggcgggagcgctccttggcctgccggcctcggttgcagggcgggcgcggttattgcttggcccatgtgctctggtggtggagtttgcgggggctgagggcgcagtattaggggactttggcgctatttgaggacctggttgcattcccgctgccctcctacagccgcctaaggacgacaagaagaagaaggacgctggaaagtcggccaagaaagacaaagacccagtgaacaaatccgggggcaaggccaaaaagaaggtagaaataagacctctctgaaagagactaggggtaactctctcgtaatcctctagtaataggtaacttgtatagtaagtggtttttcaggtgtagatttctagagtcaaaatgtgagagtttatcttcccgtcaccactcgttctttttcccattaggatcatgaaaatgggtctgttgtgcgaagtgtctgccgctgtgcctgctgtgttatttttaactgatctagtggggctcggcccctgtttgaaggccaaaaacgtgtcggtgttttttttttgtttttgttttagtaatgtgtaatttatccttgataacggtggaacagatttctctgacgcagattactcgagagggaaagggtgcttctgccagaaatactaacttgtttctgttttgttttggtgagcagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggtgaggggtgtatcctacatgtgtgtttttgtaggttaaattgtcttgaccatgttaagcatcttcagtggttttgctggaaaagcagaattaaaaaaaaaaagcgtggcttgaccattggctgttagtaatgtaattctgacgtcttactcctgatcctgagatgaattctcagggttcttagccacttttgtgccgtggaccctgtggcagtttagtgaagcccaaggatcttttatgtttcgagtaaatggatgcatagaattacagggacaaccgtttttgaaataattagattactattttgaaacaactttgaaaatgtttaaaacctttatggtaaatattttgttgatgtattaaattttaaaaccagaaatttagtacggtctactcagtagtatggtctgattaccataattccacaataataaggctcagctaactatagtgactgaacgtctataattctagcactttgggaggccaaggcgggtgaatcaacggaggtcaggagttaaagaccagcctggccaatatggtgaaaacctgctctactgaaagttagctggacgtgggggcacacgtctgtaatcccagctactcaggatgctgaggcatgaggatcccttgaacccaggagatggaggtggcagtgagccgagatgacaccactgcactccagccttagtgacagcaaaagactgtctcagaaagggggggggggtggaagataatggagccctaatttaaaggaaaagtaaggatagatgatcgttaaaaactaggattctcggttaccgaacgtcagattaagcaattctggagccaggtgcagtggtacccttgtatttctagctacttgggaggccaaagcaggaggatcatttgagccaaggagttttaagaccattctgggcacctctgagagaactctgtctttttgttttccttttctttaaatagagatgcggttttgccatgttgcccaggctggtctcctgggctcaagagatccacctgtccaaagtgctgggattacaggcatgagcctctgcacccggccaaaacaaaccttactagagtctcattctgttgcccaggttggagtgcggaggggcagtcttggctcaatgcaaccaccaattcctgggttcaggtggtcctcacctcagcttcccaagtagctggaattacaagcatgtgccaccatgcccagctaatttttgtatttttggtagagatggggtttcaccttgttggccaggctggtgtgcaactccttacctcaagctatctgcccgtctccacctcccaaagcagtgggattataagcatgagccaccgcgcccagccaaaaaccttactagtttctattgtagcatctgttaagcatctcatcgtgctattctctccccctaggacttatcaaactggtttcaaagca

SEQ ID NO: 10531 - DNA, 1991 bp, Homo sapiens
gctccgcgtgcgcctacgccttctgctccagttgctttcccaattgagcggaaaagccggggcatgttgccggggccctgggcgggacggttgtgccctgcagcccgaagcccgccggggcaccttcccgcccacgagctgcccagtccctctgcttgcggcccctgccaacgtcccacaggttggaaaccagaccctgcagcccccagctagcccgaaggaagcccagactgacgtcgcagggtaatggggacccagaggtagctctgtggggccccatcaggacctcagcccttagcggggctttctgtgtgacaccgtgggacctgaactggggaggtcccccttgcacagaattacaaggggcaactgtaggaaacaattaaatctattatgtgctaagtattgagagttccacggattgaggccctctctagaaggcttagaagtggggtagccggggtatgtgtctgactttgtgttttggtgcggtggtggtgagtgggtgtagaaactaatagtgccaagtgcagtgcctgtcaactagtaagttaataaaccttccgtgaatgaatgagaaggttctgtgactgagggagcagggctagagagggcatctctgctcatcccacccctgcctcccctgggctcaggcagacaaaagtaattaggttgaacctttaatcaaagctggtttcacaggcaagcagacatgatagaggaggtaaaggcagaaatcctggggacacagggtgctggcctggctcacaggcatgcctccttccgggacctcctccaccccctacagtttggcgctcagtaatctcttgttttcttgtctccctcaggacactgggtccccttggagcctccccaggcttaatgattgtccagaaggcggctataaagggagcctgggaggctgggtggaggagggagcagaaaaaacccaactcagcagatctgggaactgtgagagcggcaagcaggaactgtggtcagaggctgtgcgtcttggctggtagggcctgctcttttctaccatggcagcccagggctatggctattatcgcactgtgatcttctcagccatgtttgggggctacagcctgtattacttcaatcgcaagaccttctcctttgtcatgccatcattggtggaagagatccctttggacaaggatgatttgggtgagccctgaaacagcagggtggtggacctggggacacagaaccagccagacacactgggtgtttgtgtacaggcatgtggtgtgggtggattgtctgcacagtagaggccaggggccagtctgcatatgccagataaagaagctctgagatccatggacatgggtgcctgcggggctaaggagggctgcttatttgacgtgtgtgtgcatgccctggaggcactgtttattccgagagtgtttgaggggcttctgagcatggttttcacacctgtgtgggtgcatgtggaggcttcagggtgagtgctggctactgacactgtgagcactgggaactaaaaagttggcacaacgacttcatgtggcctggcatgctacccttcaggagggacaaggtccctgactccaatcctgagccctttgccccatgttgggtggtggagcaacagaactgctagaggcccgggactggcatccagagtgaggtgggaaatcccatatgcaaatcccagggagggggaactgccacgtcctgctccctttttgttccctgacaactgtagctgagaatcatgggtcagtctggggctagtgccgatggtgaggcaggagaagtggccgaagtagtagggccccatgagtgtcagattgcagcacaggctcctcctgttcctctgggaagtaacctgtctcaccccactgggcacccctgcacacctgaccccatgccttctttcattgctcctgtgtttctcccctggtccctaacccctaagtgtaatgttccctgcagggttc

SEQ ID NO: 10532 - DNA, 1076 bp, Homo sapiens
tggttcctctgtttcacctgcggtgattcctttgctcccccaaactcccaacagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattccccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatc

SEQ ID NO: 10533 - DNA, 1884 bp, Homo sapiens
gttctgataacagtaagcagcagagccagaaatagatctcaggttgactccacattcaatgctcttcctattagccacagggaggagggttcaaatagtggcccagtcacatgaagctatcttccccccgcagactcaatatcaagacaggcaaactggagatgagctattccaagttcaagaccaagagcctctctttcttgggcacctttattttaaaggtaacagggtaacaaggaggtaaggccctaggctgccatcctgaccttgaggaatggggaacctagtcctacatcagatccaaggggaacttgaaagcattaaatagatccacattcctaaagcataggtattagctgaggttctcttcacctctggtccctccaggtggcagagagcctccagctggtgacagtacaccagagtgagactgaagatggtgaattcactgaatgtaacaacatgaccctcatcaacttgctacttaaagtccttgggcccatacatgagagaaacctcacattgctcctgctgctgctgcaggtgaggatgggaatcgagtttatacctccgtgtctccctttctgcgtgattcttactccagtccatttctccttgcagatcctgggcagtgccatcaccttctccattcgatatcagctcgttcgactcttctatgatgtctgagtcccttgatcattgtcctttacctcacagtctctaggattcctgactcaggctgacctctctctctggtcccagactgcctccttgcccaggcctctctcactcttcatactcctccagattttgttctcagcattttcctttctctgtgatcattggcatcctgggcgtttcttgccctctgctgactactgattggattttacctatggctttctgcaacttgctactctctccctctccatcccatctttgcagcctcatagggtgggatacagcagctttttttgcagttatccacactcacatttcagagtcctgactctcaaggaaccactggtttttgggatagaacttgggccagggctaggaacacaggctccacggtgacatgtcatttgattgtaaattaagtgttctgattagtaagaactaagcagggggccacatgctctcaatggagacaataaagtgttgtctttttcttattgtttatgtaggtatatttcctatatgggcatttttgggtagattgggaggggtggtgggggtacttcctccaacaggatgcctatctctctgccccatcagaccccgtctaacaagaagtgaacagaactgagaccaaacagaacatattgaataaatatttaaatcctgatactagaggtggcatggagggccacaaaattgaagttatcctgtttcctggcatgggaacaaactttcaaagagtcaccgggtgcagtggctcatgcctgtaatcccagcactttaggaggctgaggcaggaggattgcctgagcccaggaattcaagacagcctgggcaacaaaacgagactccgtctctacaaaaataaaataattagccaagtgtggtggagcacttgtagtaccagctacgagggaggtttagcagggaggattccttgaacccaggagttcgaggctgcagtgagctgagatcacactactgcactccagcctgggtgacagagccagtgacacccggtctattaaaaaaagaaagaaagaaaaaaaagaaaacttttaaggggtctaatttcttcacttttccattctccctttgtcaggtaggagaagggagtagggagtgactggacctggaaaggagggctgcagtagctataatattgacccctttcctttaaaaatcctacgccggcacagattt

SEQ ID NO: 10534 - DNA, 1035 bp, Homo sapiens
ggagcaggcttgagtcatggacctgcccgagcctcccccagtttgtggccctgataggtgccctccttgccatctgctgcatgatcttcctgggctttgcggatgatgtactgaatctgcgctggcgccataagctgctgctacctacagctgcctcactacctctcctcatggtctatttcaccaactttggcaacacgaccattgtggtgcccaagcccttccgcccgatacttggcctgcatctggacttgggtaggtagtcctaccactgctgcccctatggcacctacttcagggaacccttcctggtgctccacattctcctccaagtgttccttttttgtctctgtgtcttcccagatcctttctggtagcccttcatcctatcgtccgtcctcaccacttttctaaaaattcttaaatcctcctcccctaggtggcactacttcttttcctaccatctctccccgcaggaatcctgtactatgtctacatggggctgctggcagtgttctgtaccaatgccatcaatatcctagcaggaattaacggcctagaggctggccagtcactagtcatttctgcttccatcattgtcttcaacctggtagagttggaaggtaggtgggattgggggtggggagagagaagtctgagtgttaaaggtgtggcctgatatatgactttgggaaattcaggggaaaaaagcaatatgcatagtaattatagaagataagggaagctacttactttgcaaataacaatgcagatttattaaaagtgagaaagaaaaatagtagccctgtcatttatagctggattggcactaatagctaggccatgatcttctcccattgaatataaacagtttcacagaaccccaacgttacacagggtcattctgtgaccgtgatggagcaagactaaaactagacccctccctctgtaatcatgtttgagcacaggcaaaaccacaagaacactgagcaacccacaaaatggccaagatcccctctctcggctaacatgagc

SEQ ID NO: 10535 - DNA, 1077 bp, Homo sapiens
tcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagatacgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaatcatacattgctttttattcatcatgggtaccacaggaacctgggggcctgtgaaactacaaccaaaaggcacacaaaaccgtttccagttggcagcagagatcaggggttacctctgcttctgagcaaatggctcaagttctaccagagcagacagtcaccctacttttcagcagcaaaactgccctgatgacgcagcacgaagggcctggcaggctgttagcaggagctatgtccccttcctatgctttcctgccacttggaactgccctccagacagcagctcaggctcaccgccatgaggaagggggccttggcatttggtcctacggcaactcgagtattgcctcccaaccccctgaatgagcaagaactcaagtctgctacaacaaaagaaactttatttaaaaatatttt

SEQ ID NO: 10536 - DNA, 1015 bp, Homo sapiens
atgtggatatacacagatataaagtaaaaggagatagatccttcaagattatcctgagcggaaggatcatgggatgttgtcactttcttctcatgatttttcagtgttgcctagagtgtttttataacaagtaattaatatttttacaatcggaataaaaacaataatgactgctataaaagacaaggccagagcacagggaactgtgtgggtggggggaggctgtgcctgacactgaccacttgctgccatcctcctggccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatgggtaagctgccctgggccccctccctgttcatccagaggcctgtgacctcggggcgtggccatcctcaggatgcctcaatgaccccagacatcccccttgggtgggcatgctgccatcattctaggcatgaggcttccagtcccttctagccaggccaccccacaattcactagggattaggggcaggggcttatctctagacagtggggaacgtgattcttcaggttgaagcccacaaggcactgtgctggcagcagcatcagacaccacggtaaggaaaggagccacctgcgctgcttgccttagacatgctgggactccaggaggcctaagctcgatgacagggatatgactagtagggcagggaggacataacgttagacatgatgaacttcctgca

SEQ ID NO: 10537 - DNA, 1029 bp, Homo sapiens
ttgtgtacacagtttgcgctgtaatgataatctgtgctggtttatgtgtttctttacaagtgtttttatgtcctctgtgtgtgtatgaggaaggtttatggtgtgtgtgcgtgtatgaggtcacgtgctgtgtgtgtgtgcgtgcgtgcgtgcgcgcgcgtgtgcacgcgcctgcttctgattagactctgatcgccatcttctcccacacacaggtagggggccctcacccccctcctggggttgggggcacagcctggctactaagggtgggtggagaaggagggggagccaatcaaagatgatgactgtccgggcaaggtctacactgccccccagccgccagttagagaaccggcgaaggtcagtcttagatcattgttttgtctacagggtcacaaacaactagtttgactatttttccccaagaaattgactgaacccagtggttattttggagtcaaatgatctcagtcttttatgacttacctgtgtcagcgggtgtatctgtgtcttctctaaacaagttcccctagctgtacaatgggatgagatgataagaggctggaaggggcgaataacatatgtggtgtgcttagcacaagcaataatttgcttgatccagggaaagccttcgcaccgctggactgttgtgagctaccactgggagggactcccagtctggagaaggagggtccgttccctggggctggggaagccaggcccaggaaccctcctggctgtgtgtgccccagaacgctgtggggagcccctctgctgggctcctgtgacttctccagggtggtcaatgcaagcagagtatgtcttagtctcaggcccctgggctactggagatccgcccccccaacccagatgatcacctgggcaggtgcctcctgtgctcccttctgaaaggaaagcaagggtttcactcaaggtgcagaattctggctgccccaagcgcccagtgccagtccctgtaggaatcccactgccctggatgtgttgtgggagaggcagacaggttca

SEQ ID NO: 10538 - DNA, 5230 bp, Homo sapiens
cggggccgtccggagagcgggggcgagcttgaaagttccagaacgctgcggtgagtgcgttatcgtgaggcggagcgcggtggggtgggtgcggaagggggcgaggcccgaggagtggagccgggcttgtgattgggtcttgtaagggcagccgggcgtctattggccggggaagccgtaatggcaggcagcaggggcgggccccttctggaaggttctaagatagggtataagaggcagggtggcgggcggaaaccggtctcattgaactcgcctgcagctcttgggttttttgtggcttccttcgttattggagccaggcctacaccccaggtaaaacctctgctcaagagttgggttgtgggtctgggagcgtgcagcctccacacaggcctgttgggcttgctgaggcttgggggttctgagaatctcgtcgaggcgagtgtgcggctccttctaccggcttaaagggcctcagttttcggtgggatggcagcggtatttggttgcagccggcaggacggaaatgtagggagtgggccgcagtggccccaggggaggctgggagacgcccggcggccgcgtggcgggggagggttgctgcatcggtttgcctggcgcgcggggaagtggagccagcgttttctttcacccagttccctgcttagtccagtcccaccgtggttcttcagagctgttcttggcgtgcttccagtatgggggtacattccggagtagttaaaagcccgttgactcccgggggcactggcacctggcgagggaggggaacagacagtgctcagttcggggtaagaccacgtgttgagcaacgccccacgccgtctgggtagatgggtccttcatctagggcgtgctctgctgcggttggcacggcaacctggactgcagcactagttctggacctcgcgcgtgcttagacaggaggtgatgggcactattacctcttggcagtggccatacgtttttcctggttaagtgttctgttaagggatgagggaaatattttgattaattgaatttttaaaccagatttttctttttttcagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttggtgagttcctaattttaaatgacagaacaaatataacagggctaggaagcacaaaagtttatgaaacgtgaggagggaactttttgattttagaaaaactgagctgagagacttgttatcaagtctgttataaaacaggttgtagaaacctttcaggctgaaatctggataacgtaggaggttgaagtttgaacctttgctacctatatggtagttgaattcacctacctatgaactgttaggtatttgagtaatcatggacttgagttttatcagaagagctatgaaattgaaagtgttttcatttgacaccttttacagatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaaggtgaggttggtttttcagtatggggtgcattccggagtagttaaaagcccgatgactcccgggggcactggcacctggcgagggaggggaacagatggggctcagctcagggttaagaccacgtgcccaacagtgccctaggctctctaggtagatgggtctgtcaacaccagaaaccagtgaatcttgacaattacacagtaatttacattttggtggggggggtgctccagctgttctttcaccagcattaatccatttgctggagtttgcatatatgtaagtataatagttaccaatctgtggtcttttccttattcctagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggtatgtaccatttgtgatgcaagttcggattattttaagattaatttgatccatcgtaaatttaaatgagattgtttttaacggcaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcaggtaacaatggtatctcaattaaccctaaaggcaggcaggcccaaggtgactcgctgtgatgagtgattgttaaacattcgtagtttccaccaaaagcttggctaatgatggcaacaccttccttggatgtctgagcgagtgatagttaaaacaggagctatgtactgggttttcttttaacttcttttaacgttaactttttgtttgctagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtatgtttctgtacttctcttgtttggcttactgataacagataaagggaagtcttgactgactcgctatgatgatggattccaaaaccattcgtagtttccaccagaaagtcttatgttggccagttccttccttggatgtttgagcgaccattcttccttagcaggaccctagcactgtcacagacctggagtccattgtagtaatttgttttatttcctaccaaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggtaaggaggcactgtcatctggtcttgacagggataatggtatttcaattgagttactggtgcctaagggcgtctagctaagagaaactagagttacacatacacaggtaatttaaggcttttacttagagttaatttctttcctaggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcaggtttgtgttttttttttttttttttcctcccccactcaatggaggggaaggggatggtaaaccaagcttgagctggatttcagtgtagggtcacaatgatgaatggtccaaaacattcgcggtttccaccagaattcaaggtgttggcaactaccttccttggatgtctgagtgacccaagatgttaaggaagaataaggccctattttaatgttggtagtggccctcttgtaagagtttgcgccagacttttagtatcagattgcgtcagggagaaagaagggttattaacattaaaagaacttgcagtaattcctttttctcttcctcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaattgctttgagtctttaaataatctcccaggccagctggtgggagaagtaggcttaggtgattatgtgactcttactttctccttcctcttaagcttgagttaacaagggctgggtggcaagttgcccttcagagcattgtggatggtacattttggaattcagagctttgagaaggggagcataagaaattggatctggatcaaactaaccttagtccttaggctggagaggcagaaagctgacttaatggtgttttctaaacttattctgtgtgtaagcctgcctaggagcagaggctttcctggagggttgtgctagatg

SEQ ID NO: 10539 - DNA, 1042 bp, Homo sapiens
aggtttctaactttatggattacttttcctgtctcaaaactttaaataaacagaatcattccattttgtctggtttctttaattccccattatatttttgagactcatcattgttgttgcttatagctagagtatgtcatttttcattgttttatagtatttcattatataactatacaattattcattttatttcagatgcaaaattgcattccattttatccagtaatatttctgtgaatttatcttttagagacatgccccaagtgtccaaatacatatggaaaataatgatttttttttctttttttttgagacagagtttcactcttgttgcacaggctggagtgcaatggtgcgatctcggctcactgcaacctccgcctcccaggttcaagcacttctcctgcctcagcttcctgaggagctaggattacaggcctgcacaccacacccagctgatttttgcatttttagtagagacggggtcttaccatgttggccaggctggtctcgaactcctggcatcaagtgatccacctgcctcaccttcccgaagtgctgagattacaggcgtgagccacagcactgagatatattattttccattgtgaaaaattgaaagtgacctaaatttccattaacagacaatccatctagattatgtgtcctggagctggggcagtggggaaaacagcatcctctatttgaaattactcaggtaaaataactccattcctttgagaccttaaataaaaatatccaaagtccaatttctttaaaaaatgaaattttggctgggcatgtggctcacacctgtaaccccaacactttgatggaggtgggcggatcacttgaggtcaggagtttgagaccagcctgaccaacatgagaaatcccatctctactaaaaatacaaaattagccaggagtggtggcgcatgcctgtaatcccagctactcaggaagttgaggcaggagaatcacttgaacccgggaggcagaggttgcggtaagccaagatcgcaccattgcattccag

SEQ ID NO: 10540 - DNA, 1031 bp, Homo sapiens
agggtacaacaaggtttaccacaatgtgagggactcagccattgcaaattgtacagatgaggtaagttacaggtttacatttttttttcccagtaaatttggcacagatttaaaatgtgaaacagttctataccccttgtttttgctgttctctcaccagcaaaccctttagtttggccagcaatggctttctgcatgaacttcagatttacttcatttgctaggtggtggttctcaaacttactataagcacctgaagggctagttaaacgcatattgctggggcccacccctagagtttctggtaataggtctgtgctggggcttgagaatttgtacttctaacaaggctcaggtactgatgctgcagatctgggttcttcactttgagaacaactaccttttggccaaatgtgatatatgtattgcagtaggttgaggttcagaatacctttgtttgagtacttctgtgttggaaactagtaatctgatcttttatagataatcacttaggtctgaatattttgttcgcaaaattaagaaagcgtacttaaaacaactgaatgctatatgccaaatttgaggtgaaatattgataagttcttccccttgattttcttaattctcttgataggggcttcacgttttgatcaaaatattacacctgtattctgggcttttgctgtgaattcctagtattgctaaaattctgcaatttcttaactacctgttaagttcctcaaggtcagagcttctgctttttttatctttctttgcccagcaccttgaatagtgtgggacacgtaattgacgctcagtagatatttgtgtattgaactccatcccttgtcctcctcccctcttgatgtttttctctactggccttatgctacacagtaaagcagggcatgattatgccacttgattacccccaagagattggaataaatgcttatgccaaattcctacagctatccctgtgaatggtttattacccaggagccctgacactggctgatttctgaattttc

SEQ ID NO: 10541 - DNA, 1044 bp, Homo sapiens
tcagactgagagcaaaatcgctatcatatctgcctctctcccaggcagagagagctatttccttgttatgagaacaagcattttgagtaactgaaaaaacatgaagacagataaaaggaaactatcactaaggttacagttttctcccttggaaaagattctccttagggaaggtttggaagagataatagtgttcagaccagcatattggtcttgatgctgtatcttctctgtgcctctcaatcttatcctacttttgaaagtcttagaaaacaacagaagaatgacctctgcccacccttctcacctcgacccacctagcagctgcagtttgtatccatcaacctttctctggctctttttctttaaccatttctctgaacagaaaacttaggccatggatatttcaagtacatgtcagcagtgtgctggctctttggacgtcacctttatgacactctgcagtatcccatcgggctgatcgcctccagctggggcgggacacccattgaagcctggtcatctggacggtcactgaaagcctgtggggtccctaaacaagggtaagacagcattctccagtctgagaaagagcctaccagggaattatgcaagagagagggtcatcgtcctctgtggggagttaagtatatggtgaatgtcccaatatgtgttgaatgtatgtaatttattcatgtagagggaaagcattattttcactgtcactgccaccacaatcgtttgagaacatgtaaaaaaaaagtatcttttcccccagtaatagtaatagctagtggttactgaaagctttttatatgccagacactgtgctaagcactttatatatataaattatgaatatattgaatatatattattatatattaatatattgaagtgtagatattaaagaccatgggtgaagacactacatttcagagagacttagtaacttgctcatgagcatgactagtaagtggcaagtctggcttcagtgtctgtgcacctaaccattgtgctgtattgcctagaagaataaacaat

SEQ ID NO: 10542 - DNA, 1035 bp, Homo sapiens
agtagcaagatctgttagtgtcttttgataaattgtaaaatgtgtcacctgacttttcttccatatctgtaaccattagatactgctagtttccttattcacaattacataagccaagtgaagtattaagctcaatttggtggttccaaagagagtaagagtctttgctgtggtttcctaccatgtctatcgccagagattggtggctttgcttatgcttgtgtcacttcctgatatgtgtggcacctttcttgaaaggaatgttagttttattccctgacttccgaaataaccgtcagcaacagagccaactgggcccttgtgtgtgctgaatgcttttctccagggagtcagtaagtagtgagcagtggcatggtttccttctccatttatggccttggaagggtgaaagggacatggttgggactctccatttacggtccttggaggagttgaaaagagtggttggggtgttcttggaggcagaaactagacattgtgagataaaaataaattggcaagggatgtttggaattcaaattccaatccctgcaaggagggcagagggcgctgggaaagggggagtgtgtagaaagtcaaatgagctctgccgcaggcatttgtctccttccattggaaggtttgcccatgacacacatttgccaagttcatatttctggtttgttctagaaagttttgtcttatgtaattgtgactatcttttacaaagaggaagaagaaacacttttaaaaagagtgtatcgttggaaacctcagttctctaaggcatcatttgaggctccagaagagatctcaagaaagggagaatgaggcagatgcttgtgcagggggtaggccggctggctttagggtgggagactcttaattgttgctctgtttttgtgtgaggaagatcatcacacatgtcgtgcttttattattccttttacccatctagatttctggcttcaagggacaaatttttaaagtatctgatagagtgtcttgtagattgtcaactgtgatttaaagata

SEQ ID NO: 10543 - DNA, 1089 bp, Homo sapiens
gagtcttctgcccagagaacaaaatgattaattttctggggacattgcttagatttattcatcagtaattgtcatcatctttggaacaaattttgtactctaacaggaaaatcaccatatagtatatttggtctttcattttagctctgaagccttgcaattatttataagaaccaacagggcaaagataactaacttggagcaaaaagctctcattgtccctgataagcattttaatagactctgcccatctctgaggacttctctttggcgtttgcagacaagacatttcttctatcttctcattgaaagatttctaagaaatatgataagctactcaaataggtttagatttatttcctgttattttttatatatttagtctctgttgttaccatcccaatgttacctgaaatcttgtgccttccagtttgcttatctgcttatgaatttgacagatgcttgatgtgtatcctctaagaatagaccatctttgactaccaatcatacacttatatttaagatttcagttttagaaggaaaggagctaagaagcacatgttaaaactgaatgagtagaattctgggtttattttctggcattttggaaatacagtgaagggtggagttaaatattctggttacttcattaagaggacatgttaaaggaaaaaataatttagaaagcatgtagtacaaatagtactgttccataaaattttgtgatgatggaaatattctctatctacctcagttcagtatgatagccactggtcacatgtgtctgttcagcccttaaaatgtgtggcattgtgcctgagaaacagaaattttaaattatatttaattaattcagttttaagttataaataggcatatgtgagtagtggctaccatattgaacagtttcaggtaaaaagttgttattcacagtattaaattcatctttgtaaaaggattctcctggccacacactcaaacctctagggggagctcaaagttccttcttgacctttctgtcactttacccctgtgtaggaggaatcttgataaaagtaaaaaaaaaaaatggcctgccattccaggagg

SEQ ID NO: 10544 - DNA, 1089 bp, Homo sapiens
cgccttgggacgactggcctttgtgtcagtcgctttgcttctatcttgagctacgaaggacgagtaagactagagatgctttggagaattggaaaggcttgattgtagccagattgtgtattgttaccgcggagttagtgtacaccataaaagttagcttggccaagagttggtctggaatttggattgtcgatgcctccagagttagattggcttgaggccctgcggtttcttaggaagctccttcaggaaagccagtttttccctgcttcagtttctgtgccggatgtggtgacaagtagaactctcagtgtgcatctggccgtccttgtgtacctgcatgtttaaatgcagaggcttaatttgggctagaaatcttagccaggttaagattttgctactagaactgactctaggctttcatatttgtattattggcagataaggagttgtattttagttaagctcatttcctcatcgtagtggctgctaaaaagattgtgataggattctcccagtttttactgaactacttatcctattatctgtgcacttcttttctgatacagctggcactttttctgggaacttcttgaggggggataaaaaccaccaagaacaattataaaataagaatgatcacactaaagagcaataataaagtctaataggcgcaatcatgagttagagtaagctaaaggagggaaattgcaccaaagttctccaggtcttggctccagtagtatttctttggggatgttgttgcttagaaaactgggtccacaaactaagatatttaaaacctactattgttcaaggaatttgccacccattaattactccattacaaatttaaattagtgtatttgataacatttatctttgggacttcttaagctttctctttttttaacaaagacattaaagtagtagctaataggacaaagctactcttctctgaatctcatttgttctattcaacgtcattaaggttaaattttaatttttatttatttatatttagagagaggatctccctctcttgcccaacctgaagaactcctgggctcaaacaatcctccccagtag

SEQ ID NO: 10545 - DNA, 1031 bp, Homo sapiens
acagaaactttagtatcaactctatttcatggttgttgcagttgaagtgtttctggtttattttttgctcaatgtgtaaagaaacctgctgtgattattttacagatgagaaacaggcagagaggacaagggatttaaaaagtttcacagttaattagaagtggggctccaacttgacatcaggattcctgacatctcatttctcaaatagttgaaagatcacttttgactttcaagtaactccttatttttacattggttaatactgtttcttagctgtttgtacctgacattttcttaacacatatccaaaaaggtaaaagtttcattaaaggattctaatgatcattttagtatgaataacaaacattcaatcataattcctttgcttaaacctttaagtatctggctgttacatagaaatgaatttccagatgtgagaatcagaactgtatggaaacgaatctagaaaagtgttgattatcctcatagaagcataagaactcaggattggaagagattttatagttcataaagttcaacctttaatctctagttccatcccaatacttggaaataagtctagggttccacatgtcaaaataacaatttttgttacatttagcaaacatgtgctaggcatttttctaagtgtgttgtaagtattatgtcttcttcatatcggccctatgaagtaggtactcttaatatccccacttcacagatggggaacaggcacgggctggtaggcgtaaacaggagtcaggatccaaagtcaggcagtttggctctagagtctaagagcctgactactgtctgttatagagcgttgctccataggataaactcgaaggaaaaggagggacaagggcaggcaatgcaaatccacttgacagaaataccaaggaaaagtagctgagtctggtggaaaaaccagaatcttaggaattgagcaggagtctggggaaaagcgtgaacaggcacgcaggcctcagagatagcttcacccattagcccagggtttctggcag

SEQ ID NO: 10546 - DNA, 1049 bp, Homo sapiens
tttaaatggatttttatcatctctctcagaatccttctctggagttctttaccatggctttaccatgcatggctggtctcagacccatgggatcttgacaatgacattgaccttttctgtcccattactccttctcacagctttcctctcaaccttcattttgatgttttaagtgatagtcatgaaaatagctaacattctttaagggatttccgtgtgccaggtcctgtgccaaacactttgtttgcactgtctcatttaaacctcaggacagccctaagtagtatgacataggtaccattattatccccattttataggtaagaacactgagtctgtcagaggttaaggtaacttgcccaaggtcacatagcaagaggcagaacagggattcaagctgaggtccgtcttcaaaatcttcagtgttgagaacttaacagaatattcagggcagtcccagagagctcatgggttagcattttgacactagacaacaacagtacacaagattatatgtgtaacttttgaactaaaattgacactgtaggattaactatggcaagaggaaggaaattaaactccaagggaaatagtactttaccacacacacttaaggaattatttccatggacacaagtttgttgtcagtatttggaaaacactctggaggtgtgggtaccacatgtgtgagccaggggcaaattcacacctcacttatctttttttttttttttttttttgagacagtctcgctctgtcggccaggctggagtgcagtggcatgatctcggcacactgcaacctccgtctcccggactcaagcaattctcctgcctcagcctcccgagtagctgagattataggcatgtgccaccacacccagctaatttttgtatttttggtagagatagggtttcaccatgttggccaggctggtctcaaactgctgacctcaggtgatccactcgcctcagcctcccaaagtgctgggattacagacgtgagccaccgcacccagctgctttccttgtcttttaagggggagagtg

SEQ ID NO: 10547 - DNA, 1002 bp, Homo sapiens
ggagagatggtgtgattgacagtggagtggcgggggggcggggagtgcagctcggaccgctgctacccaaccgaactgaggtcggtccaaaggctgacaggcaccgaccaatcggagggcgtaacgaagggtgacgagccaacccaccgcgctcggcgttgccgggagccgcgctaggcgtaagctaatgaggaagaagttggccgttgaaagagcaacgctgattagtgaatcttaaatcacctaaatgaaagcccacttgtgattcgccctaagtaaaccagagccccgtgggctggaacgcgccggaatctgaggtgtgagtagagcctgggggagagtggatccaggtgaagggggcagaggtgaggaaagcggggcggctgcggggaagggagaaaagtggagggtcgggctgaggtggttggaagaaggcgtgggcggacggcggtgcacggacctcgcagaccacccttaccgctgatctggacccaaggcccggctaataaatacttaattggaggcagagaaggaaggactgttttgtttcatgctcttaagaaaaggaagtgtcagtgcctgattcagatctcttatgaccgagaccttaatccctctctagctcctgggaggtggccaggtgcacattctgaagacgagacatggggggcattgttttcctgtcgccagtttgaatctgcaacagggttggggagaagcttagagttcaagtggggtgttcccaggctgcagtgctgtgagatccagagagcggatagaccgaggctctgcagcgcttccaacccacaacaccgtccaggagagggatgcaaggaagagacctaggtttactgatcctcctttttctatcaacgtgttaagagcagatgctacatcggtggcattttgggagcttggcaactgattttttccccaggcttgcattttatctaattacaaaggtagaggcgttattctaatattttaaaattcaaaagatag

SEQ ID NO: 10548 - DNA, 1045 bp, Homo sapiens
tcctttaggactatgtaaaaggcaggtttttgttccttctttttttttttttttttttgagacggagtctcgctgtcgcccaggctggagtgcagtggcgcaatctcggctcactgcaggccccgccccctggggttcacgccattctcctgcctcagcctcccgagtagctgggactacaggcgcccgccacctcgcccggctaattttttgtatttttagtagagacggggtttcgccgtgttagccaggatggtctcgatctcctgacctcgtgatccgcccgcctcagcctcccaaagtgctgggattacaggcgtgagccaccgcgcccggcttgttccttcttttgagctctcatcatagcccaggttcaagatcatcttaggcaagtatttcatgaaataatgttcaagttcatgaatttccaaaattctttaattggtaagtgtaatgcccagcaacttaaaaaacacacactgaagcacagcaactcatattgataggtaaaaaaagttacaggacacaaagggcccttactaatttgacaaaatagaaagaccaggtctgttgttctttctctgatatgatttatcttgcaattgctggatttgagtggcaatttggaagtatcatctgataccaatgtgatatatagctaggaaagaccaatgataggtgaagtccttaccataaaatgtttcgaagagcttctcaagacagttgtttctatttaaaagggaagatataaagagctaggttatctcaaacaatcctgtgaaagaagtttaaaaagatttaagaaggagaaagagggaagggaagcttcctgggtatgacaccatttgcaaggtcacaacgaacaccccaacggagtgcagaccttttcttctctgttggtactagataattgtttgggacatatatatgctgaggtttggattggggttctgctcgacaaagcatctgctctcggacaccccagcgtaattcctttctatgatcttcaccaggtaaacgtattgagtcccagtcccgtttgtac

SEQ ID NO: 10549 - DNA, 1011 bp, Homo sapiens
tgaatgtatcttaaaacgtgtgcccttttatattatttatgccttaaatgttttcttccccattccttcctccccctcggtaggaaacaaccttgttttgcatagtattcagtcacctggagggcagaggggtccttccatgttttctaacagctatagtgacagcaagagctcctcatgcaaaggatcccatctcttggctgcttcggctaggagggaatgcaggggcccgttgaaggttgccaccagctgggttttcaggtggaaaatggtctttcaatagtgtattctcagacttttttttgtttgttttttgagatggagtcttgctgtcatccaggctggagtgcaatggctcgatcttggctcactgcaacctccgcctcccaggttcaagcaattctcccgcctcagcctcctgagtagctgggactacaggcacctgccaccacgtccagctaattgtcttgtatttttattagagacaaggtttcaggctggttttgaactcctgacctcaagtgatccacccgcctccgcctcccaaagtgcgaggattacaggcgtgagccaccacgtctggcctgtattatcagacttcctgagaacactttgaaatcaactgcagttgtgacccatgtttataataacagacctggctgacggattttacaagagtgccttccacagaagtggtaatgtgacctgttgactttgtatctgcacgtgggcacgagtgatgttcagtttgctaggcactagtcatagtgttatggacgtggtggagtgtaaggtcttgatgaattacggcagtatgcagaaaaggaaccaaggccagagagacaaataatgcctcatgtcccactgctttaaaattacattaatttataaaatggccactatgggctctttttgactgtttctcggagtaggaacaaaataagacattaaatggtggcttgaagagaaagatacacattttcagaagaaagaaaggggagggctgcaggg

SEQ ID NO: 10550 - DNA, 1076 bp, Homo sapiens
gtttgctccaggagattgaagtgtaagtcagacaactttgaagcagacagataatagaaggaccttacagatcacagaatcaatattgaactaggacagaaataactatcattaaaaaagcaaaaagtctgatgttctaatgtttatcatttttaaaaaacatttttgaggtcctattgtgtgtcattttctatgtgcttggtgctagccattatgacattagttagagtttaatgtgaattaggacttttacgactttccagacaatacaaatactttagaacatttttaactccatttccccctccagtgttttgtgttgttttcttcatatgtttgtattctaaaaatatttaaaatcctctaagatattaacattactgcttttgcaatccatatttattcagaattccctgcattctttttttgttgctactcattcctttctgtatttccttttttttttttaaatctgttgctagtcattttccttcaacttgaagaacttcccttaatatttcttacagtacaagactgaaggtgacagattttcccagctttgttgtctaagaatatctttaatttgtcttcctttttgaaggttttttctttttttttttaacctctaattgacttctagattggcagttactgtctttctgtactttaaagacattattctgttactttattgcttccatcatttctgttgaaaaatcatctgtacagctattgttgttccctttcaaggtaatacatctttttcttctggctgctttttttgattttgtctttgtattttgcttctacccatttaattattggcattgatcggtgtaattttctttgtattctgcctggggtccacagagcttcttggatctgcggcttgagctttcatcaggtttagaaaactcttagcttctgtgtctccagtgcggcttctgttgcattctctcctttccccctgcagagagactccagttaaatacagagtttttcgccatacggtgcctcctctgttccttcagctgctttcatattttccatcccttgtcgtgggaactgatgtgctt

SEQ ID NO: 10551 - DNA, 1045 bp, Homo sapiens
tgagaatactgtcaactgcaaggaacacgacaatctcctctcagtaggcttcaacagtgaggaaatgtgttatccccaaaataagcagcccagaagtaggtaactaactccaacgttgttagttcaggaggctgagacaggagaatcgcttgagcctggaaggtagaggttgcagtgagccaagatcgggccactgcactccagtctgggcgagagagtgagaccttgtctcaaaagaaaaaaaaattcatttttttctgtctttcctgttcgtcatgttcccattgccaccttggctctaagactagcactgctgatagctcgccacagttctgggcatcacctttaaagtgttatcatatctgaccgtgtctattttcaggaacaaggaaaatttcccccaacgtcctctactagatcttcccaccagtctcattagccacaattcagccccacacagcccctaaaccattgaccagatttatcccagagttctgtggggttgaggtagacacccaaacaaaattggagctctcgtaacatgataaagaaggctgttgagtgagctgggcagccatcagggtctctacaggtgatcttattattcctttttaaaaatgaggacatgaaaaagtacgtttttaaaaaatgaggaaatggaggctccaaaagattgaatgataagccaaggcttagttccagcttttaaactctaaaccatgtgtgtttctgctgcaatactcacatcttaagcccatatttaaacatatatccatatacctttagacttaccttgaatttcatttgtttagcatatatttgagtgcctttttggaccagacgctgtgatgtgttcatgggatacttggagtaaagttaaataaaaatgaaatttatcatctctgtccccaggacatttaagaatctagccagacaaaacataaaacattataactgttatttataatagtataatagtatagctgtgattacaatagtatacctcattttctgacatcagtagggaatgaaaaggttctaccta

SEQ ID NO: 10552 - DNA, 1053 bp, Homo sapiens
atattggtcctgttcagccaagtagatttaacttgcatgtgtggttttgttttgctttttttctccccctttaattaattcttaaatcagttgggggtatacttgagttcctaagaaacagtggagacagtctgaagagatgtttccacaagggattaagggtgcttgaagagttaatttaatctggcaaaagtgtccctgcttatgaaagattgtcacaggtccatggaagtcaacatgaagagtgatttctactggagtgttcagtttaggagtgtttctaaatgaaatgttggctgtgtgccacggataacagaatcattctgctagagatacttgtgtggtttggagatcttgactcaaaagaaaagcaggagtgggggtggtggccaagagtttcccagagtagattttgctttttggtgatcctcagcagtttattcaggcattcggtcatatgtcagttcacgttgcatccatgacagtggaattgggagctttgctaaggccattcttgtaactggtcagttgctctgggtagtgtaccttttgctggtcccaaatgtcctgttgctttttggtgggggaacatggattgacttgctgggttaagatagggatgaaaggacttgggctttctttcctatgcatgaaattaacatgtattttatgaaagactcccactaattatttttagtgaaacaagtattattgccaacacacagatatagttttaggtcagtttatctcctctctttacctttttttcatgccgtgtaatagaaatgctgtttatctgtggtgcattagtcaaatacttactattaagtacatttttattgcacaaactactggatggtagtggatgctgctccagcctcatcctgaaaacattaactaattatattgacattatcatttaggctgtatgatgtgtaaagccttttatttttccttttaggttcaaagcagtggcacatgattggccacctgcagccagaaacctcctatgacattaaaatgcaatgcttcaatgaaggaggagaaagtgaa

SEQ ID NO: 10553 - DNA, 1027 bp, Homo sapiens
tataatcagattcctgcctcccttcccaccctaccccacaaaattgaccattttcttgaaggaaaattatctacttttatacttatttacacatttttcctgttaaggtctgaggtttcaaccttatatgttctatatttgcagtggtcagatatgtgtagtgtaccttcagaaaactctcaaaagatttctttatatatattcctttctttctgaaggacaggaaatttacgtaggaaatgtttaggagcccacagctatgaaacaactctaccatttattgacagtcttacttggtgaaagttgagaagggaactaataaggaggtagctatcttggttttaatcattactcccacatttacgtgataggatgaagttgttttgcatcgtaggtactacaatgttcttcatttttcatatgtgaattacttttttaatagacggtggattcaagccagttataattacggcaccagtaagtgcaaaggttgcagacggagactttgttactctgtcctgcaatgccagtgggctgccggttccggtcattcgttggtatgacagccatggattgataaccagccatccatctcaagtcctgagatcgaaatcccgaaaatcacagttatcaagacctgagggcttgaacctggagcctgtgtacttcgtcctgtcccaagctggtgcaagctctctccatattcaggctgtgactcaggaacatgcggggaaatacatctgcgaagctgcaaatgaacatggtaccacacaggcagaagcatctctcatggttggtgagttgccattattatttatttttagttgagtaatttccttttataatagaagataaagtgatttgaaatatgttattttaatgaatccagcaatctctctatattttttcctgatgacagtgaaatgtagaactgtatttcttggtatttcactttatgtgaatcacatgaattttggtctctgtttctgatgtgtttgttaagattgtaggtgcaatacagaaagct

SEQ ID NO: 10554 - DNA, 1035 bp, Homo sapiens
ctctgttacccaggctggagtgcagtggctctccactgcttggctcatcacagcctgaacctcctgggctcaagcgatcctcccacctcagcctcctgagtagcttgccccagctgctttctgagatgaaaagatcatgcagccctctggactggggtcagctgccacaaaaggccgtgctgcagatgttgtttctaatttgtaaatttcctttgggaaaaagaattcaaatttgcatgtatttatttatctgtttccttatatatttcagttcttggtgattttggttcatccacaaagcatgttattacagcagaagaaaaaagtgctggtttcattggctgcagggtaccggagagtaaccccaaagctgaggtgcgctataaaatccggggaaaatggctggaacattccacaggtgagaccttttgtgaaaagccggtggcacacacagaacaaatgctcattaaataagctacttctaagctctgtgtgctagggacgaactgtggatacaagaaggcatgagtggagaggactaaaacaaatggttacaatatacaaataattacggccccataccctgaggcctcactccctcagttccttcagacccccatcagatttcacttccttggaaaagatagccctcatggtcctatctaaaataatatgcctggtgctctctggcccctttatttcgttttgcttttctttatagaattgatcacacctgatactgtgttattcatatttctgttagtttattattgtttgtcttttcctctgacctccccacatacccctactggaatgccggctgcatgcatgcagggtttttgtctgctcttttccttgccgtagcacttgtgcctggccattgttggcagaaagtagccccttaatatgtatttgtggaaaaaaaatgaatgactagacagtgcaggaacaccatgtgaccagtgctgtagctagaggtttgccaaagtcaaagcatgtttcttgtgctttgagattcactaccgttaacatgct

SEQ ID NO: 10555 - DNA, 1040 bp, Homo sapiens
ggaaatggtgcacacacactgcagacagaagattagtagaatctcactaattagtggaatctcacagaagatcaggagaatgcccactgtcctccccctcagttggcatctgaacacaaagcacaatgtttgaggtcatccaaacacagcaagcaattcacttttttctacgtgacgtggtgtaaagtctaaaaactgtggtattatataaattggtgtgtgcagctttgcctgaagctataatatcactttttagagtgttttctttagtttctgattggaaaagttgtactgaataaaacgaagctgtattttaaaaaaagtgaaataactttctaagagccattattgcaaaaagttgctatctgagccattcccatgttagacgagtctgtattttaattgcttccttacttgtcacatgtcctcacctggttgtaagcctcatgtgggcagacactgtgtctcttttattcatggttgagtttccaggatagctcagtgcctggtatatagtaagcatgcaccaagtatttactgaataaaagatgaattcctctgctttgaactctttcaatactttttactctcttattgcatttaagacttttttctttattctggagataattatgttcgtgcccttcttagttgagcagtttcctttagtttggtatatctttgcacccctcataggttcttgcccaaagtagatgttctatgtattaaatggtttgattgaatgaatacttacttgaaaagcagagttatttgagaagtttgtgtaggaaatgatgttaacttcttagttaaattaaatattcagaatgaagaaaactgacaggagatttaaagttgcctgtggttaaggtcaaggtagcccaatgggttaaaaaacagtatatactatatttgacttccataattgaaattggactgcactaatcttgatagtacttaatgaagaatttttaagtagacatgttttagtttttctttgtagttctgaaaataattttttcttagctgatcaatagcat

SEQ ID NO: 10556 - DNA, 1026 bp, Homo sapiens
gactttattacaagcaggactacagtgatgtgttttcagcactgaagtgaactccagtgtaagtacagaaagtggcttctctgctttccctccgaagcacaagcatatacacgttgcagacttggtaagttttctttgaatgatcttttgataaatatgtaaaattatcttactgtttggtcttgcctgtaaaggctgatgtatcgttttaataactttcaaactgagagcaaaatcagacttcatgtgaaacaaatggttttgcagtgatgaaatgcttgttttaataggcatattttagtttactattgatagaatttgattgtttctgttacattattattattatagaattctaatttagattatgtcttttctgttgtctttttaagaattgtatcatttctagtgtttctgaggcattactttgcagacttgctagcagcgccaagtaaatgaaaatctatctgccaaaaacattctgtaaaatctttggagcaaaatttttgagaaacattagtgtgtcttccttcccaagtcccttttcccctgcctcaaataatgtttgggcacaaactttttttcagaatattagcccagtttgtttcttgtgtacttttcaaggaagaccagttctgaatggtggatggtgtagttaattggttttcatctaccaagaatgtgaattccaatgctcctggttttcagctaatgcagaatgcagtagcatatttgatggttcatttgatatattttgtttccaagtaaagtcgtgttgtaaatagtgcacagtcttttccgtcctactcccatgtagccctctaccaagttctcctcacaatacagtgtgttcagaaaataaagaagcctttttgaagatatgtttagcttttttccaccttaatcctgggcatttctcctactactatggccagattgaaaggacccttgaatgaattggagtaaacactgcagtttgtgcctgtccgcattcacagctgtttagtcgctttgctgtgcggtata

SEQ ID NO: 10557 - DNA, 1074 bp, Homo sapiens
taactaggagtggaattgctgggtcgtatggcaactctgtttctagagctgccagactgttttccaaaggggttgcaccattttacattcccagcaacaatgtatgaggggtccagtttctcaccagcacttgttattacctatctttctgattacagccatcctagtggatgtgaagtggtttctcaccgtggttttgatttgcatttcactagtggctaatgatactgagcatcttttcatgtgtttggtgactatacatcctaaagaaatatctatgcaaatcttttgcccatttttaaattcagttatttgcttttattattaatttgtaggagttctttatatatcctggattccacttttttgtttgtttgagacagagtttcgctcttgttgcctgggctagagtgcagtggcgtgatctcggctcactgcaaccaccgcctcctgggttcaagtgattctcctgcctcagcctccccagtagctgggtttacaggcatgcaccaccatgttcagccaatttttgtatttttagtagagatggggtttcgccatgcaggctggtctcaaactcctgacttcaagtgatccgcctgctttggcctcccaaagtgctgagattacaggcatgagccactgcgcccggcctggataccactgtcttattagaggtattgtctgcaaatattttttccctttgtgttgtcttttcactttcttgattatattatttgtaataggaaagttgtcgattttgatgtccaatttttccttttgtcgcttgtgcttttggtgtcatatctaagaaaccatcacctaatacaaagtcttggagatttccttctgttttttttgtctaagagttttctagatttaggtctataatcttaaatcatttctgtgtgtggtataacgatggtgtccaattttgactgggtagccagccgtcctagcaccatttgttgaagtctgttctttcccaagtgtaatttttttgtaagttgtgatttttgatggttacactgggtcaaatatagacaatttcatagggtaaaatgtagttttatt

SEQ ID NO: 10558 - DNA, 1661 bp, Homo sapiens
ttccatcattgacctgaaagaggcataaatttacagacagattaaacagtcttctacctgtctgtgaggtcatgaggtcatgggagggagaacaccaacagaagtgatttggaatgagttattgagttgtggttgtggtacctatgacttctttctttctttttttagacggagtcttgctgtgtctcccaggctggagtgcagtggcataatcttggcccactgcaacctccacctcctggattcaagcgattctcatgcctcagcctcccaagtagctggaattacaggcacgcgccaccacgcctggctgattttttttttgtatttttagtagagatggggtttcaccatgttggccaggctggtcttgaactcctgacctgaagtgatccacccgccttggcctcccaaagtattgggattacatgtgtgagccaccacgcctgtcccctgtgacttcttcgggtacagttccctcctgttttacctatgtggcaaatgagccaggaacggttctctgaatgttttattaggttcattcatccaattattcatttgttcatttaccatgcagtcagaatctacaatcttttattatttgaaaaaaaatacaaaactatattaccataattttattttaactgtacatatccatttttaaagactggaaagaccatgttattaatgtaatttttttctttttttaccccaaatattctacaattagcatgtatgactttagtagtaaaaaagataagcttgtgaaatctatcagctctcaggctaagcattacaccaagagaatcttgcacgatccttcaatcataagaaatcacatgttagtgcagaaggtccagcgtgaaatcctctaagtggccaaatctaggagttcttctctggcttggttggctaaagcagtgatctgtgtcacccccagggccatcactgtgcatgtccccatgccctcagcaggagtcgtggacatccccattgtggagaaggaggcgcaaggccagcagcaacaccacaaggtgagcgagcagcctccctgaggcatgggttgctgctcttccttgggaatcatatcttgatttctttggcttcagatgacattgtccccgagctaccgcatggacgatgggaaaatggtgaaagtgcggcgcagccggaatgcgcaagttgctgtaactcagtaccaggtgctcagcagcactctctcctccgccctcgtggagctccagcccatcactggtgagagtgtcacttttccgcagtgggatcacaaaaccctgtgccaccaggttttgtccagggcctcgttctgagcagctagtagtgtggctgacttgtgtgagaatgtgcttctggtgctgatctgaggccggggactcccagagagatggttgtggctagcagaagaatacaaacaggttgaatgcctctatttaaaactgtgtagagtggttcctcaaaacgattaaacagaattattgtaagatccagcagttccacttctgggtatataccccaaaaatcaaatatttgcacacatattcatagcagcgttattcacagcaacaaaatgtgaagataatcccagtgaccattgggggatgaatggagaaacaaaatgtagcatacacataaaatagaatgtt

SEQ ID NO: 10559 - DNA, 1091 bp, Homo sapiens
tagtgcactaaggaaccttactgcttctttgttatgtaatgcaacagtctaaagacatatttattttttgctaagatttagtgcaacagaaacagttatgcagacggattttgctgttttaaactttagcatctttcctcagcatatagatcaaaagaaatatgtagaacttggatatgtatgtcttgttaatgaaaacaacatgtgcaacagaaaagccttctcaaagtctcaagtgtgggcaaacaacagcaggagagtctagaacactgcaggacaccagaaaaactcatttccaacaaagaatagtaaatagttttcacaaatgagacttgttcatgtggtgatggcttttaaaagtctggttccatcaaagcatagccatggaagaagctgtgtaatttttcattacaggagaattctacttgaagccatctgattcagttaagaaatctggggatgatttgatttaggaaaactgctttatgtttattaaattacctgtatgttatttattttagaaacagcgtcttgctttattgctcagactgtagggcagtgatgcaatcatagctcactgcagactccaactcctgggctcaagtgatcctcctgcctcaacctcccaagcagctggactacaggtgtgtgccaccacacctggctaattttttgcagagacaggttctcactatgttgctcacactcatcttgaactcctggcctcaagtgatcctcccacctgggcctcccacagtgttgggattacaggacaaattacctgtacttttgccctcctaagatgcattcaggttgacaatgaaaatacttacataagttttcaggaaatattctgtgcacaacagccaagtttttttggaattagatggatgagtcacactagccatactctggagcctggcaatgtgaggttttgaaaaagcattcttcagtttagctgataccaaaaatgtttgtgttttgtgcggttactgggaatttgcctgcagccactaatcagctgaatctttaatcaccattttgctctttattgttagaatgtggaggtaaaatatcaagtgtatgatacc

SEQ ID NO: 10560 - DNA, 1085 bp, Homo sapiens
ttttgttgtttcgagcctaggtgaaataacagatgggaaaacacctttacaaaactaaatggtgtatagctgctagtaatctgattgtttacatgactacttcccttttggctcccatgtgtcttgctctctctctcatctttttcccccaacttggttatcttatttctggtggaatgccagagagaagtgccccaacatcctcttgtcctggggacagatttgagtttgggggaaatgtttggctctttcccaaaggttatccaaacccagggcccaaacctgggttttctggggatagtctgaacactgagacatactctttctccaggaacggggaggtaacaactccttcacccatgaggcactcacactcaagtataaactggacaaccagtttgagctggtgtttgtggtaagtggggtgttgtagagggacgattgcattgttaacatagccctgatttttaagagaactctgattaattgcagccagtgtatatgatgacgtaactgaaaaaactagaaaggtagatgggggaaaacagcagctactgggcccaggcagggagcttggctgcctctcaggacagggaaaccggccaggtagctgaacctatctctgaaagccagggttgagttggcgtccctccattctaggctagtatgtaagcagatctgttggctgtttcttcccctaaacaggttggttttcagaagatcctgacactgacatatgtagacaaattgatagatgacgtgcatcggctgtttcgggacaagtaccgcacagagatccaacagcaaagtgctttaagtttattaaatggcacttttgatttccaaaatgacttcctgcggctccttcggtgagagacctgccttctctaaaatcaatttatttccatgatttgatgacctctctgaaggtggttcaaaggtggtaaattgatgtgttcaaagacattcctaatttgctacccagttctcattgtcctcttgggtgtgagagtcctttctctggaccgttatttttccttctgcatggggtagaaagataaaccattctcctttttgtttagtga

SEQ ID NO: 10561 - DNA, 1051 bp, Homo sapiens
gcatcatttgatttgtaaatattctaaaggttaaaaattaacataatatgttaatctacttaatatatgtagattttaaagtttcagtttctcattttatgaaatgacttgcccttttggcaacgcatgctaattgggggaaattgcttttccattgcttggttaagaagaaatccagttgtccagcagtatatgccaccagaagtgcggtggtataagccctcatgagaaacatggaaacgttttaaagagaaaaataacagcacctttgacaggataattgagcaagatggcaggtaaattccagtaaccatacacactgcctacttcctggaatccaagacgccatgcaccttccctgttccttttcagttcttttgtagctggagctgtggaactgtcacatattcaaacacgtgttaatctttccaagacctggtaactgtcatcatatcttgagatgtggttgacaagtaggtaaggtaatgaacccaaatctccaactggaagctctactcactagctctgcctattctctgatttgctgtgtggtctaatacgcagtcgctttctttgtgctttgaaaaaattcataaagtagaatcataccaaaaatacccactttgtaagaactatgacttgatagaaaattagtaaagggaacgggctcagtggctcatgcctgtaatcccagcactttgggaggccgaggtgggcagatcatgtgagctcaggagttccagaccagcctgtcaaaaccccttctctactaaaaatacaaaatttagccgggtgtgctggtgctcccctgtaatcccagcactttgggaggccgaggtgggcagatcatgtgagctcaggagttcaagaccagcctggccgacaggtcgaaaccctgtctctactaaaaatacaaaaattagccaggcatggtgtcgcacacctgtaatcctagctacttgggtggctgaggctggataatcccttgaacctgggaggcagaggttgcagtgagccgagattgcaccactgtgctccagcctgggtgaca

SEQ ID NO: 10562 - DNA, 1088 bp, Homo sapiens
acagaactttctatagagctaagaaccctgaaggtccactagctcaatgaaggggccaacaattttttttttttttttttttttttggatacggagtctcactctgtcgcccaggctggagtacagtggcgcgatctcagctcactgcaacctccgctgcctggattcaagcgattctcatgcatcagcctcctgagtagctgggattacaggcacccaccaccacgcatagctaatttttttgtatttttagtagagacggagtttcgccacgttggtcaggctggtctcgaactcctgaccttgggtgatctgctcgccttggcctcccaaagtgctaggattataggcgtgagccaccatgcctggccaggccaactatttataaaaaagaaaaatgctgccctactaaaggagagaaggtgattaggaaacttgcctgcttcaaccgttgttccagagggaagaaggaaaaaacctcctaagaatttataaccacagatgattcttcatgcagacagacttcacattcatgattgtgtacatgatccaggacactcaaactgaaaaatctacttaaactggtcttgtagtctttattgactgtttgtaccaaattgactccaggagaaatggaaaatctaattagatctataactcttcaagacattgaaattacagctttaaattttacaataaagaatattctggccaggcatggtggctcacgcgtgtaatcccactgcactccggcctgggcaatagggcaagactccgtctcaaaaaaaccagaatattctaggctcaaatggtattacagatgagtctaccaaacattcaaggagcaattaattccaatcttaaattcttcaaataataattaaaaaaaggctgggtgcagtggctcatgcctgtaattccagcactttgggagcccgaggtgggtggatcatgaggtcaggagatcgagaccctcctggctaacacggtgaaaccctatcgctactaaaaatacaaaaaattatctgggtgtggtgacacgcacctgtagtcccagctacttgggaggctgaggcaggagaatcgct

SEQ ID NO: 10563 - DNA, 1218 bp, Homo sapiens
agccaggcgtggtggcgggcgcctgtagtcccagctacttgggaggctgaggcaggagaatggcgtgaacccgggaggcggagcttgcagttagctgagatcgcgccactgcactccagcctgggtgacagagcgagactccatctcaaaaaaaaaaaaaaaaaaaaaggactactttgtgtgtgtgtgtgtgtgtgtgtgtgatgcagaaagcattattaggagagacttaggatctgtcccccaggctggagtgcaatggcgcgatctcggctcactgcaacctctgcctccaggttcaagcgattctcctgcctcaacttcctgagtagctggtattacaggcggctgctaccactcccggctaattttttgtatttttagtagagtcagggtttcaccatgttggccaggctggtctcgaactcctgacctcgtgatccgcccgcctgggcctcccaaagagctggcattacaggcgtgagccaccgcaccctgccaaagtagctatgttttaacaaaaagagcccataattgagagccatgaagtcgggccccaacactgactagctgtgcaactttggaaaagtctcttaacctttccaggtctccattttccatgtgccagcggctattagttctaagcaagacaacgaggcctcttctttcataaaatgtatattcaaatggggtacatgaggtaaacaagataatgattaagaactgttttttgttttttgttttttgtttttttttgagacggagtctccctctgtcgcccaggctggagtgcagtggtgcgatctcggctcactgcaagctccacctcccaggttcacgccattctcctgcctcagcctcccaagtagctgggactacaggggcctaccaccacgcctggctaattttttgtatttttagtagagacggggtttcaccgtgttagccaggatggtctcaatttcctgacctcgtgatctgcccgcctcagcctcccaaagtgctgggattacaggcgtgagccaccgtgcccggccaagtactgttaataggacaaaactggacagtgtgaaagagcctggggataggagccccccccccccgcccttttttttctttctttgagacagagtctcactctgtcacccaggctggagtacagtggtgcaatcttggctcactgcaaccttcacctcccaggttcaagcgactcttctg

SEQ ID NO: 10564 - DNA, 1073 bp, Homo sapiens
tttaaggctgttggacttcagatcataatggtgtagagatagaaaatcgtataatttaccacccaaactgggatacctttgagagtgtaaaggggcactattaataattgcatcagaatgacagacattaactggggctctccccacagatgagggccacccgagttagacactaaatttggtcaatcgtactttctagaatatcttctctcaattgccaatttcagggtttagaccatctaagtaagctaataaggcacgattaagagtttgaagccctttaagtttagtatggttttcccccaaacatggattatattttaaatttgtttctcagtgtctgagaaacccaaatcaacctcagacaagttcacttcaagcatttgaaacctcttggtagctttgggtagctgtgataagccatttatttttgctttgcaaggttctgtggagaaactgtaaactctgcatgtagtgtgcacgcgcgcgtgtgtgtgtgtgtgtgtgtgacagagagataaaatgaactttgaagtagagggacgtgtcttcattacacaagtgaagacaattgcaatttttgttttgttttgtttaaatgtttatcgaagataagaaattttactttgggctgaaaaggggcaaaaaaaatgttgtgttttctttttgtaccattaaagtgggcaaaaacaaaagcaaaaataaaaaacaagccctcaattctttagaaggggaggaaaggaatggtggattcaattgcaaaattctttttgaattaaaaaaagacaagaataagaatgaggacaggaagagtaagaaagtatgaaagaatgaatgaaaggaaattgtaaaactaaagatgaacgaatttaagtgatattacatagattcttggaaaagctttcatctgggccaagcattacacctggttaggaattccaggctcaggtggccccatgggcagttttgggtctgttgtttctactccttgcctgtggtcatttctgaatactttaaatccctcatgggtagatgggtggtcaggacaactcagatgaagtcttccctgggtt

SEQ ID NO: 10565 - DNA, 1089 bp, Homo sapiens
attttattccaaatgctttacatgtataaactcatttaatcatttcagaaaaggtaccaggtagatactgttctccccattttatagatgagaaaactgaggtgcaggagggtgagtcaactgccccaaatctagtaagtggttgatctggagttgaacccaggctgagtggcccttgactcacactcagtgtctgagcaactccacaaaaatggaatgcttaaatgattcaagaaagaggagatagacaaatatcatggggtaagaaatgaaacagaaaaatccattgagaataagagaaaaacaaagtgaaagaaataggaaaggccaggcacggcggctcacgcctgtaatcccagaactgtgggaggccaaggcaggcggattacctggggtcaggagttcgagaacagcgtagcgaacatggtgaaactccatctctactaaaaatacaaaaaaaatgagctgggcgtggtggtgagttcctgtagtcccagctattcgggaggctaaggtatgagaatcgcagacagcagaggttggcagtgagccgagattgcgccactgaactccagcctgggtgacagagtgagactctgtctaaaaaaaagaaagaaagaaagaaatagaaaaatcagagtaaggagttgagaatgaaagaaggatttaaaaaagcaaaggacaaaaaggaaagacaaagtgaagtgtaagtggatgtgggcattagaacgaaagctgaggaggaggaaacaaagaacagatgagagacccagctgaagggaactgcatcttggcgcttgccatggggcactgctcatgcgctaacttatttgactttcccatggcatttcaaggtaggtgttattagacacattttacagaaagagaactgaaggtctgaaagactaatgtccaaggcgacacaattagttcatggcagagcaaaaagaactgctgacaattacaaaatgccaaagaaagaaactgaagaatagcaaataaatggagaaacatactgtattcatggattggaagactcaatatagtaaaaacgttgattctctctgaattcatatacagattcaatgc

SEQ ID NO: 10566 - DNA, 1029 bp, Homo sapiens
cctcaatattcagctgttgaatattggttttcctattgagagtcaagttgcaaatcattcttcattttgaggtgttagggccctatttttttttcttgccagcaataggaaaagttgcctgtttattccagatggccctagtaagccaaccgtcttttctgtgcctgcataccacactccagacctcagcaaagatacagcatctgctttggtaagcgtcctcagacctgaataagtgttcccatggaaactgctcagatgggatgaaagaaaagatacagccgcagctccactgggtcttctcagttttcaggactctgctttccatgccaactatttcatcaccaaacttatgttatactgacaaaaatatggtacctacctcttaaaatgtgtatcactgaggaatcagtaacacatacattcttggtggttgagattttagtcatttgtggttgtacaggaagaggcacattttaaagtaacactgactccccatccagtaaaaccttgggcatctggaaacaccagaaataagacattttagttggtcatgtttttcatacagttgacagtgtacctctgaaaaagtataaggtgtaattttattttagacccttgaatcaaaatacttccagaatgtatttccaaccacaaattttgtggccagtgtagtttcatcacttgtatcaatagattactgcaccatgcataacttagggatatcctcgggggcacactgagataaaagatctgcgtttataccaagtggtttaacaccagttctttttatatttttatacccctttttttcagtttcgtatgtctttgctgctgtcactttgtgttactgtctaagaactacctataaaccctcctcttcctttttctctttgtaattctaatctggggagcaaaagtagttctgaactggagtcctgaaaggttatcctgaatcgtgtggactttgtattgtctattttttgttactctgaggctcttgttttctcctagcaaagggcttggata

SEQ ID NO: 10567 - DNA, 1316 bp, Homo sapiens
tatagggaaaattgtttggaaaaataaggatatactgtcactatatgggttgattttgctctctgaactatgttgtttataaagttgtttagaaataagctgtgttggaagagtttgttcagaaagtcaggaatggacagtgacttgtttgacattggtttcacattaaggttagaagagattaatagtgtggtctcccagccaacagcatcagcatcacctggtgataattgctagaagtgcacattgtgcagtcgtccagtcacaccccagacccgctgaatcagaaaccctgggcgtgggacccagcaactggtcattcatctaactttccaggtgattctgatgtctgctaggacttgagaaccactgcagcagttcactctttcaatgtcccttccagctctgaaattctattactctaaagaaatgataataacatggtttctgtatcttctttactaggttatagtaggaagactaatgtatgtaaaagttatttttgatgtctctgctactcctttggctattacacatgaatgtaaggattttgattctctggattgggtagtactaatataactttagaatttgttcttcccgtattttagtatactcctctaacttcctttcacttcctgtgactaaaaacattctatcagcaaaaagttggaacatactcttactttgtcatcctgagtttgtctttagcatcttgattttatattctagttccataatttactcaaagatttatttatggagtagtagttaagagagtagatactgggatgtagattggcctgggttccaattctgactccatcatttaatagttttataatgttaaagaagttatttgaacttcttagtgtcataatttccttggctgcaaaatgagaataatagtacttacctcatgtggttgtatctgatttaaaggagatattacatataaggcaggtagcacagtgcctggcattcagtatatgtttgttattattcttaatccttgtcttctttgtttgcctttattctctactcacacctaaaatcattttctttaactctgtgttatttttggacacttaatatttcctattcccagatacgtcttattttcacttatttttcagtttgtgaggttggatccaaatatgaagatatatataaaaatgatctttgtgaaaatatttactagtactaaaatctgcatgtttactatccattttctgctttggctgcactgtgtagagtgtgctgtctggaaggtggatgtttgcttactgtttcacttatgcttctccagcctgttt

SEQ ID NO: 10568 - DNA, 1048 bp, Homo sapiens
ataaagatgctatgtattttgcatatcatttcgacacagaggttgcttctaatatcaattaaatccacaagaagtacccagcaattctacctgcccttcatctttactacataaccataaccttttcttgttactgaaagtcttgaatatttttagaggtagaaagcatgtagttgaaaatgtattcatatgaaaactaaggttccttccctgctaacttgaccagataatgaccatttcaggctctcagggcactggtaaattaattcacttgctaattttatacattgtgtcaggacggtgttcctgagttttaaatatacaaagatggacgatgcatggttttgctcttgaagagcccacagtcagaaaagggtaatagttgtatgaacaaataaatgataattttgaaatatttttctatgagcacatagaacacagtgctcagccacctctacttgtgggtattcaatgaaggctcgctaaagagtgatagtttacctggattttgaacaatagccaagaattttttctatacgaagagcgttatgggagagagtccagctagaggaaattgttttgtgaagaagtcatagcatggttggtttgtatggcaaaaggtaacacttcacttggcctagggttgtggaatatggaaatacaataataattaaatgtaaattatgaaaggccttctctgccaggcagtatattgcagtagtcaaaagcattggctctgactggataaagaaaaatgtggcacatatataccatggaatactatgcagccataaaaaaggatgagttcatgtcctttgcagggacatggatgaagttggaagccatcattctcagcaaactatcacaagaacagaaaaccaaacaccacatgttctcactcataagtgggagttgaacaatgagaacacatggaatagggaggggaacatcacacaccagggcctctcggggggttggggggctaggggagggataacattaggagaaatactcaatgtagatgatgggttgatgggtgcagcaaacc

SEQ ID NO: 10569 - DNA, 1053 bp, Homo sapiens
tgaggcaggagaattgcttgaacctgggagctggaggttgcagtgagccaagatcatgctattgcactccagtctgggcaacaagagcgagactccatctcaaaaaaaaaagaaaaaaaaatgaaagagagttttccaatttgtcctgccatgctcattagctttcaaatatcaattcaattttagttgtacttagaagtttcagttatgtttccattcttcataaggatgataggggaggacagaggctattatatcacttctttctgaaaaatagcaggttaaactacagtgttcatctgttccctaattatgataaaatctatttgagtggaacagagttttttggtatcattgattttttgtcattgatttttttgtagggacagtgtctctacaaaaaattttaaaaaattagctgggcatggtggcacgtgcatgtggttccagctccttgagaggttgaggtgggaggatctcatgagcccaggaggtccaggatacagtgagccatgatcacaccatagcactccagcctaggcaacagaatgagaccctatctccaaaaaaaaaaaagacttcatatgtattgtccatgacctataaccacagttatatcatatgtgtgtatatatttacacatacaaatatatatagagactattttaaagtctaaattaaaacaatgagaattgattatatattttaaactctaaaataattagaataaaatgaagaaaaaatgattatatattatatacataattgtgaggagagatgagacacatacagtatatataatattgatatatatcatatataattgttctttctcaaagtttagactttaatatagtgtctttaccctaaataaaattaaccttgcactagatttttctgagaaggaagctcgtatcaaaattacgttttatgtgcttgcttcgacagcacatatactaaaatttgaacaatacagagataagtgtgacccctgcacaaaaatgacacacaaattcgtgaagcattccatataaaataaaaattttttttaaa

SEQ ID NO: 10570 - DNA, 1046 bp, Homo sapiens
tcatcctttcttatgctaaatatgctgttctctgctttgcttttttgacttaatgtatcctgaagattactccctatcagtaggtagagatcctccttaaaaataaaaaaaaagccaaccaataatcctctgtgcagatgtaccataatttattcaaccaattccctattaatgctcttttgggtttctgataaacatatttggttatttttaaaggaacccagtgttttaaaatgttttgaaatgtttaaaattgtttatttgtaaactctctattctggcctatgctcccagcctttacataccccttgagcctcatttcataccactgtcccgtggctccctacccctctcatggcttccagctcagatatgacttcctcagagaaactgttccttaactctctgtttaatgcagtttctttcaagtcactaatacgtcaccctgtttatttttttattagccactataaataatctgatattactttgttgccttcatttaggcagtatcatttagtggataagagtttggactctgtgctaaatgccctgattcggaatcctggttatgtgacagtgggcacattaacttagcattctctgcctcagtttattcctctaaaaatgggtataaatattttcctaatagtgggctgtgagaaatgaatgattaataaatataaacacttaggtagttacttgcacatactaagtgtaaagtaaatgctggctatatccgtattactatttaatcattcattgtctgccatcagtaagctctgtgacagcaaggaccttgtctctcctgttccccatcgtaatctcatgacttagagcagttcctaggttatggcagacacttactcatttgttgctaaatgattaatagttaatattcactttccattcctttgaaacattcttagaaatatgttacttaaagaatgctttcttatatacatcatatgcagttaccaaatttgacaattattttcatcagattcagcatcaaaatataaatgcctactgttaacatgtatttt

SEQ ID NO: 10571 - DNA, 1069 bp, Homo sapiens
tcagtagttttaaagtagtattttcagtgtcaaatattaggaggttgaaggtagggtgggtggaccacataatattatacaacagaaatcatttttttgtgtctccacgtctgctacacaggctgtgaggtgaaagaaaacttgtttacaaaccccataggtatgacacatgaaattgcagccattatagaactacaaaagatgaataaaagaaaagaactctttccgtgttccatttgcaatccgttgattaggctttggtgaatggtttcttctgtgggtgggtggtatatttttaccctgctctatgctactgatttccattctccatatggagaaagaacttttctgaacatttgaagacttgctgaatagagttgtatttttaaagatcctaacaacactaattgtaattggtttccatggtgatagaaaagtgaactcaatacaggaaaaataactccaaagatagatttggaagaaatttagaaatgtgggatttggaaatcctgtttgccatttctaatagatgaaggactgaaatattattaaattgagaagtgaaaattatttaaatcactgagttgctgtcataaatttctacaggcaaatatagttcagtccttcatagtgtatagtctttgtacatgtagttcaggtactgcataaaatacattaatattcagacatgtatagggtgtattaaaacccacagttctcttaggatagttttattgaatatcttgtatgtgctagccacctatgtgagtaccactgatgaagcagataatctttcctcagagaaaacaagtaatataccaataagtttaagagaaaaacaatgttataaatgttataaaagtgcttgtaggtattcagtggtgagagagattatgtcctgtggcattcaaaagtcttcatctttattgaagattgaatagaatttggatatgcagagatagaagtgaagaaccctcagccaaggaaaaatagtacagacaaaggtgcttgtgttttcattgttcagctccctcttataagtgagaccatcaattgctttcttagtaag

SEQ ID NO: 10572 - DNA, 1057 bp, Homo sapiens
agagtaactaattgctgttgcaaatcttttcaaggttcaaattgtgttgaactgataaaaatcagtttttatataataaccatggaccataaaggttaactagctgtaaaccttattttatcttctggaataaaagcaggtgtttggtacattaggagagacctctgaaagccagagtagaaataaaggatcactgctattcagttaagctcttttagctaaacttcaaatctgacatgtagtttttctgctctttcaattgtgatcattggaaggctttcatagaattggaaattcttatcagaatctttcgtgttttgatctctaggaagatgaagtcctcagtacattctgaagaagatgattttgttccagagctacatagaaatgtacaccctcgagagcggcctgattgggaagaaactcttagcgcaatggtaaatcagttttatacaattgttcatatatacatatatatgtatatatagcacttatataaggaaaaggaactgaggacacattacacaaaaaattttgttgctttgttcatttattcaggaaatatttattgagtgaatactgtatacttggcactgtcgtagagtctgtgggcagagtaatagggttacagagtggtaaaaatacagtgtgaaaggataggtgctaattatatagggtagtcacagatggcctctgtgggaagatgaggtttgatcaaagacctgaaggaggtgagggagtgagtagtgtgtttatctggaaacacatcattttaggcaatggaagaacaagttacaggctgtggcataggattagagaacaagtcggaagaaacacaaataggatagtgtggctgaaactggatgagaaagaaatgaggtcagagaagtggtttgggtgggtggaaagcagatcgtgcagtttcttgtactttattgatgaagacttttgctttttatgcttagtgagatgggaaaccattggaggatttttggctgagcagtgacacaatctgacttaaaatgttaaagaagtctcaggttactgtgagtaggag

SEQ ID NO: 10573 - DNA, 1035 bp, Homo sapiens
ggcagaaaaggaaaaacataaatgttttaattctatcaagaaagaaaaactttacttagaaattgttatatgtaatgtactaggccatatatatgctttatacagtgtatcagttaactgcttatcactcctataaagcaggtatcatttttcctatttcctcggtgaggaatttatggctcagagagtcacacagcccacatttgtcatggtggagcaaaattttgcaagtggtagcacaaaaatttgaacccagatgtaactgactttgaaagtgaagactttaatgaaagatttttggggctatcttctgctaaatgctattttctgctaagtgataacttataagaggctacagctgatatctcaagttttgaaattccttttttttgaggaggttatgagcatcaatgacatatagattatgtgaccatcataaaaatgaagtaatgaacacaataatgtgacttttaaaaaatgtgacctctaggacacctaggaatcatgaaaggttctagttctttggcatttgaaggtagaaatgtttatcatatgattttgtttagacttccctaataccacgttatgggctgatagacagcctggcaaatatgacatataatttgaagcagctacagagatgatatagtgcttaattgaaccatatttttgatcacgatctgtagatgcccagatcgctgatcttcacgtatatctccattattaaggcaattcattttaagtgacgagaaagttctgactttagttaaactggatgatttggtgaacatattttaattgggggggacaatgcctttattgatttatagcattatagaactaatgatacttcatgcacttgactcgttggttggttgcattattcatcctctacctcaggggttcccaacccctggaccgtggaccagttatcttatttggaaggatgccacaagttagaagctattgtggcagtctaagtaggtagtaagggtcttgactgtggtattgtacatcttctaggctcaaaacagc

SEQ ID NO: 10574 - DNA, 1011 bp, Homo sapiens
taaagtagtaagttaaataaatgagaattttgtttccttttccagaagagttaaacattttagtagatccaaacctagattcaccaagtacttttcttttattgttatattataccttccattttttgaacatctatataggactttatcctgtttcatgtaattacttcaacaatatgactgggtatgattattctgttcagaagaggaaattgatcttcagagatttttggtgacttgtgcaagttcacataggtaataagtggcacagaaggaatttgaattgtctgagcccaaatttcttaaatttaaaaatccagcattatttctaaatggaaaccatggatactcaaggataatactgttgtttccaattgctgtgtatcttgtaacttgaatagtacctgtaatagtgaaaaagtaacttaatgaattgtatatcagtaagcaaagtcagaacagtgatgtaacttgaaaattctcagttgacacttaaaaacagccttattatttttcaagtaatgtttgaggcatcagaaaatgtactttgtattcattgttcattttgaaaatataacataaaaagccccagagatgataatattgatatctggttctagcaaaatcagaagaagtagacagatattaaattcctaatttatgcatcattcaaatttaaacataaatctgtgtatcttttaaagagctgcatatattaaacttctttttacttccctgttatattttattcttcaaatgattaactttatttttgcagtggataaaacttagcagaacaaatttcaataagaaaggataatgggaaaaatgcttctctgtttccagaaataaatgagcaggcaggaacttaaattctccttcctaggaaaataaaattgaagaattactgataccagaatagtagtacacttactttaaatcaaaataagataccccaaattaaagtttaaaagtacagcatttagcttctgttacttgaggataagatgt

SEQ ID NO: 10575 - DNA, 1018 bp, Homo sapiens
ataaaatgtattagaacctatggggactcagctaaaatctgaaagattgtcttttttttttttttttttttttttaaagacagtctcactctgtcgcccaggctggagtgcagtggcgcaatcttggctcactgcagcctctgcctcctgggttcaagcgattttcctgccttactcccaagtagctgggattacaggcaccagccaccatgctgggctaatttttgtatttttaggaaggtcaggatttcaccaggctgatctcgaactcctaacctcaagtaatacacctgcctgggcctcccaaagtgctgggattacaggagtgagccactgccaccggccttaaatatacatattaataaagaattagaataaatgaattacccatgtaactcaaggagagagaaaaagaatatcaaaatatatttttcaaagagaacagaggaggatttgaataaagactggtagtctgaatagtggcctgtcaaatatgtccgcatccgaatccctggaacctgtatgttactctgcatggtgtgtttgttgctgctgcaacaaattaccacagacttggcggctataagagtagaaacttactcttctggttttggagaccagaagtctgaaataaggtgtgggcagggttgtgctcgctccagaggctctaggtgagaattctttccttgccttttcttgtttctggtagctgctgacattcctgtcgttccaatttctgcctctgttttcacatcgctcttttctcctctgtgtccagaccccctctgcctctctctaacgagcatttagagactgcctgcataatccaggattatcttctcatctcaaaattcttcatttattcaagtctgcaaagactcttttttcaaataaggtagcatttataacttatagggattaggacatggaggtatttttgggagccatatcggtttgccacacatggcaaaagggactttgcagatgtgattaagctaatgattttgagatagggaga

SEQ ID NO: 10576 - DNA, 1023 bp, Homo sapiens
atactcagtcagaatctgcattttagtaagatccccatgtgatatctttttacattaaaagtttgcaaacaagaagtattgcactattagattgctgcaggatgaacagatttacaggaaaaattttgcataaaatcagttaccagagaggttgcacttaaagagtactaaaaagtaggttgtgaatgagaacagtgacaacaggttttcccaggtgtatttctgtttaaactcttggaaacgagggtaactatctttctcttctcccttttgctatatcagtttattccctggatataacctttctggaccatgcagaaatttatttcctgtgaattatttttacacttaattagggtgtaattctacttaaaatttgagaaaacttcctgtgtcttgtagtgtagcagggcatagcttttggcaattaaaacatcaaggttgaagttctccggcttttttacttagtagcgttgtgtccttgggaaagttgcttaacctgtctgaacctattgcttaacctgtctgaacttggacactgaagaaaaaacactaagataccagctttcatatacttgctggtaaaactggaccaagttaattatcacttggtctctttgagggttctgtaactcttaggttcacttgtcacgtttcttcttgatgagggaatatgctttagagtagcaaaagagaccagtactgcttaaaatatttgatcaatgctgaaggtaaatgaatgcttcagatgctgctgtttcttcatcctgttgctcagtaaactccaatagtagctatagttgtcaatatttcagaagtaattggtcccacagtgcctatctgcaggattctttgggtcctgcatattcacaatgtccctgagtaaagagggccagtgactcagtgaggtcttggaaggaaagagaagattcgagtgtccacaagtaacatactgtgggtacgtccaggaggagcagaaagaaagaagagggttggagcatagggtcccattgcctactattt

SEQ ID NO: 10577 - DNA, 1053 bp, Homo sapiens
agtggctagcaccataatttagctcataggttatgatagagtgcagaaatctgtcatcatattgcttaactggagtcactgggattgagtttatgatttcattagctgtattgtcttggtacctgataggggtaagatgggaaaaattagtacagtagttataataagaaaagtggttgactattaactttccagtatgtgttaaaatactgatttatcaaaaatttaaaataaaatcttaactggttgatagttggagaatttgttcatcatagtcctgtgaaaaattatttaggaagtttagctttgagtctcgatttatcagctactcttaagaaatacaataatttactggcagaagttctttaagctctttttgtgcatctgtcttaaatgcctaagacaactagggcctccaggagtgggttatctgggaggctagttccttagtggaggcagagatttggggtgaaggggactgtgactgtgaaggagaaagtttggctgtagggaaaatggtggatagagtgggagctcggagctggaagaagttaaaaagagggacgtggcaggcacatactgctgcagatagcaggctgcctttcagatcccagtctaaaggaaacgagaaggaatcagaacaccggggtctgcagccatcagatcgccttacctgatggaggagacaatctttaaatggctcacagattcagaaagttaaactcaaccacctggggttgatcaatgtatcttttactcagttttagttttggtttattttgattaaattctctcctctgatggttgaatttggtttagattttaatatgatagttgtttaatagagaaaaaacaaaccatagcacagcatagaacatatatttgacaaagtgctataaaattgccatataacattagtgaattgaatattccctttaaagaaatcttaacatgaaatgtattacattgctattttagacaaaaataagacttttttgaactgttcattttattgacatgttttatgaagggaaaagataaagaagactgaag

SEQ ID NO: 10578 - DNA, 1029 bp, Homo sapiens
ttttatagctctcttctttagattagtattatatttagttactacagtaatgtttgtgtgaaatgtgtgaaatggtcacctcaaactcatttatataaggttagattacataagacaggaaagtgtgcagtacattttagaaatattcctgttgtaaaacagttaaagttctggtgcttacatgtaaattcacttgtttttttatctaatgcctactttgtactgatcttaaggagtgttattttattgaaacctcccagtaactctagtagtagtactatcatagaagggaactgggcctcagaaattgtggtcacttgatcaggtttactcaactatgtgggggattgattcatactttaaatccaggtctttttgcccttcaagtgcctgtgttttcctcagtactactttgtaaataatgtgaagtgatttctgaacacttaactcgggttgagaaggggatgttttccacatttatattcttaacatttagagtaacagattctttgctattactcctgcacaggacaacctctctctcttctctcccaacagagaattaccatctggtcaagaatgtcagtagcgccaaggttgagaaaccctgctgtaagagttctgagtagtcaaggttttactttgagtgcgtttgtgtttgcagttttagctctttaccgtgatgataggtactagaatgcacgagagacatgaactacttgtgcctccatagtttatattcttaatttgtccacttccctcccagtttggaaacaggttgacagtgagtgtagagcaagatgtttatccatttgtattctgtgttgtttctagagaatcagggattttatgttagagactttctgaatggtgaaggttaggctttttaggttttcatgctgatttttatgataactttcaataggaaaaggttgtgagacatgggcagttaagctggctttcatgtactggcttgctaacccacctactcttatgaagagttgtgttgattgattagagcacagattt

SEQ ID NO: 10579 - DNA, 1051 bp, Homo sapiens
acagctaaggtggaagcccagtttactgtatgatcgttcacattgaggtgggtgacagggtgaagtagtgggggagaaaaacataagtgggacagagaggaaatgttagttggaagaaccttctccagttatgtaactgttttgttttctagggagagactaagaaccagcaagacaggctcaactgtcttctttagagcctttgatgttggtttgaattccagtagttatgttccttctgtgttcatttcctaacctccgtatcattttccagtcaccaaaagcttttctgaagttggcctgcgacactaatggcaatacattcatctctactttctctctctctcggtgctatataaacgatgtttttattgttgcttgttctctcttgacttattcaagtgttttccttcccaagctgacctgagtatattatctgcacactgtatgttgatcgtagacgcatgtaataaatgttaaggactaggcatctgttttcttcataaggctgtggtagcagaagaatgaaacaaaaaggaacttaacatagttgaacttttaaagagtaagactaatattcttgagaatttttcggatttaacccatgattgtgaagtccaatgtccatggaagtagtcaggaggcagcaaggacttgaagttaggttgtggttgcagttctgccccatagtagctgtgtgacagcgtaccttccttggacaagttatttacatttctgagcttgtttgcattttataaaatagggatcagaaggcttgcattgtttttcttacagagctgtgaaggatcagatgatagaaaggatatgaaaatgctctgcagaactgtttttaaatatgtaaagtattgtcattacgtataaacttagttactaacctatgttacctggtaaattggcctagcaaactcttttaaatgttgtaacagaaatttaaaaaacatgcatataaaggctgggcagggtggcttacacctctaatcaaatgctttggcaggcagaggtgggaggatcccttgaggccaggagtttg

SEQ ID NO: 10580 - DNA, 1048 bp, Homo sapiens
gggctccaactctcagtagagccagtaaccagcttcctgatttaaaaaaaaatcacctttggcctaattttgtcacttataaacagtggtattgcagtaccctggtatgattagttatgatatgtttaacaataattttaaaataccaaagcttgtgaattattttactttcaaaaaatatgtaagttagaattgtaattctaaaggcactgtcgtttgcttacacattctaacatatttctaataagaaagtacctgctttcttaagagaaaaagggataagttaccaaaagcagcacgttctcctgggctcataccccggattcatccatgaggccacttccattgtaaagcttttagcatctcttgatttctcttgacactgaggcacaaaggcctgctacttataggcattacttcatttttccttatgaagggtactataccaacacagactttatagtatgtttaaaaatcccaactgcaagatacacaggatgctgtaggcctgatttcctgttgtagaacctccagccctgtgttgaatgaggaggtgcaaatatatagacccttaagatcagaccacagcaggcattcaggtggaggggatgaactccattcattccagctgtgcagtgggacatctgcgccctccgcatctcggctcattcctcatctgagccactcaagagggcggtctggtaagtgtcatctgaattcagcttctgaattccaatgatttctccccttccgtgtctcttcatccgagtcaaaaggctttaatagagaaagagtaagagccaattagccagagattcccttaatccattaccaaggatgtgaaggcatctactgattcttaaactattttctttatatttctatcaaatactgtgattacatgtctataaactagacttcttaggaaatattcatcagtagataaaggggcgatggtggaaactactgaatgtcataattgaggccaaggtcttgcctatcttggtttactgtttcagtggctgggcaggagaactaaaagaaactg

SEQ ID NO: 10581 - DNA, 1035 bp, Homo sapiens
gccaggattggttgttttttagggtgggaagtattatagcatgtttgcattctgatggccgtagtccagtagaagggagaagatagatcatgccacagagagacgaagtccctgagtaaggttaaaaggcttgcatctgttacacatgagggaattggccttaggaggtgggaagccgggctcagttgtacacctgtagtcccagctactcaggagactgaggcaggaggaaatttaagcccaggagttcgaggctgcagtgagctctgattgtaccactgcattccagcctagtgacatagcaagaccccgtctcaaaaagtccttttctaggttattgatgtatacagagatactgatcagtaaaataatagatcttggatttactttaatatattctaattcctccctcccccaccacagtggggagggatagctaaaacaaagtattaatttttgaagctgggtgaaagggtataagggtttgttatactgttctctacttctgtgaatgtttgcaaaataaaaagttaaaaaaaaaatacaaaacatctacccatgaaacggaagtttgtctagttgtattttgtaaccggtttactattgtgaatccctcatcagtgctgcttctccccattcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcaaagtgactcctgacctcaagccaacagaag

SEQ ID NO: 10582 - DNA, 1049 bp, Homo sapiens
ctgccacagccagccctgtgagtaagccagccacgagttctcctgggacctctgctcccagtgcctccacggctgccgtcattcaaaatgtcacaggacagaacatcatcaagcaggtaggtggggctctttccacgtggatctcaatccttcatcctggagcagggaccactggagctggaggttcttggccagactgcatgcccatgggaagaagatttgtcatcttcgactctcagcttatagatacttaggtgtgagttcccaccaaaggcaaaggcagtgcagctttgatagatgctgaagagatttcttctgtttcattccgtttaattcagcattcagtagtcgagtttctggatttagaatagactgttcatgagtttatttagtgaaattcccatggccacattttattggcttctcagtttaccactcgtgaaagtagaatttgcttctactttcttggttgtgaatataaaagaataatcatcgaacttcaaagaatcgtaagcagtatagcaactaatactgataggagtgcctcctgtgtgcctgcaccgcgttaagcattttttgcttgttaaatagtctaatcttcttagctctgtggggtaggcactcttattatttacaggtggagaaatggaaccacataacgataaagtaatgttttttttttgttcaacaaacattaagccagagagtgtcctaagtattggagatttaatggtacattaaacagactaagtccttgccctcgcggaactcgtattctcatagagctaagagacgagtacctcagtatgagatagtaataaatgctatgctaatcagtaggcaggctcaggggtggagagcagtagtgtgttattttagctgcagtgattggagaaggcctctctggggaggtgacatttgaaagagatgaaagaaagcgtgccatgaagtgatgattgggagataaaacattcgaggcccaggaatggcaagtgcagatgttttgtgtcaggaatatgattgaggaacgagaggaaaatcattgtggc

SEQ ID NO: 10583 - DNA, 1079 bp, Homo sapiens
gcagttgatagtctgttctatgccagttctgttaagaaggttttattctgagcatcaggttgcttctgcaatttttttttggtgctattttgaagttttgttaaactcacatgctatgtgctgtctcacccgcttcacttatttaggcataggcatgatgaggatgtcatttcaccatgtgctgaagggtgatgagggggcacagttgcttggggaccacccacgtgacttgactcaacgcttaagtttctgctatatctttacatggatctgaaatctcttcaagggagcttgaaataatttagtggaacatgcttcattttacatatagttattctagaactgttctttatcattggagaattttggaaaagaaaagtacctgtattacgtaattcacactgtcactcatctagagattattcattgcaggattccagaattggaaataacgggagggaggacctggtccagcttcccttcctcaaataaggaaattgacacctggcgtggtaagatttgtggaatgtggtgtttgtggaatgtggaatatggaattctggtgttttgactgttaacatccttttttcttttcattttagtatgctttttagcccactttgtaggaataggagctggaaaggatggatttagtaaatgttggtagagtgattgagtttaagctccctgtggtcctgttagcattgtgcagtcctgtgctatcaacttgacccctaatcccagccatcagtctgaaaatgttgtggtatgtagttttctgaaggtgatcagcagtgttctgttattacacgaaggagaaaagtagcattaatttacatgattatacggatcaaatggaccaactaaaggcagattggccattgactttactggtggttatggtcaggtgtgtggaacctcaggaatttatatggactaataaagtcatatcagtaaggttcgtttttattatttaaatgttgcgaggttatacaagaggtattgtgtgtagcattaagcacatgggtttgcaggcaggtagacctgagtttcagtactgcctctggggttgggcaagt

SEQ ID NO: 10584 - DNA, 1058 bp, Homo sapiens
cttattggaaaactgaaaagaatcactgaatggaatgttcattttatggcagttgttttaagttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcattgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgtgaagctacaagagctatttttttttctttgaagaattgcaacttttggtttccagcgtggcatacaggaagcttggaagttgtccctccatcctagcaataagtaagaagctgagcaaatggaaagatcaacatctctccttagatccatcagaaagttgagcccacaggacaaactgctgtccccaaaattggaaagacaaacaggcaaatacagagaatcatagcttattgaacagaaacccgtgagaaaaaaatccacgatcaataacctct

SEQ ID NO: 10585 - DNA, 1032 bp, Homo sapiens
acaactgtctcacaagctttctgcccaggtctggaatcagccattttcccaagaaactctcattccttttagtagaaaatgttatttagagaccatcaacaagatgctagggtgggctttatttttaatttgctctaataacactggtggtgaaataaaattcaagttggattaaattataattgccaagtgtggatacatttgtgtcacaaattcaaatctgaatataaaagataaaaatattgatttaaaaggtaactctttgtgacgtatttcaaggttttaaaaattgttgagtatttgtctttgtggatattgagaagccacatttgaaggggaatgcactgattgtctctgacactgggtatctgcgtaccaggctcttctcaattcgtagcagagatgctttcacggcaccaagaaatcacatcattgtgagactctcatggcaagcaaatcagtgcggactgtggctactggttatgtttttgtttctaagacttgtgttaaaatctgagaccactgaactatgaatatttcctgttttttagcatctgagattcaaatgatgacgcttcctccgggtcagtttgtgattacagacagtggtgtggcaactccagttactactggccaggtgaaggcggttacttcggtaagctacgctactcggtcgggtttttcctgtccaacctgtggtgctgtatagtaactcttatcaccacttatctcgtaatgattggcttactctgttttctcacagtagatgatgaattctttgaaagctaggtcttgggcattatcactttatcctcagtgccctgtccaggaggctaggatatagcaaatgctcaataaatatctgttcaattaataactgtaatggtcctatctccatccctatgagccttttttttttttttttttttctgagacagagtcttgctgtgtcgccaggctggagtgcagtggtgcaatctcagctcacctgcaacctccgtctcctgggttcaagtgattctcctgcctcag

SEQ ID NO: 10586 - DNA, 1025 bp, Homo sapiens
ccccgttttcaaaaatactctccaaatagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtcagtgcccagtggctgcgggttcctctgtcttcccagcatacctcattgctgtcgatgatggtgacgtttgtgttgcattgtgtcctaagttatatcgatcaatggttttgtcaatgtccaggggaagaaacagaggcaaacgattcccaatttggagttctgtcttttctagtctccctttgctctctcttgctgctttttggatcaattcttgtaagaggtctttttctttttctttttttttttttaatcacttttcattactacttttgtttttctttacccatctcaatctctgctctcaccttattttagttccctcttttgtgtccctgaatgtatttttttaatggggtatttgccttctccccagctgttcccttttattttatttatttatttttgagacagaatttcgctcctgttgcccaggctggagtgaaatggcgtgatctcagctcactgcaacctccccctcccaggttcaagcgattctcctgcttcagcctcctgagtagctgggattacaggtgcccaccaccatgcctggctaatttttgtatttttagtagacacggggtttcaccattttggcaaggctggtctcaaactcctgacctcaggtgatccacctgcctcagcctcccagaatgctgggattacaggcgtgagccactgcacccagcccccagctgtttccttttaatgcctctcttttccagatatcaaacagcagtagaaggaagctttccgtcaaagcagggtatgtgcatccaggttagctgaagcatcagacagccagtgctctgctct

SEQ ID NO: 10587 - DNA, 2025 bp, Homo sapiens
accagttcttcattccttttttgtttttttgacggagtttcactctttcgcccaggccagactgcagtggcgctatctcggctcactgcaagctccgcctcctgggttcaggccattctcctgcctcagtctcccgagtagctggaactacaggcacctgccactgcgcccagttaattttttgtgttttttagtagagacgaggtttcaccgtgttagccaggatggtcttgatctcctgacctcgtgatctgcctgcctcggcctcccaaagggctgggattacaggcgtgagccaccacacccggcgtcttcattcctttttatggtcaaataatattccattatatggatataccatattttcttcacttatcagttgatgagtatttggatcgtttccattttttagctattatgaataatgccactgtgagcattcatgtacaagtcttttagggacatatgcttttatttctcttgggtttattacatcttgatgaggaattgctcagtcatttggtgtgtctatgtttagtcttctgtggaattgccgggctgttttccatattggcagcagtgttttacattctcaccagtagtgtatgagggttccagtttctcctcatccttacccacagtggttattatctgttgccatatcagaattttgaatgaaattgaaaagatgaaaaggcactacaaaaataagcataatagaaaccagagtatcattaataaaggcagttttgtgtggtttgttgacatggcaggaaagctgttgcctttattgtttgaagctctccaaacaataaaggatatagatcaatattttgctgaaattgaggccaataaaagtattattctgaagctacaatatgctgtaatttttcttagctggacaaaccttccctattagtggagagtttataatctgtgtgatttgaatttcaggtatattttgactgcacaatagcagacaagaacttgaggtgcttattttcatttggctattcttattccttttaaccctgggaatgaacatgaattgatagggagaattaataagtatatattaataaatacaaaaaccacaacaatgagcactgttgagtgttcctatgggccaggtgtgggttttcatttgcacagtgtacttcatttatttcatagttctaccttagggaattggaactattggtcctgctgtaaccatgttatagatgaagtcttgatgccttgaaaagtaacttccctcacctgggtcatggagctggagctggcagttgaggagtctcaatccaggcccccgaccctagagatctgttgccctccacgcaaagtcatgcagcagacttggtgcagtggctcacgcactttgggagacctaggcaggtggatcgcttgagcccaggagttcgagaccagcctggccaacatggcaaaatcccgtttctactaaaaatacaaaaaaattagccggccatggtgctgcacgcctgtagtcccagctactcgtgtttctgaggttcaattgcttgaacctgggaggcagagtttgaaagtgagccaagactgtgtcactgcactccagcctgggcgacagagtgagaccctgtctcgaaaaaaaacccaaagcaaacgaaattcacacaacagcgttagaggtggggaggagcaagtctggtcagtagcaggctgctagaaggtcatgttaaggccccagctatgacataaggacttgccacagcctgctactcaagggagcactatgtgtgatttccaaccattcttgttgccatcctaagccacaaggacttgccacagcctgctacacaagggagcactatgtgtgatttccaaccattcttgttgccatcctaagcctctgccccctccattaactaatacaggttggaggcacagggcgaggaggagatctacattctggttgcagaaccacacaccccagactctgccacaccaccatgagcctgctgttaatccaccacgagcccaacacct

SEQ ID NO: 10588 - DNA, 1027 bp, Homo sapiens
tagggactagctatcattcctttaactaattattgctctttgtttgactttttaactgtcctctctgagacacttgtttacgtttagtcttcaacacagaatattgacagaaccgtgtccaattttgcaaaggagagaaagtaggtagaggtcagggaattatgcaagtatgggagaggggtcagagcgcatgggagaaaagggtctgtatcctcagccccaggcaggggatgtatattaataaggtttcagtctcttccatcatgtattcatcttctccttcattctttttctcttgaagttgatgaattgaaaattattccggactgtgtaagtactttatcactggataaatataaggacccatgaatggtaatatttggacaccactttatgtgacatgcaagttctctcaagtactttagtactgtggaagtgtgagatgttacattactacaaaacagtaattctggaattaaaatgaaattatgtcatagtaattggactttgatgaactttgtttcatttatacattttaagaaagtttatgttggccaggcgcagtggctcacgcctgtaatcccagcactttgggaggccgaggcaggcggatcacgaggtcaggagatcaagacaatcctggctaacgcggtgaagccctgtctctactaaaaatacaaaaaaaattagccgggcatggtggtgggcacctgtggtcccagctactcgggaggatgaggcaggagaatggcatgaacccaggaggcggagattgcagtgagctgagattgtgccactgtactccagcctgggcgtcagagcgaggctctgtctcaaaaaaaagagaaagaaaaaaagaaattttatgttaactttttaatattttttaatttttttagagacagtgtctcactgtgttgccaaggctggtctctaactcctgggttcaagccatcctcctgtctcagccaaccgagtagctggggttacaggtgcaaaccaccaccaccagtttcgtttctttttt

SEQ ID NO: 10589 - DNA, 1022 bp, Homo sapiens
caactctttacctcactcatgaacttgtttttacccatttgctgccaaacataggtgtgttcccttcaggagaatcagcatatacaggttatgataggctcccaccatttatgcttcttcactgatagggttgcattactttctgcagcagactataatacttcatatagtactgctgtgtctcaactggaaaggtcaggaattttaatgttacgttgtggtctttgaaaactgttaggcctagcaatagataaatctcaaaattaattttaaaatctgtattgacaagaataggtaaaattatgaccaggaatcattgttacccttagttccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttctta

SEQ ID NO: 10590 - DNA, 1062 bp, Homo sapiens
ctccggatgatgatgatcggtcagtactaacatagcatttcgttacctcttaagggttgtgtttacaactccaaattcaagcatttcatctcaagagttgtagaagtttattacaacctcacttcagtatacttttcaaagtaatgaagtagcatcatcacattataaattagagtacctatacaaggcttttttttttccccagcatttccaaaactacctagtcccattgctttaaatcgtatctgtaccaagtgttggcaaactatgaaccacaggccaattccagcctaccacctttatttgtaaatcaagtattactggaacacaaccaggctcatttgctgacatattgtttgtggatggcagagttgagtggttgaaacagactgtatggtgtgcaaagtcagaatgtgtgctgtacggactgctgtgaaaaacatctgccaaagtctgatctgtatacccataactccctccctgcttgatatttccacataaatgtataaagggcatttcacatttaacaaggccaagacagaactcttgatttctaactccttgtctgaatcctgcttctccagcctttctcccatttcagtaagcatcatcattatcccctaatttctcaagcaaaatctctgaggattgttcttaatcttttttccttaccactcttcatctccctcgtagttaatccttaagtcctgtcaactctgcctataaaatatatccctgtctacttttctaatctgtactgtagccaccctactctaagtcaccaccatcttttgccttgactactgcaataaccttcaaagtagcctctgattgcattcttcccctaatccattttccatgtagcagccaaaatcatcttttcttttttaattaagtcagattatgtcactgttttaagctatagattcttaacattctttattcatacctaaaatctataggccttgctatgccttctaaagccctacacgatatgacttctgcctaactccgtctcaaaaaataaaaaaaaaaaacaaaaggcattctggacattaacat

SEQ ID NO: 10591 - DNA, 1027 bp, Homo sapiens
tttgatagcaatgttagtagcagcagcaactaatgtttctatagcattgattatgttactagttactattctaaacacttaacatatattaggtcatttaatcctcagaactctatgaggtgtgttgtgttatatttcttataccactgaatatagtaagatacagagggtttgtttaatgacttgcctaaggtgacacaggtaaaaatagcagaaccagcatgcagagtgagcattctggctccagagtctgtgctttcaaccactccactgtgatgcctttatatactgttgggagatagtaggcatacgtcttggccttgattgttgtttaaatcagacttatgtgcccttcagagttttttcagttgtaacatattttccatagatttgaggtaaaggatcagcatgccttgaagcccctttccctgcaggggagtaagcagggaagtagaatggggtttgcaactcacaacaaactgattactctcagcaaaaatccttttcatatctactctttgaacacggaagatgactgaaggtggatgtaactcaaggttgaaaatagttttccactaccccttgtataaggtgcccttgtgcctcacttgagaacgtagtacattatctgttgtttggggcctattcaagatggaaatggtttcattttaatactccgatgcacatgtcttccaaatatgctgtttaatttcttgccttcacacctttgttcatgcagatggtccctggattataactaattcacttgctctgaaagcatgtttcttccctcagccacatgatcccaaagtaagcactctcgaaggccatgctttaaaagcagaagctagtctcctgggatgcaataaatgaacaaaacgctttatatatagccctcccattttctttctttcatctcatttttgtgagacctaaatcagcaaatatgttacatgatggtttgcgtagaccagtccctggctgtctagtgtctcattgtggtcagttgacttcaggaagggtatgt

SEQ ID NO: 10592 - DNA, 1110 bp, Homo sapiens
gggtaggagcaaagctgtgttgggctaaggaaatgactacagatgggaaagcagtaatcatgaccacatattgtgtttgtaatcatgagcagatatgatatctgtaacaatgctactataaatgggggagggaattgacatatatagtagtcatgtttttgtctgtcacaagaattaagctagtatagatctgaagctggttctggtatatattctaaaaccttgagcaactactaaaaacaactcaaaaaatataattaaaaatcattttaaacctgcagatgctacattagaaaataatacaaaagtaagcactaaaggaatagtagaggaacaaaacagacatgggacatagaattgcacgtttgaatctaactatacaaataacattaaatgtgaacggattgaaatcaaaagacagagattgtcagactaagtttataaacagcattatccagctgtatgctagctaaaggagacataattgtcattcaaagaaaaatagattgaaagtaaaaggatggaaataaatatatcatgtaaacagcaaccaccagaaagcgagagtggttttactcgtatccagcaaatagactttataacaaaaagtgttactagagacgttttataaggataaaagggtcatttcatcaggaagctgtaacagttatgttgcatatatgtaataacagaataccaaaatacatgaagcaaaaacagaaatgaagaaacagacaattcaacattagtagttggagacttcagtataccgcttttaataatgtatagaacaggccgggcacagtggctaacacctgtaatcccagcactctgggaggccgaggcggacagatcacttaggagtttgagaccagcctggccatcatggtaaaaccctatctctactaaaaatacaaaaattagccaggcatggtggtgcactcctataatcccagctactcgagaggctgaagcaagagaatcacttgaacccaggaggtggaggttgcagtgagtcaagatcatgccactgcactccagcctgggcaacacagcaagactctgtctcaaaaaaaaaagaaaaaaaaaagaaacgtatagaaaattaaa

SEQ ID NO: 10593 - DNA, 1897 bp, Homo sapiens
ccttaactgctgcttattaagtaacttagatgatgtaggctttagtttataatagggtgttatgtttcattttaagaaattgggtctcactccatcacccaggctggagtgtggtggcatgatcatagcccactgtaaccttgaattcctgggctcatgcaaatagggtattggagaacttttacaaaataaaatgacatgggcacatcatcaaaacaataggccgggcgcggtggctcacgcctataatcccagcactttgggaggccaaggcgggcggatcacgaggccaggagatcgagaccatcctggctaacacggcgaaaccccggcgaaaccccgtctctactaaaaatacaaaaaattagctgggtgtggtggcgggagcctgtagtcccagctacttgggtggctgaggcaggagaatgacgtgaacccgggaggtggagcttgcagtgagccgatatcacaccactgcactctagccggggtgacagagtgagacgagactccatcccccccccaaaaaacaacaacaacaataaaactactttttaaaatatttatttatttatttatttatttatttatttatttatttatttattttgagacagggtctctgttgcccaggctagagtgcagtagcacaatcacagctcactgctgtttcgaactcctgggctcaagccatcctcccaccttagctttctaagtacctggagccacaggcttatgttaccacacctaactaatttttgtattttttgtggagacagggtctcactgtgttgcctaggctggtcttgaactcttgggctcaagtgatcctcccacctcggcctcccaaagtgctgggattacaggcgtgagccaccgcgcccggcctgttttctggcttcttaaggcagacactttggatgattaatttgagaccttactcattttctaattataatcatttaagggaatgaatttccctataagcactactttagctgcattccataaatgtagatgtgtttcatttttgttcattttaacgttttatagcttcccttgtgtcttgccttttgatttatggattgttagaagtgtgttgtgttaatgagagaacttccccaacctggcaaagggcaattacaaaaaacctagagatagtaagactggatgctaaaaaggcgagattgtcctttccctcaagttctattcccaccaatcctattaaacattatattaaaagtcctcactggtgcaaaaaggcaagaaaaataataggcatagagatatgaaaggaaaaaacaaaacttcttattgagagacctgattatttacacccaagtaattttttaaaaatacaaaaagcgtgctagaactaatcaatgacaggaacaagtcaacgtaaagaagtttggtgattttttaattacctttctgttaccaatttttgtgttgtaattccattagggtcagagaacatacattagaaagactgactattcttctgttactgcatagaatgttctataaatggcagttagatccagttggttgatggtgttatgtctttgctaattttctgcctactagttttgtgatggctgagacaggagtgttaaagtctctaagattagggccttgtatattttttctttcatttctgtcgtttttacttcatgtattttgatgctgtcttttaaggtatatacacagaattgtttcacttgatgagttaatccagttcagctttcttttgattagtgtttaaatggtatgtattcttttccaacctttcccctttaacgtacctaagatatgtttgaagttagttacttataaacagactacattgagatcatggtttttctcttttttctcctcgtgctgtctctgtgtt

SEQ ID NO: 10594 - DNA, 1029 bp, Homo sapiens
ctaaatcaaatagactttggtttctatcttatttgaccagtcagcagcatttgacactgtcaatcaccactccttgaaataccttgtacccttggtttctgaagtaactcctactatgctggttattctgtgtatctatctctttcacaggtttcccttctgataccccgccttcacttttttcctcttttttttcttaattggtctagctaaaggtttatcaattttgcttatttttttcagagaaccaagttttggctttaatttttcctatggcttctctgtttaatttatgtctgtgctttgttttgtctatttattttgggttttctttgctctttttctagctaaggtagacacatagaccattgatttgtgtgtgtgtgtgtgtggtgaaatacacgtaacataaaatttgccatcataaccatttttaagggtacagttcagtggcattaagtacattcacattattatacaaccatcaccaccacccatctttcagaactctcttcatctttcagaagtgtaactgtgctcgttaaacagtaactccccatctctgtctccccacatccccaggcaaccacccttctacttttctgtctctgaatttgagtgtcctctaagtacatcgtgtaatcggaatcatatggtatttgttccttaattattggtttatttcactcgcataatgtcttcaaggtttgtttgtgttgcagcatgtatctgaatttccttcctttttaaggctgaataatattccattgtgtatttatgccacatctcattaattcattcatctcttgtggacatttgggttgcttctaccttttggctgttgtgaataatgctgctttgaatattaatgtacaaatactggtgtgtccttgctttcacttcttttgggtatctacccagaaatggaattgctggatcatatggtaatttctattttttattttttgaggagcccctctatactgttttctatagtggctatgccattttacattcccaccaaccatg

SEQ ID NO: 10595 - DNA, 1051 bp, Homo sapiens
ttgcatcccacacatgtacatgagacacttaatcaccatgcaagagaacaaggaggatatccttgtcctaatgccatgtgaggtcctgtccccatcagataaattaatgttcattcaaaagaatgtaactcttgctttgtaagacatgccagaagatggctgaggtacctaggcttgctggcatgttacaacatgttcagtctaggaaggatcatgtggctaaagattttagtttgcaagactttgcccctctccctcaagacagttagatgagaccctaagacacatcattctcctcagcaaaaattgcagaagtatacatggcttgaggtgaagaaaggagaccttgggtcacttaatcccctgcagagaagccgatcaggtcattgcagccacctccctctagtgaccctcttacataaacaggaacaggaattcttgctactggattcctttcatcaggcatcttaggctcactgaatgaaaagccctataaaaaggagatgcggccctaataataacaaatacgatcgtgttggctattttggacaagaacagctttgtgccactcttgatctccatcgatggctgccattcttgccctgctattaccttacacacttcctattcttagaatcagttgtgagccttgggcttgggggattgcagccctcatggctggaatgcccagcttgagtggaatgcagactgtctggcagagtggaggttaaataaagtttgccttggcagccccctctgctcttggatgagtgacaagtgactcgagtataggagcgaggagtgatggcatgagctgccatgtggtgcaggatcaaacgagtcttccgtgcatgaatagaagtggttgattgtccatccatgacccacacagctatgtcagtcttaaatgaggtgggtgaaggggaggcctcaacagccttgaacctcacttctgaccatatcactttgaaaaaaattcaggaacagatcaagaataacgttgaaccactttctaggtttccagctgaactccagatttggtatatcttcc

SEQ ID NO: 10596 - DNA, 1057 bp, Homo sapiens
atgcacataggcacaggcgcatacacacatatgcatgcacgcagatctgatatatacatatatatgtacatacatacgaaacaagtgtctccaaacatgagatgcctttttatgttatcacaaacaacaaaacagatgatatgacctctaatgatgtccagcccacaggtcgaaaaacattgcgctacaaccatgaggtttaaaatgactgtgaaagtagcctgatacaattatatccaaaagtccctgggtctaaggcagtaattctcaactggagcaattttgtcctcaggggacatgccgcaatgtttggagacatgtttggttggcaaaactagcatctagtttgaggggaggaggggcaaggatgttgtggaatgttttataatgcacaggaaagcccctatgacaaagatttcgcagtccaaaatatcagtagtaccaacgttgaaaaccctgctctcagggtaataaaataagtcaatacttctaatttactgaaggtgtacttaggatgatagaagctttaacttgatcttccttttctttctcttttcctttgaactgtatttggtatcttaaggttggagcataattgcccttggattgtctatagaggtacagccaatagataaataggctggaaggaatggacctgttattttccttatatttagactgcaccaggcatttttgtttagaatattgttgtggatcttatgaatattttctgttttatgattttagtatcttcttccctttctcctcttcattaagccatactgattcaagaccctttctcactcagccatagctgctgtcttagaaaagaaatgaaggggatttggctaattggattagacatggtctctaaagccttctccttactcatgagatttgattctgctgttttgatgggaaatgaccttctactaaccttgaagtgccatcttaagccctagtattaaactgtctcctttttagtcattgcttcattcccctatctgcggctatttcagaccaggttcccttgaacatggagtggatgtgcagtccc

SEQ ID NO: 10597 - DNA, 1050 bp, Homo sapiens
tcttgctgtagttcttcttttctggatatgactgtcagtttcgtcatgagatttcttgctctcatttcgaactctttctttcttccactttctttgggggcgacccccgatccatgccaggtcttcctgtgaagaccgttccaacctcgtttccatttcttgaatgttgagtattacaacatcactgcgctagggtgcttcatggtgctgttctcgaagaggccagttgggctgaatctccttcctcccactggctcctgatatcttgctgtattttgtcttctttctgatttttccctaggggtttggggtgggtgacttaggggcggcttttgtgttctccctctctctctctttcttttctgtatgtatgtatggactggttaaagtgagtttgggcagctgactttatggtatgggttggctgacttttgttcaacattaaagacaaaccaacaaattgtacagctgcacacagaacacctttgagtgtgaacttgaatggcaactagaggcttactttttgaacttcaggtatgtaactcaaaagtaaataaaaccactattttttcagtaagcttttttttcttctaaaagatgacttagaaatcaaactataagaacatgaaatcggtgctgtaccaaagccttatatgaacatattctacactctgtataacctgtctgtgaggagctccctgctctatcaccctcttctcaaaagcctgggaatgccagcgcgtgccaagcctggggctgggtcttggggacctgtgggccaagggcaccctgggaagtaaaagatgacggtgaggatgggacacccttctgctgcctgagcagactgcaaggaaaccagatgtgtgtgtgtgcgcgcacctgcatatatatgtgtgcatacctgtgcgtgtgtgtgcgtgtgcgtgtgtgcacgcaagagagtgagagcgggagagagctcacaggtgcacagtgtcatggtgaatgtactaagtacgagcttgaagggaggcccaggttggctctgggagtggggcggtgtgggaatga

SEQ ID NO: 10598 - DNA, 1049 bp, Homo sapiens
ggagggtcaaattagtaatgcaccatctttaatgtattttttatggagactgtacataaaattatataaatctacagaattggttctattttaaggagagaggggaatgtatgtgggaggcaaggatcagatgcaatcgtggagactgggagcttcgggcgagtggcactcgggtgtggggagcgggagggcaagagatgagtgccgggcaagatgggcaggggcccgtgccctctgcacacatatataaatataaagaacacctagataaagtctatatatctctatatctatatgaagtcatagtttgctttatttttgtacctgtgcttagagatgttttgagcagtgctaccttcccaggcagtctgggatactagctcatgccttgacgccacctccttccctgctcttcctttggtattctctctgttcagagttgcttgggtctttctgatggaaatgtgtatatatgaaaagtttgtaaaataacaaaacaaataacccacctgcaggaaggacaagtgagctgaaggttgtgtggagctgcaggatctgatagccctaaagaaccaggaccaatgtgtctcttgccacttgggagggatgttgacttgaacttctttgcagaggggcttaacagggcaaggctgaggagatgaaaactgtgactccatccccacgtggctgtggaaaggtaaccagttcctcagagaaaacctggcttcacagcattagaaagggggtggttgagactacctagggacctacggtgacacctgtcttggtttgtagcactgtagctcagacagctcagaccgctcatagagggcatggcaatgggagagtttgtgaggctggctgcctgggcttggtcttggagaacacatggcctgtttagtgttgctgcagattcttagagccagtgtgaatgtggtatgtagtataaatatgtcatctatgtttttttcagttatttttaattggaaataaagtgccattgcaaataggatgctccaatcctgggacactgagtggaggatgaggag

SEQ ID NO: 10599 - DNA, 2002 bp, Homo sapiens
atctagtaggcagtgtgtagagccccatgtggctgtgtgtgttgctttagggagagggccaaagaggtgccttattggccagctctagattgactagggtaatggatggggcactggtgtttcaggagggggagttggagaactggagggtggaggggaggcctgtgtgctttgccaggtgttggtgaggctggaaggggcacagagggtgaggtcaggcatgggttaggatggtgagaccaccccaggggacaccaagcctcagcatctctttgagtcatgtgataacttagttacttgtaagggtgcagggtacacactgggggatcatcccaagatgacgaagaatgattgcctggtgggcatctggctggggagtggtagccatgcagggcatgtgggagggggatctgggcatcagggacggattgtggggtggggtcctgcatgtgaacgcagactggatcttgggagaggtcttgcttcttagctagatcttccttgcttcttctagaattagcctctaacactaagtgcccaaaccaaacatggacatcttctttatattgtatttcaacttcatttgttttgggggctcctcaggcccaaagctgagaaacttgtcttgagatgcccatcctatcaccagctcttcatcagtggagaaggaagtgccattctcattttcctaagctgcagcggtgggttgcctctccgtccacaatctgaaaatgttcatgggccttggtgatggtgatggtgatagagagggggagctggagcctgacgtgccttcatccccctttcctcttgaggtagagaggcttccttccggccatgaagttgcacagtggcttcgtgaggccttctctttactttctcttcttttgataggctaaagtcactagtctgtggtggaggtgggagggcaaaagagtttcacctgaaactcttggcttgaccagccattcttctctctttaatgtctccagctctgcttctttttagattaagaggcagaatgaaaaatctcttctttagaagaagtcagtaaaccaaggatcaaagcccagattggactttcgcactcttaccagcttgctgtttggctaggggtaccaatcaccacccttccctctgactgcgagtgaatccacactggttcagagccttatttctgggttcctgtctgtactctcaaaaccttctttcaggagcaagtataataaccccaccagatgttctgtgtgttgggttgccgagaaggtggaagtttttttcaacctcattttaagctgttagaaaaacactcagtagattgaatttggtccaaagacaccaccatcccctgagggatcccatgtaggataaggataaatgaagcatccatacaggggtcattaatggctgctcacatcttagagaaggaagagtctgggtatcttggttgccatatactctggtggaacagtggccagtcattaaaatcacatgggtgttgtcttctgcggtgtagaagacagtagtagtagttagggtttcggacgagagctggtgaaaagctaccggctttggagccctggctgggagagctagattggacagttttaaccccgtggctcaaatgctcagctcctgtcactggtccttggttgtcaccattcccatcacactagatggggacgtgaatggctgcctgggcctgcctttctttcgggtcttgaagaagtgtgctccaccaatcctacctctctgtggcactggatttcctggatttattttgcgaactagggcaggttctccctcgccaccccgtatacacaccagttagcttcccttcccttttcctttccccacttctgtatggctccagggatcgtgaacatgtgcgtggtttacgatggggaggtggtgggaggggcagggaatctcggagggcagggggttgggctggggaggtgacttgcattttcggccttagaaatgctgcgggcatgcacgt

SEQ ID NO: 10600 - DNA, 1054 bp, Homo sapiens
gattcctttgtttcaacattagaaacccggaacaaatgcaggtggaaaaggtgagcaggctgcgtgcttccttttcatccgcttgcttctcttttgcgtccctcttcctttcttcctagacgattctgcctcccagactcagcagcttcccaactctcaggttctgtggcccgatgaagctgtctgcctccgaaagaagaagagacattctcgtcctgacccctttgcccggctctcagacttgtgccaccgccagcttccggaagaccagacagcgattctcaacagtgtggaccacgatgacccaggacatgccactttgctgtgactccaccccactctaggtgtccccggggcgaggttgctgggctcaggcagggagggccactgtgtgggggtgtgtcctcctccgtctgccaagggcggcccagacctttgtcctgcatgccccctcttttgccagagcgggtgtctccctccagatcctggccgcctgtcttcaggacggagggtgggcacaccttccacctgtgggtcgaggtcaggaagtggattggagactgggcaacacctgtctcctcccctccgccccctgcttcactaggttgatttttctcatctcttccaatgtctttggaagtgaagaggaaagcaatggcttttactgctctctgcttctgtttcagtttttcaagtcctggaagaaggctggacttaatgtccatcttccacaccccacatatatatagatatagatacagatgcatatgtctgtagtgtgtgggtttctctatgtgtgtatatatatatatatatatgtacattgaggcaaagtgctgttgctctctgtggtcagtggaggcaggaggaggagggcagtggccagctggggtttgcgagcagggctggctgcacgttggccaggtgcctgacatctgtcttgggggattctttctcccaaaacaagatccgtgtctctcagctgaattctccgtgtgtctcctaccttctcccacccagagcagaaatggggccttgctgtgattaccggctg

SEQ ID NO: 10601 - DNA, 1155 bp, Homo sapiens
gacttgggcaggaaaggaggacgttcagctccttatggtgaaacgagagatttggctccatctctgctgtccctgccagctctagggtacttccgtacctgagatgaccaggatgcgaatcttcaggacgttgcatgcctgtactagaaggggagaggatctgaattttgtagtaataatccctcttcctgcagtcgtattttatcctcaagttgccttcacacctgggctctccttttgtagagacactggtgtgaggcaggaaatcccagactgggagcaggcagctgcgttctggtttgggcactgatggcaatatccacgtaagcgggtctctctaacccagtggatcagagctctttcatttagagaatgagaacagtatgtgtgctctgtgtagctcatggggttaacatgagaagagctgataacgtgcatgaaggtgctttgcagaaggcaaaaccctagataagtatagattactcttgaagtcattatccccatggggacaggcatagatgttttcttctttacaccctttggagagattgacttctgtagactctcctctcttcttcctcttcgtgacgccatccaaacctcttcagtgctagagttcagcttggagcccgagccttgacactgtctgttctacaaaggcagggtgaaacacttggggactgaaggtcggagcaggtgaggtcccggggaaggatgggctcatgagtgctccccaccctccctgcagacatcttcccgcagccggacctgaccgaggatgggctggcgcggcctgtgctggcgggaatcgtagctaccatctgcttcttggcagctgccatcctgttcagcaccctggctgcctgctttgtcaacaagcagcgcaagcgtaagctcaagcgcaaaaaaggtgggtgtctgtccccttcccttgctctccctggcccggtttcaaatgccccccatcaagagaggtggaccatttttagcatggccccccttggaaatagggacattgagatcttgtgggtagagctgccagtgagacttgatttgaaagtgggggtaagaagcaggggtggtggggagaggctgctggggcccaagctagcatgaaggcaggggccaaagatgcccactgtgagcagctccttc

SEQ ID NO: 10602 - DNA, 1047 bp, Homo sapiens
acaactgccaacgtgtcctgggaaccaggctatgatggaggctacgagcagacattctcagtttggtacggacctctgtgagtcaccccggcatgctttgctctctgcttctcccctccccggtcttcctgcaggctaccccgggtggggggaggtaggaggaggctgcagttcctggcctgccagccctgcacagactgaggtgggttgagacagtgatgaggtccttgtgggtgacgggaggggtctgaagggactctgggcatggctgtgtccctgtggcctgaggggtctgggcctctctgtgccctctccctgctcacgtgctgcctcgttttgcgtcctgcttcatcctctggattcctctggagcctggaagagactcctgcccttcaagggctttgtgaaattgcccagccttaagtgtagagtctagtttttagactaattttttttgtatttttgtatttgtaatttttgtgggtacatggtacatacgtttgtaggtatggggtacgtgagatattttgatataggcatgcagtgtgtaataatcgcatcagggtaaaggggtatccacccctcaaacatttgtcctttgtgttccaacaatccaattatactcatagtggtttaagaatgtatgatacattattgttgcttgtaatcctgttgtgctggcaaacaccaggtcttactggttctttctcactatgatttgtacgtgttcaccctccccacctcctgtagtctagtttttattctgtcttttccccagaggccacagaaactggtgtggagaggtgatgctcacttcccagccttggggtcagcccctgcattttctctctaggaccatgtgtttctcgattgttttcattcctctgttgtcagtttagccagatgcagtcatatgaggtctttgcgcaaaccttagggtagatacagatctcaaaaatgtgccaagcggggtgagggcaggaggcacaggaagggaggagaaggaagcctagctgactcctcccacccccaagggctgcccctccc

SEQ ID NO: 10603 - DNA, 1665 bp, Homo sapiens
atacagtttggagcaagagtcgaatggcgagattgagcacgtgaccaagcgggccatcagcacccccgagagtgagtaactgatcggaacacgtgggcttctcctcagtctctcctgcattcgtgatgtgtttgctagagtcgcagtaaaactccttccggtgcaggatagttctgatggtcagaaccatgagtgcattgctgaggtggagtatttcacagtgaccacggtcgcttgatccatgagcactgaccgagtatgttgttccagtgtcgttacattcagtcagtcaaacaccacagtggcccgcggagcagacaatgccgttgaggcacaggtaggttgggtgactgacccagtggtgccttctggaggcggccctccgtgtctctgggctgtccgggtgcactgggcgctgctgggtgggcctgctcccagggcgggcagacgtcagcaccagcaggtaccatgcacgctctgcaactgccaagaccagagacccggggacccctgctcggagcctgtgtctcattcccctccatgttttttcctactgtttgtgcttttcctttgatttcaaaacagaggtgagttaggagagttgagtattcttttcctattatcttgtgtgatagcttcatattgtgtcaaacctcataaaaaccattattttgagaaaactcttacaggaagaagaaatgcttcctgtcctaaatctgtggagtagtggctaggccctgccgccgtgtccctgtgtgcccctcgctctgcgcccggctgtgcacagtgccctcagcaagctgcatccagccccgctcgtccctggccattccactcctcactgtttccacagaccacagtgcctggaacctgggaggtgtcagagatctcctcccggagacttctgggagggcagagctgggcgctgagcccaggccttctggtcccaactcttgtgccccttctccagcctgtctcctagtcctgactgcaggggaagatgagagcgtgctaaggtgctcttcctggtaacagagcagcaaggtgtcctgccgttcgtttagtcactgcttcagtcagctcatgtgtgtggagcacctgctgtattctagctacttgcttgtttggttctgtcacactgatgctgtgatctcttagaatagttaacaggttagaggtaattttcatccaggtccccctttgaagggagtttatcccacccccaccctcagacgacaaccgaatcatgacggcatttgtcattaaaggcagtgggtaatttgggatcctgcgtcgtggacaggtgcgatgttctgtgtgttagagcttgctgtgtgttcgatgttcctggctcaggagtgccaagagcttctattttggcagtgaggtgccatatgctgaagaaacggggagaacgcatctcattttcgttgtgctcatcctgagtccctgatgtcagtgttgggttgtttcctagcagctcgtgtttctccacagggcagcctggcgtggagggttcatgccgccctcatctgcctgtgtggagccacgctttgtgctggaaatcaggcgcccggtgtcattgagttggtagagtacttgttcttgctccaggctcttggacataatattcctgctgatgcagtctctgtccgtctctcttta

SEQ ID NO: 10604 - DNA, 1032 bp, Homo sapiens
agtatcacactgttgcccaggctggagtgcagtggtacgatctctgctcagtgcaagctctgcccccctgggttcatgccattctcctgcctcagcctccctagtagctgggactacaggcaccagccaccacggccggctagtttttttgtatttttagtagagatggggtttcacagtgtttgccaggatggtctcaatctcctgatctcgtgatctgcccgcctcggccttccaaagtgctgggattacaggcatgagccaccacacccagcccagcagtctttcttaagtacaaatttgatcattttattatatctgaaacagactaaaggcaggttgactgtgaggggtggcaggaagcttttgggtgatagatggtgagtggtctgtagtgctggttattccatatagacttttgtcaaagctcatggaagtgtttgtttaaaatgggtaaatttattacatatgttatacttcactagtgaaatctttaaaaactatgctggtggcttcctgtcatcttctgaataaaccctgattcttctttttcaaggtaaacaagaacttctggtgtgccttccacctttcccatacctccctccatcctcacctctaacctctccacttcaaattgccatctgcacctcagttgcgagctgccccctactcgtgtgctcttgcctctgggtctaaagtctgcagcgccctcacccacccatcctcccttctccacacatcctcaggatcatccatcagatggccatgcactccttaggcatcccatctccatacctaaattccctaacaccctgccacttaacacctcttcccttgagacacacactttctagaagtggctggagggcagggatgcttagcttcattttgcatcctcagagggttagctctttgcctggacagagaaggtgcttgataatacttgtcaagtgaatgcatggaagccacttcttaagactattcctgaacataacatctgctcacatctgggtttattaaattgcttatttc

SEQ ID NO: 10605 - DNA, 1045 bp, Homo sapiens
gggtgtggctgggaacagtgaggcttgcccatgatgacgcactctgaaacatgccggcttctctctgcacaggaggaatttgtgaaatggaagggctccctgttcttccgatttgtcagcactctgatcgattcacacccagacattgccaggtaaatcttttcctcacgtcagacgactcaacagtttacctcatttctgatgtatgctggatttctttttttttcagattggtttagagttaagtaggatttagtgagctttcggtaggtgccaggaaaattagcagatttttaagatgctaagcaatataacaaacctttgttttgcacacaagtttaaaagaaaatggttagattcatcattgaataatctcagcattgactgcacttgctgacagtgtttgctgttcctgaaggagcttgaagaatattatatgcttgctgtattacactgtatagagtagcagccactagaaactcactgttaatttctaggcaaaaaaaaaaaaaagttaattttgataaagagctgagactttaattgcagaaattttaaggaggaaactaggaattaagatgaaattgcacaatgtggaatcaagtgtacagatgacaagactccttggaaatgggcatttcttcagacttctgtggcgtgggggagtgactttggcaattattaatttctatccttgcatctttttttttaaagatttttttcaaggggttgagaaatggtctgatagaatttgctaccctagagtttgttgtaacagtaattctttttcaagcaagtctgcagttggaaagtagaatgctgaatgccatagcaaaagccccacagtggggaagaggtctttacagagctcattaactataaatggctgctaacagtgggtccctctggatctaaatatagccaccaataatttaccctgagttccgtggaagtttctgctcagttttctttaggtgtgattttccaaggaggggaacatttcacataacaaaccagtaaaactaacattctacttactgctttc

SEQ ID NO: 10606 - DNA, 1050 bp, Homo sapiens
ctattttcacaaaataattattaatagcacccccttttacttgcagatgtgtctagatttagatgataaaattatatgcttgccctaattttggatgagtttcattacatagtgactaagtttttacaatagccatgtatttttatgaaacgaaaactagtaacattgttttaaatttgggggataaaggaaatactccattgacatgtccttaatctagctagagttcacttttcttttgccttatttttactgtaaaaccaattatctttgtaggtgaagtacatttttaccttaggggatatagcccagctgtgtccagccagggtggagaagcgcatcttccttctgattcagtccgtcctggcttcgtctgctgatgctgaccactgtaaggcatttgaaatcatactctgtagcacgcatgccgtttcaaggttctgtcggtaactttctctcccttctttgcagcaccatcatctcaaggcagcagtgaggccccagcgtctcagccacccccccaggtcagaggttctgtcatgccctctgtgattagagcacatgccatcattaccttaggtaagaaaaacatgggagaatggggcttgacatcgttctgtgtgtagctgttgtcttaagtaagcccagccatgggactgtgtcaggggctgcggagcctgtctgtgtctgctctcagccatgtggttcctagaggtggctctgatctgagtgctgagctctgcataactgcgtgctggtcatgagagccctcaggctgataagtcctcaagactaaggtactctctagagggtctagagggagcttttgtttttcagtagggttatgttaatttattacaattatacctgtttctgtaattttttttcaataccttcacttgacttgaatattcctgtaatattttaatattcataatgcagccccacgaagtctgttctgtgccgggcactgcactgagttctggaaatgaagaaataaattttccataaaaggaaatggtttatttagtactttccagaattggctag

SEQ ID NO: 10607 - DNA, 1123 bp, Homo sapiens
tgccgtaggaattgctgacgcaggtgtgtggggatgtactctccacctgcgagcaccgcctctccaacatcgttctcaaggagaatggaacagggaatatggacgaagacctgttggtaagcgactgcttttcctaaccattcttttcgcttccattttatccgtgaggttctattaaagatgactttgtcatgtacgctttaaatgcttttaacaaaagagctgtcttagcctagagcttactttctctttttagaagatatttttaaattgataacctattcatttttttcttatatactttttatcggtggggaaactcaatggtatacgcttcatctagttcagtcttatgagaagcctgatttcagtagggaaaacacagtatgtgttgtaaggttggtatagtcaagcttagaaatgtaaggtaagaaataataatgtgagtatagtgtttttggtttgtgtgtttgcttttttaaaaatttaacatgtcttctgagctatttgaacatcagacagtagaactggggaacagtgctgagcaattgccaagtaatgactgaaataaaatgagagatttgacaattcagaacacagatgaccttggagccccaagattgttttctgtggcacccctgctttagaaactgtaaacggtgcaagaaattcccgtgagccaggacgggacagtgggctgatttcagtggctgactggggataagatgtatggcagtaattctggttccaacatctgactttgtccagtaaaggaaataatgagctgctttttgatgccattcagcacagatcattatttaaccaaaacgggccatttttctcatatgtttaaattagtggagcacgtcttttctgtgttcagtttctgcttgttggcctagctctcctaacgcccagtgatcaccgaccaagcttagatttgttcaaagagaagaccattgagcctgaggcactactgtgcacgtgatcaggaatacagagcctcactatgggaacctgggtgctttaggtaagagcaccagggagtgtagcacaggcttggcccagggcttctagagggtcttgctcttctcatttctgcccacattaagaaagatgctta

SEQ ID NO: 10608 - DNA, 1034 bp, Homo sapiens
tgtcacacctcagttgggagctcttggtaatgcatgaggtcacccagagttaggttggagataagaggactaagaatagagcttttcaaatcagcaattagttattagaagacaggaattagttacaggagatgaaaagagatccaactggtggaccagagtctcagcgcaagagtagtcagtaacctctggtggaggccatggagacgggcctgaagcatggccgttggttttggtactaagatagaagttagtgtgttgggtcacagtctgcccaggtggggaatggctgtggccctcagctgggctgggaggctggctgggagtggagggctgggagttgtcaaagaggagccaagtttgagatttctgcaagttcagaggattttttcccaattctgttggctacatataataaacattacttaatattttatatcgttatttttaaataaatttaaaaatacttgttcattgcttatatcttgtggtatttggacataaatcagacataaatcatgttgtaagctaactgtagtaagacttgacatctgtggatggatttttaatcaatagctgatatattagcaaaacttcatttatatgcatatgcttattatggtatatagatgtgtttattttgttacagttaccttattctgtatgttttgagaatttcccttctaaaaacagtttaatgaggaattcctgatgttcgcgtgtgggtatgtatgtgtatgtgttttcccagaagtctaagaaaaattaatcaagggaagaagtgtatttttctcttcatttaaatatataatatggcattgtctcatgaatcatatgatcccattcagtgacttgggaagaagtaaaataagagatagttctaaaacaacagtgacagccaggcacagtggctcacaactataatctcagtactttggaaggccaagacaggaggatggcttgagcccagaagttcaagaccagtctagacaacatagtgagaccctgtctcaagaaagacagacaaagagaga

SEQ ID NO: 10609 - DNA, 1715 bp, Homo sapiens
ctgtaattttttttttaaagctttttcctaccaaaggcagacatctaaccgttccgaaccctcaggggagatcaacatagacagcagtggtgaaacagttggatctggaggtatgtcagattttatcactgtcagataggtaatactgctggatttcagacaaccgtaagtagagtctaaaaccttggatttttttttttttttctgatttattcacccctaagagttgaaacagctggctgggcgtggtgactcatgcctgtaatcccataatcccagcactttgggaggctgaggcctgcagatcacttgagcccaggagttcaagaccagcctgggcaacacatcaagaccccatctcttaaaaaatatatataaaaatcagctgggcgtggtggtgtgcccctgtggtcccagctactcaggaggctgaggtgggaggatggcttgagcccaggagttccaggctacagtgagctctgatcataccactgtactccagcctgggcgacagtctgtttaaaaaattaaaaaatgaaaataacactgcagggcagtctgcttttttgtaccagcttagttactaaatagctgcatgatctaggggtatacctgtcgttttccggttgtaacaccctcccatctttcccagacgactgttgggaaagtctgtagaaacaacatttaagaaagtgatttaaagagagagagacacagataagagagagaaagagcatgtacgtagaggattaattacataattgggtttattaatttattcaataaaccttgatctggtccttcccgatgcgttccaggcattggagatgcacaagtctgtgagacagagctccatctcttaaggatcagtggagagacaggtgcttgtgcacacaagtgttctcatatatacaattgtgcacacatgtatgcggaacactgagataggtgccgagatgcacagaaagcgccctgaggatgattacattactgcttttattattcagcctagaaggtcagcgtgaaattgggttcaggaggctagatattagcatgtattactccaattcagagcgataactacatttataataaacaggttttctaaatgtggtaggaaaatgtactctggaaaaatgctgaatgtttgtgttggctccagacttcgtctaaacaggttacggatttacggtggcacagactttttcaagcaatatcaagttgaggtgatttaatgatgcttaaaaattatgaaagttcggggacgcaaagagcccatgtttccagtgcattgttcataagctgaaaggacatatattgttggcattaattgtacattaaaaattttgtatagtcacttagatgcactttgctctctttgctttttcttattaaggcagagttcacacaccataaagttcaccatggaaagtgtataatgtagttgttttagtatagtcacaagattgtacagactaattccagaacattccatcagctgaaaaataaaccccatagccattagcagtcactccccatgcccctttcctcctaacactggcaaccagtaattttctttccttataaaattgcctattctgggccaggcgtggtggctcacaccggtaatcctggcacattgggaggccgagacgggaggaggatcacgaggtcaggagatcgagaccatcctggccaacatggtgaaaccccgt

SEQ ID NO: 10610 - DNA, 1054 bp, Homo sapiens
tcttacctgatgacttagctactctgcagcagctctcaaaactgcacgggaactacttcacagttttctacgatgacattttatgtcttcactcttcattctactgaaaccactcttatagcgtgaggtagagtgttttaataactaggatttctaaatataggagtagtggtttttggggacagtcgctgactgtattgtgaacagtagatgtgtttttcttttacaaagcgcccttgtggatgaattaaaggagagtatattcccagtcgtccgtatcttactgcagcacatctgtgccaaggtactgtttgccttagtaatattaataacatggaagtatatcgtgtgtgaagataaatgtgtgtgtgtgtgtgtgagtgtgggtatttgttcttgggaatgagtgtgcattgttacttaaagtggttttatttaatgttcactagatggtcccctagacaaaagtgttctataaaaaacaaaaaaacaaaaaaactttgttttggaaaaatgttgaacatacacacagaaacagggaaaataggctggtgaaccaccacatacccatcaccgagttccacagttttgtgtcacttaaacccctaccccacatcccccaacatgtgtatactggattgtgttttgaagcaaattccatcatatcctttcacggtaattccttaatattatcaaacatccagtgttcaaatttccatgatgatctctacatttttataaccatttagacaaatgattcttaatttgaaccttatgaaacctggggatctaaaaactctctgaaattgtatactaaatttgtatgtgcatttttctggagagatggtttatagatttcctttagattagttttgaagtgttctaaaacctaaaatttattagtcatttacgtaacatttaaaggtcattgaactagttgtactcactgactttcaacttatattacagaatatgtttcagccatcctgcgggtggatattggttggtcaacttctctttttgcttttcaggtggtagataaatcagagtatcg

SEQ ID NO: 10611 - DNA, 1027 bp, Homo sapiens
tgtaaagtatcgttctttccccttttgaataagggaacattagtagcattctttgccctatgtaaatgacagttaattccctatttgtcctaaattctgggttatgatatgcaaagggtggggagagaaactaggtattgtttttatcagacatatcatctgtcagccattctttcacactgtttacattgtgcatttattgtatcctgctcattgtttaagaaatatatccctagtgttcagccagcaattatgccagcctgacctaccttcagatggcttgaaatggtttactacagtctgcatcactatgtctgagacccttgtgttctccatccgatcttaaattgaattttcttttctcttctaggtcatcagttgtgttttccatcaaatgctcagtgtaatattaatgttagaagttggtgaaggatcccatcgtgccccccttgctgttacctcccaagtcatcaactgtagaaaccaggcggtccagtttatcaggtgaagcacacaaatcgtgaattttcaccctgtcagtctccctcagtactctgggccctgcactaagatttctgatacatgtagacttaaaatttctggcctgatggtggttttgggggtgaaaaccaagcacttcgtagctaatgtgctttatgtgtctgggtctctgttggtaggctcccagctggggcactgttaaagagataggaatctgcagaacacgggccagcgccagcctccagcttgtttgcgctcaatatgtgggtcagcctcagagagaggatggtggcctctcctcctttcccttgtctgcttcattgcagccagttcacctctttcccttttctgttgctctctactttgcagctctttgcttttgttctttgccactttcttcttgtttctttgcacttttctattcctttccctctgtagaaatgacttgaaggaaaggattgagttgctttttacctccgtagcaataagtgttagactacttttcctctcatgggtcactcagctt

SEQ ID NO: 10612 - DNA, 1047 bp, Homo sapiens
accatgggacaaagtgtttggcatttattacagtcacctgtacatttcttcataatctagatggatgaaattatagaagaacaagaagatgagaatatttgtttttctgcccgggacctttctcaaattcgaaatgccatctttcaccttttaaagaattttttaaggcttctgccaaagttttccttgaaagaaaagccacaatgtgtacagaattgtatagaggtaagtgaaaattccaggaaccttagggcaacttcaaaggattagactatggctaatacctgatcagtagaaaaaatcaggccttttcttcatatctgttttctaggtctttgtttcattaactaattttgagccagttcttcatgaatgtcatgttacacaagccaggtgagccattaaatcttccagtgctacaatttaagtatagtgtaccaatttttgctccagcagaaatggaaataccattttatcccaattggcacacaggtagaatttattcatttaaacatggcttgtaggactaagaaatattccaagtaaaatcatatccattaactaatatttcgtcttttttttttagagctcttaaccaagcaaaatacataccagaactggcttattatggattgtatttgctgtgctctcccattcatggagaaggagataaggtaaaggagatgagaacctaatttggttactagttgaatcgaaggcacatgaaccatatgatggaaatatgttaaaagcatttgatataatgccatttcaatttactagctcattttcatgaccttatattatttgcataataaaaagtatcactatttctatttgctctctgttctttattgccaactttatatctgaatacttggtggctgcagcaaattattgttaggctccagttagaaaaaatggttctgctgtgaatgaaataggaggaacagataaactgctgaacagttacttctataggaacagatgagctgctgaacacttacttctataggaatatttcccaaatcattctaaaaagtagaa

SEQ ID NO: 10613 - DNA, 1032 bp, Homo sapiens
gtgtatacctatgtaacaaacctgcatgttgtgcacatgtacccaaaaactttaagttaaaaaaaaaagtttatccaaaaaaaaaagaaaaagaaaagaatgggaagatttagagttaagagagattggtggaatccagccagcgtgctgtcttaatacccctcctctcaatgtacattctttcaatcagtgtgttttaaagtcaccaagtattcctgggagtctgaatctgggttgcctcttctattttaaacttcctggagaaattatatatgttttttaaatgctacatgattgtccaagggcccaataaagtgctctatattttatttccacttattaacttggttatgatattttcacaaaggaacctcgtgggcaatctgattaacctctgtttcttctctagattgaacatgtgggaaagcctgatcactgaatgttttgaagtgtcctttcccaaaactcttgtatctgaaaagtatttcctcctttatatttttagaagatgattagcttaatagtcagtgtcagttgtgatttaagattctcttaaccttttctggttttcttttattatgctacacctatgttattaaaacaagttaaatgtgaatcgtgactagtaaacttttctcctcttgaacacacctggaatctaaaggtgactagtttttttacttgttacagagtacttacacatttcattgcattttcccctagaatgggttgacacagtgtgggaactggatttcacagagactgagcctttggatcccagcatagaagcagagatcatagagactggattggctgcattcacaaaactctatgaaagccttttaccctttgctactggagaacatggatctatggaggtaaaaatataaaaacaaactagccaaagtttggtgttagaagtagaagatgaaagtcattattataatctgaagcttagctttcttggtgtacagttcacagggagtacaatatgagtaacataaagaatgtggttaatttattggaatatcc

SEQ ID NO: 10614 - DNA, 1050 bp, Homo sapiens
agggtggagagagagttagaatgaaggcgaagtttcctacgcacataaagctcagtgagaaagcaattccaagagtaatggaaggaaaacgactctcgggaattcagtttgaacactggcgactgagcccataaacatctttctggaatgaggtttgcagaagaaagcagcggtctaacctgtggtagcctgtgactctgacattaacaccagagcggtgggtctcaaagtgtggttctcagacaagctgtggcagcctcacttgaagacttgttgcagatacaaattcccaggcccacactagaccctctggagcagaagctctggggttgaggcccgcaatctgcgctcccatgccctccaggcgattccagcacaggctgaggtttgagaagggtgctgtgaaaggggcagggaagccccattatataatgtttccagcaaggcagcctcacgttgcttcaccgaagtcactcaaagaagcctctgcccctcctgcttttccaagagtcgtgtcatttcaagacttccgcactggctgtagagagtggagacagccaggctccgagcccgaccccaacggcttccatgtttcctcgatagaatgtctgtgactaccaagaagatacccatatagtgatggtttattttattgaaaaatacactagtaatattgagacaggtatcttttaggccatctggctgataatcaatatagagctactgatgaccatactggctcacatttgccttgtccatcactgttcttggatccctgagaaccacgtactcgataaccttagagaaaagccccggctgtggttttcaacatgctttctcatccattatctcagttcacccttctcgcagatctccagaggaaaagggcagcagcagagcgatctgaggccccccgaaagggacgaagctgcggctctggactccaggcccctgccagaacagctctgcggaacgggagggaggaggaagcctcgagacagacagggcttgactgcaccctgaggcccaggaggcatggggacagagagt

SEQ ID NO: 10615 - DNA, 1061 bp, Homo sapiens
gtggatatgcaggttgccctggtggggtctggaaatgggggctgcaggcttggagggaggcctcagtgtggcttggaacgtggtgtatggtggtctgccgcgaaggccggcctgcacaggggtgggaggggggagcttctgcatgggaagcacagacagcgctgcctctcccttgcactcagctctcggggcatgagaggctgactttccgtgagcctgtgggccaggcctctttgaatggggctgagggagctttgccctggttcctttgtgtccccacggtgccacgggaggctccctggcagggtgtggggcaaggcagtgagtgaagagttgggatgagtgagttagggcccacggattactcaagacaggacttcacgttgattcaggagcgttagggagctgtgattggattttgagcagggcagggatgggacagaagagtttggggaaggttcctcaggcatccgtcacggaagggataagaagggagagagagtggatgccggggacacccagaagctgttattgtagtcaggatgcgacaggggtgaggctacagacaggggacttgcaagcagggagggcagggtgagacattcagaggaaacgacgacaggaaatggtgacagatagggaacgaggatgaagggaagggagagccagtgacgactggcagtggagtggggagcaccgccacctctcctcctccacttgccccctcctgtggcactggacaagcgagtgggcttttcgttgtccgtgggcttttttgttggggatgtgaccagctttgaacccttccccttaaacatgctcctcctgcacggaagagacaggggcaggggagagactctctccccaccaccccatctcaggccccagcacagcccggcctctggcctcactggcgtctgtgcccagtgacgcaggcaggtgagctcctggcaaattagcattccaggccgtgctctctcctcctgctctgctgcagccgggagtgtgcagagactggaggggatgacagtcacctcccaggctgtcttcagctgtgccct

SEQ ID NO: 10616 - DNA, 1049 bp, Homo sapiens
caatttggagacgtattttggaaggaggtgagtttggaggaggagagtagtcttttaaaggagagaattagaagaaagatggcgtatttgaagggttggctgtagaagaaaacaaatgggatgagagaagcagaaacagatttttaaatctagattgaatagactggccagcagaagaaaaggatgtttaacagtctttcaaattcatattgagagttgtatatatatacatatacacttagtatgagccaggcactgtttatgttactagggatacagcagtgaacataatagataaaaacccgctgcctttagtgagtttgcatattccagtgtggagagacagacattaaatattagatggttataagtgttcaacttttttttttttttttttttaagagagggtctcactctgtcaccccagctggactgcaatggcgtgatcatggctcactgcagccttgatcccccggtgcaggcgatcctcctacctcggcctcctgtttaactaggactacagacatgtgccaccacatctggctaattttttgtagagacagggttttgccatgttgcccaggctggtctcaaactcctggactcaagcagtctatccgccttggcctcccaaagtgctgagattacaggcgtgagccacttcaactagccaaggttgtaagtgttaatggagaaaagtaaaacagagaagagggatgaggttggtagagtggtcagggaagacttcatcaagaaagtgacattttagccctgaaggaggagagggagtaagccacatagataaatggggaaagaacatcatagcaaagagaactgtaggtacggggactctgaagtagaagtgtgcctggcacgtttgaagaacagccaagaggccggtgtttttaccgcagtgaacaaggataagagtagtaggtgaggtcacagaagtaatgaggttggccagatcatacaggaccttgtcggcaattttaaagaccttgaccctctgagtaagatgaaaagtcattggaggcttttgggcagag

SEQ ID NO: 10617 - DNA, 1064 bp, Homo sapiens
ttttttttgagacagggtcttgctcagtcacccaggctggagtgcagcggcatgatcacagctcactgcagcctcaacctcccaggctcagatgatccccccaacctcagcctcccagttagttgggaccatgggtgcgcaccactgtgcttggctaatttttgtatcttttgaagagatggggtttccccgttttgcccaggctggtctcacactcctgggctcaagcgatttgcccaccttggcttcccgaagtgttaggattacaggcgtgagccactgtgcccagccttattttctgtttatttgatagtaaccgtcttaatgggtgtgagggagtctcattgtggttttgatttgcatttttaaatgttgagcatctttcttgtgccatttatatatcttctttggagaaatgtctattcaaatattttgcccattttaataattgggttgtttttgttgttgagttgaagttcttttttgttgttgagacagggtcttgctctgtcgcccaggcagtggcgtgatcacggctcactgcaacctttgtctgctgggctcaagctgtcctcccatgtcagcctcctgagtagctgggactacaggcatgtgccactacacctggctaatttttgtatttttggtagagtcagagtttcgcgatgttgcccaggctggtctcaaactcctgagctcaagtgatcctcacctcaccctcccaaagtgctgggattatagatgtgagccaccgtgcctggctatagaagttcattatatattctggatattaaacctttgttagatatacagatgcatgcaaatattttctcctgttccatagattgcctttttattttctcctcttttttttttttttaggggcagggtatcactctgtcggccagggtgatcctcctgccttagcctctggagtagctgggattataggcatgcaccactatgcctggctaatttattttctttttttcatttttttgtagaaacagggcagatctcactatattccttaggctggtcttgaacttctgacctcaagtgat

SEQ ID NO: 10618 - DNA, 1025 bp, Homo sapiens
ccaaggtttcaccatgttggccaggctggtctcgaactcctgacctcaggtgatccgcctgcctcagcccaaagtgccgggattacaggcatgaaacaccacacccggcccgaaatccctttttagcgtttgcttccttggcccagtccagacctaagctatcttaggttgagttctctgggaaacagactgtacagtggagatttgcttgcaggaattttattgggaagtgagggaacttaaactgggattcagttgcagcaggcctcgtccaacacgatagggatctctgaagctgggatggctcttcagagatatcctgaactgagcaaggggattggatttttgtgtttcctcattgaccaggcactggatatgggctgtccctgaggaatgagaggcagaaacttgggtgaggcagttcccttgtctggggattcaactacaagctatcagcaggcagcattcctggcagttggcagaatgagcccatcagccccgaagagcaagatctgagcagtaaccctcagcagccactaccattcccttttagaattagctaagaagtggccgggcgcagtggctcccgcctgtaatcccagcactttgggaggccgaggcaggcagatcacgaggtcaggagatcaggaccttcctggctaacacagtgaaaccctgtctctactaaaaatacaaaaattagccgggcatagtggcgggcgcctgtagtcccaggtgctcgggaggctgaggcaggagaatggcgtgaacccggcaggcggaggttgcagtgagccaagaccgcaccattgcactccagcctggacaacagagcgagactctgtctcaaaaaaaaaaaaaaaaaaaaaaaaaagaattagctaagaagtgccctggccccttttctctgaatggaaatacctgatgttttacgaagtagagctgaagtctagatacaaactattcaattttaatttgaggttactgttttaatttggggttacaattgttttaaaaaaaaaata

SEQ ID NO: 10619 - DNA, 1025 bp, Homo sapiens
agttcccttatagagattcctatttgaaaagttaagcactatgattatgatgtttccctttgtcttccgaatcccttcattagtgagaaccccttcattacccttacaggtaaatgaatctgaactcctctgcgtgggaaatactgatatttcaatagcacacagaaaagctgagtaaaatcttcttgatggattttgttttctattttagatcctaaaataagcaaaagaagaccatcgagagagagaaaagaaagttctgagcattaccaaagagacatacagacactcatcctacaggtaaagaatgtattttggcagaccaagatggcttttatccacaggtgcagctctatgtcacataccctcagtgtcatgtgataagtatctccttgcacacaggttacatctaagcatcatgtggttaagaaaattgagattgttcctaatttctaagagcttatattttgaaaccatccttttctatttgaacattcttaaggtgctactctgaaccttcaattcaatatactaagccccatccaccaaaaccattacaaggtaagaattcactggcctagggatatgcagagattgcagagggaagcttgtctatgctgatagatcaacatttgatggtatattcatttatttagtgcttaggttccaaagtctaggaaagtaatgaactgttctcttacctcctggttatgtgtcatttggaaccatgatttttcatctagttgcactaaagtttctgtccttactgtgttaaatctctgttgatttaaatgacagtttctacctttggccagtatctccatgtggagtcatgacaaccagacacagagaaggaaattacattatattcattttgctctgctttttgaaaccaaaaactaagaaaagagtcattttgcttctgtgcaggaagggtgtcttaaagggagacagtcaagggagatagtgaaaaggcaaaaatcacagggtgagaaaactggattttgtagctttgtttgtgtgtt

SEQ ID NO: 10620 - DNA, 1085 bp, Homo sapiens
ttggcgggagaggcgcagggacttgggggcacttccccaggccctggtgaccgtggtcatctttgtcacagcctcctcctctgcccttgcaggccaaggactggaccagtccctctcagccttgcctctatctctccctgcctgctcggcagccaacacagaaacactgctgtgtgcttagcccaggggtgggagggatttctgcccagggattggccatggaattggctgcttattttggcagctcccaccacaaagaccatcagacgctgagggaaggcgaggtgggagttagtgagtcatggccatgcctcagggagggagggagctttcaccagaggtgcccctggaggaagcagacttcccctccaaagaagaggggtgggactctggatgcttcctcccagggtcactggcttaggtcaactaaggggatgagcatccccgtggcgttctgtgtaatgggaataatggccctgacctcacagtgccgtggcagcaagttgaaaagctagcacatcaagctctcagtgaagggttgctttcctttccttggtgtgccttaggatatgacggggtaggcaccatgggtgcagacatggaggaaaaccagaagcaaatcaggagtccagctgcccacatccagtcactcttgattctcgtggtttctccagtgcccagctgaggctggccatggtgggaaagtgggactttgctctgtgctgccttctcctaaccctgtgttgtcctgaggccaggcagacaggccccagtcattacctcaccgcagggcccctgtctgccagagtgcatggtggagctgcctgggtggagagcggagctaattttagacctggagactctttgccaacagctgtggctgggcccaggcagctgggctggatggctggggggagtctcagccgccctgcagggagccctggacacagcgctccaggtctgctcttgggggcatattcctgcctcagcctcagctgtggggaagcctggatgagggtccctctgcacagagggtgcttccttcctccctcttgcatcaagatatttctgtcctccatctcctc

SEQ ID NO: 10621 - DNA, 1045 bp, Homo sapiens
ccatgctaacactaataaaaagaaagcggaagaatagatgaatccactgttagagttgaagacttcaacatctctctagaaattgacagatgcagcagccggaaaattggtaaagacataattgaacttaacagcaccatccgtcaactggatataattgacatctatgaactgcttcatccagcaatagcagattactaattcttctcaagctcacatggaacatttaccaagattgaccatattcggggtggtaaaacacaccttaacaaatacaaaagaatagagttatacaatgtctgatctcagaccacgatggaattaaactaaaaatcaataacagaaagataactggaaagtcctcaaatatatggatatttaaaaatgtgctttcgaataacacttatgtcaaagaagaaatctcaagagaaatgtaaaaatcttgaactaaatgaaaatataacctaaaatttgtgggatgcagtgatagcagtgcttagagggaaatttataacactgaatgcttatattagaagagaagaaagatctaacatcaatgacctaagcttctaccttagaaaactaggaaaaaagagcaaattaaatttcaaaaacagaagaaataatgaaaattggaacagaaatcaatgaaattgaaaataggaaatcagtacagaaagttaataagaccaaaagctgtttctttaaaaagatcagtaagattgataagcctctaagccatgctaactaagaaaaaaaaacaaattactaatgtcacaagtgaaagaggagacatcactacagatctcatggacattaaaagtataataaaagaatattatgggctgggtatggtgactcacatatgtaatcctagcactttgggaggcagaagtgggcagatcactttaagctcagtagttcaagaccagcctgggcaaaaccccatctctgcaaaaaatacaaaaattatctgggcatagtggcttgtgcctatagtcccagctactcaggaggctgaggctggaggatcatttgagctggg

SEQ ID NO: 10622 - DNA, 1028 bp, Homo sapiens
tctttgaaagacacaatctgccaaaactcacacaagaagaaataaaccatctgaatagtcatatctactaaggaatttgaagaagtaattaataacctttcaaaacagaaagccccaggcccagatgggtctgcagatgatttctactaaacatgtaaggaggaaattatgccatttctctacaatctcttctagaagatagaagcagagggaatactacctaactaattctatgaggccagcattaccttaataccagacccagacaaagaccttacaagaaagaaaattacagattaatatctcttatgaacatagatgcaaaaatcctcaacaaaatattagcaaattgaatccaacatgtgtaaaaagattatacatcatggccattttttctaggtatgcaagggtggttcaacacttaaaaatcaattaatgtaattaatcacataggcaaaaaaagaaaaattacatgatcatatcaatagatacagaaaagatatttgacaaaacctgacacctattcatgatacaaattctttttttttttttttaagacagtcttgctttgttgcccaggctggagtgcagtggtgcaatcttggctcactgcagcctcaaccttctgggctcaaacaatccttgctctttagccttctgagtagctgagattacaggcgtgcaccatcatgcccagctaatttttgtatttttgtagagacggggttttgccatgttgcccaggctagtcttgaactcctgagctcaagcaatctgcctgcctcggcctcccaaagtgctgggattataggcatgaaccaccacacccagcctgatttgtgatacaaattcttaataaactaggaatagaggggaacttcctcaacttgataagcagtatctacaacctacaactaacattatacttaatagtaagaaactcaaagctttcccattgaaatcaggaacaaggcaataggccgggtgcggtggcttacgcctgtaatcccagcactttgggaggccga

SEQ ID NO: 10623 - DNA, 1057 bp, Homo sapiens
tttattttttattttatttattttttttgagacagagtctcactctgtcacccaggctggagtgcagtggcgcggtctcggctcactgcaagctccgcctcccgggttcacgccattctcctgcctcagcctcccgagtagctgggactacagacacataccaccacgcccggctaattttttgtatctttagtagagacggggtttcaccgtgttagccaggatggtctcgatctcctgacctcgtgatccgcccgcctcggcctcccgaagtgctgggattacaggcgtgagccaccgtgcccggccaagtgcatttttaaatgaatttttaattttagaatagtttttcatttacccaacattgcaaaggtagtctggagagctctcactttgctcacacccagtttcctctattattggcatcttgcattaagccccggtacatttgtcatgattaatgaaccaatatcggatgttattattaactcaagttcatactgtatcctgaattcctttcagatatcccttttctgttcctagacctctgtagtcattgggtctccctaagttcctactggccatgacagatttaagcgtttttttgatagtgtcacttttgtgatatatatggcaaccttttttcacataactatatgttttgaacacctttctgggttagtgtgtgtggccttccacacccttttaactcaccacagtgttctgttgagtggctttaccccatcattttacactgcccttggcacagagcccccgtctggaagtgtcactgggcctgggtgctgtctggtggattagacagacgcttccactgtcttggaatttggacactgtgggaacagagaacatggatgtaaatgacctgacagagctcagagaaaaggagccacgtggcctggggcactgctgttgtggcgacccttcaccccacgccctccaccctacatccctcaccccacaccctacgccctgcgagtggctctgtgtttacatacaagagtttacatctgtggtggaagcactttctcacaaaagg

SEQ ID NO: 10624 - DNA, 1026 bp, Homo sapiens
gtgaggtctttgaaaccaaacagaattagtttgaatcccagtttagctacttttaagatctggggcaaatcatgtaaactctttaaacctcagttttatcgttaggaaaatggggagaatagtaccttacagggctgttgtgcattggaaattaattcattcatttacctaattcatctttccagctgaattatgagggtagaggggtgaaacaactgggctttaagatattaaggaacttgccaaaggtcacaagctaaaaagtggcagggtgggaattcagttccagatctttctgctctgaaagtggttcttacccatcttcaatcatccactcagagccaaacaaggcagctatgcgcagttgtctcttggtatccacgacggattgattccagaattccccatggataccaaaatccgaggatactcaggtcccttatataaaatatggtgcagtatttgcatataacctacatacatccttccatatgatttttttaagactctgggtctcactctgttccccaggctggagtgcagtggtgatcatagctcactgcagactccaactcagggactcaagcagtcctccctcctcagcctctaggaccacaggcgtgtgccaccatgcccggctaattgttgttgttgtaaagatggggtctgttgtgttgctcagcctggtctccaactcctgggctctaagctatcctcccacctcagcctctcagagtactagaattacaggcatgaggcactgtgcccagcccctcccatatactttaaatcatctgtagattacttctaatacttaatacaatgcaatagcatttgcagttacatagcattgtaaatagttgtcatgctgtgtatttttaacttgtattttctattatcgtattttttatttttatttttctgaatattttcaatcgctattggttgaatccacggatatgaaacctgcgggacctgtgtataccaaggactgacgatatacataatagatgctcagaaaatcta

SEQ ID NO: 10625 - DNA, 1044 bp, Homo sapiens
catgggatagagggttttggagtaaacttttatcctctaaagctatccatgcgtcttagcaacatctctgttgacccagctatacatgggttagatagagttgtatagagcagttccctctggtcctttgacccgtgattttagcaaatgtgtgaggctgaggactatagagatctttgaaactgataacagtgtcaaacaatgtaactggcctggttttccaggagagatgaactatttcagacattctattgccatagccagaccacatatcctgattttgagttcagaaaatatggttattaacacatcaaataaccagttgatttagtaaggtcctcacttttctattatcatacttttccctgtagacatagagctgtatgggatgtaaaaatcctgctcagtagtttaattggccatcataacggccgatgtctcattgcattgctgaaaggtaagagtagatcagtagaaattatcttatgggattgtgactaatagtatctgaactaaagtaggtattttgacaattttcctgaggcaggagaatctcttgaacctgggaggcggaggttgcactgagccgagatcgtgccactgcgctccagcctgggtgacagagcgagactccgtctcaaatagatatatacatatatgaattggagtgttgctttcaaaggctctgactgttttatctcaactttccaagaaatacttgcacattgtctgcctgcatgggaactcacttttccctgggaactcacttttccaggggatattctgaatagtcagctcttccatcctgtaaagtttcttaagtattgtaaaactaactccatatgtttgtatctttgataccttcagctgcattttaggtgcctttgcattaaaaacgtaatgactctcggagaagtcacacccccggttcaggaagaacagtcagttattcagagttaagctgttttcacagggaagattcagaacatcgccctctccccacccctgagtctaatggcgttagaaggatgtgcggtccttctg

SEQ ID NO: 10626 - DNA, 1091 bp, Homo sapiens
agaccccggggcttcttagccaatcatgtacgttcaccctggatcctcaggtcctttgcatgtggtggtgtacatggaaccagccctcccaggcctctccttctccctcgctttcctagggccctggtagggcccgtccttcccctcttgcatacccttgcccagggacaagccctttctaatggagccctgccccaaaagagcttcagaaagacctttccgcatctccccctgtaggtgtcacccccacacccactgcttccacttctttctcgggcttactctcagccccacctctcctgttggcattcatgagttgcctccaggctccctactgatggagggagcttgcttttggttggggtcggggttaaccctttagctccctgtctacccccttgtgatggacttgcgccatccgctgggttgagcagtctccacccagttacatctgtaggcgggcaacgttcgtttccacacgagcaagcagtaagatgtggagtgatgggtgaggtgaatctaactcatttggggccgacgatactactcccagcgtagatcagcagatgattggaacagattctggagatatatatcgggctcccttgccatttaccatgaagtgatgtgtgtgcacgtggcacattatctgcaattttactcagtgaaataaaactcttagcatagtgccttgtatatgataagcactcggtaaaggtgagctgctatgaatattgccattattacaactacttaggagcaaaagcaatacatcctgccgtgtaccttcggtaaaggtgagctgctatgaatattgccattattacaactacttaggagcaaaagcaatacatcctgccgtgtaccttcggtaaaggtgagctgctatgaatattgccattattacaactacttaggagcaaaagcaatacatcctgccgtgtaccttcggtaaaggtgagctgctatgaatattgccattattacaactacttaggagcaaaagcaatacatcctgccgtgtaccttcggtaaaggtgagctgctatgaatattgccattattacaactacttaggagcaaaaacaata

SEQ ID NO: 10627 - DNA, 1024 bp, Homo sapiens
cctggacagacggggagtttggggcggcatgaagctggagcgcggccagtgcagggaaggtgggagtagatccagagtttgatctggacgcccttgggcatctgggcaacaagaggacgtgggtttgatgattggcatgggatgaggcaggggggtgggggacaccagagacccagcggtttgccccattcctgggcctgcctggcagacgtgggtttggtgattggcatgggatgaggcaggggggtgggggacaccacagacccagcggtttgccccattcctgggcctgcccggcacagtcattaccctccctcttccgcgccctcctctctcgttccagctcagacttccctgtcacctaggcctcttgccaagtcccagctcctaaggctggtgcgattccatcccttgaagtcaaggattgcttcattgttctgccagacagccctttatcccttaatccttgttggcctatatttttgtttatttacaggacttaggttggataggaaaggaatgccttttttaacagaaaagtaaacatgtttttcattgtttatcgactttatggtcagtggggaccataagctccaacagatcattctgctctttcttggaaacaagattacagggctgttctcccagagggccatggaggttgggtaaaccccagagtggtaagtaactgccctaccaaaaagccatggagcccgcagatcagtgtgtttaggccctggggcctgtggcaggcagtgtgtgtcccaagggaagtataggcatggtgaggggagttgtagcagcccagagggcatcaccaaaggcaccttgaccacattccagccctgctttaatgagtgagcaatccgggccgggagcactggacgccttttcttatcatctgcgaggtcgaagggactggaacacaggcttccttgggtccttcctagcacggagtaatctagggatgggaaagccggctctgagcggagaatcccgggggctgaggacatcgctgagaggc

SEQ ID NO: 10628 - DNA, 1112 bp, Homo sapiens
gtccatattcatatcttaatgatactgagaaattggttaaattggtttttggtgtctgtctcttgcttatgaaagataaactgtagttcagctatttattagcattgagtttttctagaatagttaaatttttttgtttgtttttgagacagggtcttattctgccccctgggttcaagcgattctcctgacccagcctcctgagtagctgggattacaggggtatgccaccacgtccagctaatttttgtatttttagtagagacacggtttcaccatattggcccggttgatctcgaactcctgacctcaggtgatctgcccgcctcggcctcccaaagtgttgggattacaggcatgagcctctgcacccagccttaactgctttattttaataaagttgtaatatatttgagatggcaagaccattctcttcagactgttaatggtaattttttaaaattattttttatttttagactgggttgcacactgtcacctaggctggtcttgaacttctagcttcaagcaatcctcctgtttcagcctcccaaagtattgggattacaggcttgagaaaccctcttaatttaaggactgcagaagcttactttttttttttgcataagggcctttgatagtcattgtttatggctacaaactaatttgattttgactaaattatctgagttataaacttcatttatttccaccttagttattgtaaccatccttaattcatacacaaaaaagatgctttaaaaaattagtaaaacactctcgttataaaaattaggaaattagaggaggaaaaaggaaataaaaaatcacctgcagtcagtatctttatccagagataagcattgttactgtgtatgacacactggtttctgtgtgtttgaactctgtttttatagttatcgttatattgtatggttgtacagtttgcctgttttaccacatagcaaaagcattttcccatttaagatcttgaggtttttagattaaaaagcagcaaaatatttgtacacagtaatcataattggggtgtgtgtgtgtgtgtgtgtatgtatgtgtgtgtgtgtatgtataggggtgtgtgtatgtgtatg

SEQ ID NO: 10629 - DNA, 1075 bp, Homo sapiens
tgttaatatatgtaaagcaccagaacagggtctggaagtcaataaatgttagctattattaggtgtcagttattaacaaaagcttgaaactacattattagcgtagttcttgtgggttcctgtgtttaatgcttgcctggttcttaacctatattagctttctgtgtgtttaaaaaaaatctttatcttttgtgtaagtcggttttccttattcttacacactttaatgtatgtaggctgctctgttgtaaagaccatctgtcttctgctgggctgaggacctctgtgcatttccactctttgaccatctcaggacaggcacaacaaaaaaatgttaaaaacttagatgttgtcatggatatgtggatgctttacattgtgtgtgtgtgcgtgtgtgtgtaattttagtgtgaaaaatggtatcaggtttctccaaggcaacaaaaccattaggagattttgtatataacagatagatattatatgtaatttcaaggaattagtttacttggttgttggggctggcaagtctgaaatctgtcttctggttgagctggccattgggttgggaactctagcacaggagctgatgctgcacctttagccaggatttctcaggaaatcccagtttactgccttgtaagtgattagatgagacccaaccacataattgagggtagtctcctttacataaagtcagctgattgtaggtttaaccatatctacaaaaatacctttatagcaacacctagttagtatttgatagaataattgaatactgtggcaaaattgtaacataaaactaaccatcacagatgagtatattatttcacaatagattgtccttcatatcagcttcttgaaattaaaaaaaaagctactgtgtgtaatactatatggaaattaaacattgtccatatttttagtaaaataataattcatagttatactctgctaacatgagatcaacttatgcactaatggaccatatttctaaaagtttgtgagttgtttgttgacttaagtgagaaaggcctgtaatgccagtaccggaaatgattgttcccagaataac

SEQ ID NO: 10630 - DNA, 1677 bp, Homo sapiens
acctaaagcttcctgtatatgccaagtcccaggtattttggaatcccatgtggcttttgtgccctccaaagagaggtggagagaacctcttagactccaacttttacatactcttggcccagatttggggattaagtgaagggtgcctaatgaatagaacctatgcattcgtatacatctggcttgagaaaactgtatctctctctttttttttttttttttttgagaaggagttccactcttgttgcctaggctggaatgcaatggcgagatctcgactcactgcaatctccgcttcccaggttcaagcgattctctggcctcagcctcccaagtacctcggattacaggcgcctgccaccacgcccggctaatttttgtatttttagtagaaatggggtttcaccatcttggccagtctggtcttgaactcctgacctcaggtgatctgcccaccttggcctcccaaagtgctgggattacaggcgtgagccaccgcacctggcctcctatctctcttataagtagacttttcttcttgcttctttgaaacagaaactttttgtaaataaataaagtgtataaaggtgagccatattgggaagaaggggctgatagaggagttagaacaaccaggtaaccagatttttttttcctattcttttgaggaaaaaaaaaaaaaaaaaattttttttttttttggtctttctgaaactggtgctatttcagaatgataggtaaaagtctccatggagaagcaggggatgtgatgccatgtttacctgcccctcccccccataattatgatatcttttcacccattgaggaaagttgggctcacatagactctcttctttatgcgatagaccccaaatttcatctcgtaagagtaccagactggaaggtcataaagaaatctgcagtaggaatttaatctgtagatttggccacataaaatgcaggtgtaatttttatattatacttcaaaacaccttgaaagccatgttagtctttttgctatctttaacagttaagaatttttgcatgagaattattattttgtttctagttgtagtttttccaacctttcccaggccttcaatctctaattctgaagtttttaagaagagttagttacctacagttaatacttctgtcatctttgaattgctgttataccatataggcctatgagagagttgccagacttaaataattatttatatgcttaatttcttttaacacatagaataattctttaaaaaattgttttctctgtaaactgtaactgaaacccatgctgccctggaaagcaatgttacaaactgctgtaccctctgcctgaagacaagtttttatttctttatcctaatacccaacaacaattagtatcactttaaaagataaaatagaggccgggcacggtggctcacgtctgtaatcccagcactttgggtggctgagatgggcagatcacaaggtcaggagtcccagaccagcctgaccaacatggcgaaaccctgtctctactaaaaatacaaaaattagccaggtgtggtggcacacgcctgtaatcccagctattcaggaggctgaggcagaattgcctgaacccgggaggtggaggttgcagtgagcagagattgtgtcactgcactccagcctgtgcgacagagc

SEQ ID NO: 10631 - DNA, 1049 bp, Homo sapiens
tatatagaaaaggcaaaagaaacatacagtgagcacacactcagcaccaagattctgttgttactaactttttgcatcacttgccttaccatattattaatatgtccatttattcatcctccatccatcttattcattccataataaaataaattgtaaaataaaataattcaatatgcttcacccgtaaacccttcagtatgcatttcgttagagttccagtatttgtgtactttatttttcttttacctccaaacagcatcaggatagaataaattattattgtacgattgaatgagttttgacaaggcattcattcgtgtaaccaaaactctcaagatagagaacatttccatcatatcggaaaatgcccttatgccgctttccaggcagccttttccttaccctccatccagcatgactgttttgatatattttttaaaccataaaacccacttttgctattagttttcttcaattagcccacccaaatgaagtaaaattttattttagttctgctatttgatttttagttagatctggatctctgcatgtttttcattttaagtagttgccctgaagattacatttacgttgttacttttcacaatttatttaggactaatactgtacaatttcatgtaaaatacaagacctttgcacaaataaggttttcatataacccctctaccgcttgttctgtatgctgtaattttcatatcttatacaagtacaagattacataagtaatttcatatcttatacaagtacatagataagtcattattaaatgggagtaattatagtacctattcaacaaaattggaatactaaatgcaggaaacagtgacagccaaatgttaacagtatagaaaattttacctcaacaaatagagaatatcagtaaagacatagaaattacaaaaattaaacaaattcaggaactgaaaaacaataattaatagaatatgtaagcatatcatatatatcacagtattatagattttcctttaaccaatcatgtgtgtattttaaagatactgaaagga

SEQ ID NO: 10632 - DNA, 1027 bp, Homo sapiens
tttctacagctgtctaattgaaacctgaaaggtagttgttatgattcattttactttatcactacatgcttcattatgctactctaaaatacattttcttacataaccatattatgcctgaaaaaattaacaatcatttctgcatcatccaataccctgaacctgttcagatattctctccattgtttcaaaaatgtccgttgacagtgttcaaaataggctccatcaaggtccacaaaatatattttattgttgtagttcttaatctagaactattgcttttactttctttttctgcatgcatgtcagagatttattgagaaaattagattatttcgaggaatgttccacattctgaattttcctcgtggtgtcatttaactagtttattcttctatatttctgtaaggagaagtttaccttaaaatggttggggtaggttaacaatgtaaaaataattttgtcttttttactcgcattcacccaagagtgtacgttgttgttttccagaggctatatgatactgcacatatgatattgcagcagagtacatacagaagcatataaaagaattcatttgtagggccgggcgtggtggcttatgcctgtaatctcagcactttgggaggccgaggcaggtggatcccttgaggtcaggagtatgagactagactggccaacatggtgaaaccccatctctactaaaaatacaaaaattagccaggcgtggtggtgcacccctgtaatcctagctactttggaggctgaggcccgagaatctctggaacccgggagatggaggttgcagtgagccaagattgtgccactgcactccagcctgggtgacagagtaagactctgtctcaaaaaaaaaaaaaaattcctttgtcttccattaaaccatatatttaaaaagattacaaaaatgtaaaacaataccagtcttatcactaaatttttcttgttttggaaaatactgactttttaattttaaatatatatttgtaacataatgagttataatttt

SEQ ID NO: 10633 - DNA, 1027 bp, Homo sapiens
ccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggcctgtaccttctcttaagtcagcttgcaatttaaatttttagttagtaaatttaactaattttaaaatatgttagtgtctgtctgcttaactattgcatacttattaaagaaacatgcgtggttatccattggaagagatcgatcctagggcttcctgatacaaacacacccacagaccccagccactctagatttctggttttcatcccaggtctattgtgtataccctggctattagtaaccagtaaaccactctcccccttctgtagatttagtactaacttagaaaaaggatacaaagaagagtttgtatttaacagctcaggattgccttttcaggtggaagaaataggctctggagttggatctgcttcctttcaaattccggcaatgtcattgcctagctgtgagaccttgagcaaattatttacttctctgagcctaaagtatttgtgaagattaaatgagaaaggcaaagtgcctggcatacagttatcaatcagtacctaataggtatcaccattatcatcaacatcattattattaatacatatttagtagtgaaataaggtgtctctttttatgttaaccagtgacattcagcaaattgcattaatttaaatgtgcttcctaagtgtcacataaaatcaagctttaaatgggagaacaagctaacatttatttgtaatcttgtcgatcaccttgcaaagtgctttacatatactgttttaatcttttatatcatgataagtagataatgtcttcatttc

SEQ ID NO: 10634 - DNA, 1063 bp, Homo sapiens
catgggttcagtgttcaaaatagttaaatgctgtattgatttatgtgtttagggaacaaggttgaacaaaagatcttctaaccaattagaacatttagctttcttttttaggcaataaattcctttacttgaaacacagcagaagatattaacatctgcctaaattttttcattgtcacatatggaagtaagtgaccctgctgtcactgttccatgttttcttgtgaagagctaagttgtcactacccaactgtgacactgcatggaccaactcctgcaggcgagtcagaaaaaaagccgggatagtaagaaaggaacctaaaagaaccttaattggaaatttaaaaaacaaagttcaaaggccctgcttttattaatgtatttctgtttatggttttcagggggtgaagccagccagttttgacaaagtagcaattcctgaagtgaaggaaattattgaaggatgcatacgacaaaacaaagatgaaaggtaagttgcctcttttgatctgggtgatacttgaacaaaacctaaaaagtaatgtgctttgagtacaacacacattctacggtgtatttaatatttgtgattggtttctctatttgtgcctgtaacatttttaaaggtagggttttgttcattgtggttattcagatttgatatactggaacactgtaaaaatatggtttggtagagtttcagtaaaccagaaccaccataaacatagctacattccatgagaactgcttacttaaaacatcagcatgatttataaaactcaaaaaagagtttaatatctaacacaggaaatcttttcttagtcctttaccattgaattctaagtggtgaaataaaactttggctctttaaagtcagctcagctattacaggtctgatttgccgtccttacgccagaattgaagaagagcaaaacatcaaaattccttgagtaaaaagagaagacttggcccaggggttggaaggagatgtggcttagtcatttgtactaacagagggcttctcttagaggagtggcaagtatctgatctgccatgtagctga

SEQ ID NO: 10635 - DNA, 1005 bp, Homo sapiens
aataaccttggagtgaacatttattttaatttaatcatttatgtaagatgatgtatcagcaaaccaaagaactacataatgttcccccatggaagtattttttccttaggtttcaacctaaggtgggactgtagctctaatgaatgcattagatgcatatatagtatgtatgactttctttggctccattaatgtttataaaagatctatcttataaaattattttaagcatgtgggtccttgctgcttttccaaataaagaatatagttaactttctgaactagcaaccccagaattttcagatttttacttaggagaatgaagaactatacagtgttattatggctttgagacataccatgagtaaataacaataaaatgagcattctgactgaaaatagaaatccttatttagctattgtgaacagttgatctactttgccagctcgataaggatcttccctatggaagaatgaaactgaattcttttaaaaagcgggggaggctgtgatagtgaattcttactattatttacttatttatttatgttttggagatggaatctcgctctgtcgccaggctggagtgcagtggcacgatctcgactcacggcaacctctgcctcctgggttcaagtgattctcctgcctcagcctcccgagtagctaggactacaggcgcatgccaccacacccagctaatttttgtattttagtagagatgggtttcaccatgtttggccaggatggtcttgatctcctgacattgtgatccacccccttcagcctcccacagtgctgggattacaggcgtgagccaccgcgcccagcgggtaatgaattattatagtgtatattgtttgcatttggcaagctgtgtttctaaatttagtcttaaatctagaactgcttctagaataaaaagtgctatcaaataaaattggctgtcatttatattacccttttcagttgattagaacaccaggatgtcagaatcagaaaatt

SEQ ID NO: 10636 - DNA, 1091 bp, Homo sapiens
tattatgaatctgacgattctagccagctaaaattacagcctgagcagcattgacagcttaggttttcactgtcagtgggttttgcatgggttgggatcagaacatgttgtgtggtatgatccttttctaaatttttcttacaaaagttgacccagaggcctctcccatacataatcaggttaatgtttcattttgatcaagcaaactctgaggagattaaatattcattgcaaaagcctgacctctatacacttactttaggccttctctaatttgttgtgttcacttctttccttcaggcacaggggcagagccagggtcagccatcctcaagtagcttaacaggggtttcatcttcccaacccatacaacatcctcagcaggtgagaacaatgcattgcaacattttatgaattagcagtggccagaacactattttaacttttgtgatttgttatataaatggcctgctaagtttttgaaaggaaaattaagaggcataccatgtcttgtgttcagtaacaaagaaaaaaaagagacttttctgtgtttcagaaaaatctcttttgtttaatatacttttgaacaatttagtagacatacattattactgatataattatctttttaaaagaggattctacaccttttttttgagacaaagtctcactctgtcacccaggctggagtgcagtggtgcaatcttagctcactgcaaccaccgcctcccaggttcaagcagtcctcctgcctcagctttccacgtagctgggactacaggtgcctgccaccacactcagctaatttttgtatttttagtagagacggggtttcaccatgctggccaggctggtctcaaactcctgacctcaggtaatccaccctcctcggcttcccaaagtgctgggattacaggcatgcgccacctcacccagcctggattctacacataatttacggtacaaagagtatgtcattccttttctctttttttccactgcttgcagcagtgatttgtcattaccttcattgtgcttgcctctactaatcctgcacttctttttaattatttctaatctgtagaatgatg

SEQ ID NO: 10637 - DNA, 1032 bp, Homo sapiens
gttgaatttccataagaaaagtactaattgtgaatctgttgtgaccaggaaaaatcttctgacatgagacaagccagtaaacttttaaactaaattaggaatttatttttgaatcatatataagaaataagaaaaacatggtaaattgcttacttgagaagctgagttggaatttatccctatttctttggtcccaatgtacaggggaacactatttgaggaacttgccacaatgaagtaaaaaccccaacagagaaagcactccatcagccaccacatttgggggaaagtgcattgtgaaagtccgtaaatcaggagttagaaaattagttttaaacttattttctcatttaaaaacatggattcagatttctaagggagtataaagtgtgacaaaaaatagcaagtgagacatgtggaggggtaagggtaaatagctagtgcctagatagagggaaaggcctaagcaaagactgtgcaagaatagattgatagaagccaagacagatgtaggattagactgtggaagggtagaaggaagctgtgtgcttgcggtggatggaatggttaacaggatggaatacccagacctccttgccaccatctgtagggaagaagtatacatgtaagaaagaggaaaataataccctgtgatagtgacagaatatgttaatgccatcttttattcataggggcaccttcccagaaagatgtataaaactgagaaagaaaagagggaacatgagatacagtgaatctaccagtagatctttgtacatttttcacaatatattttaaaggtcgcacaaataaataactctttctaccgttttgagtaacatcaaacatagaatgtaataagacttctcttaaactgcaaaaacatgaactactctgagccttgagagtctgacatacaatcttgagaaactggcaaaataatcaaagcagtacactaaatttgagtatagttttgtatgttccataaagacaaatgttatgttgtgccaatataaagcataaaacagtgtg

SEQ ID NO: 10638 - DNA, 1120 bp, Homo sapiens
cataaggaagctggagaactcaatgtaaaatcaaacccatctgtaatttcgagtgggtggagctcttgcttttggtacatgccctgaatccctcactccctcaagaatccgaaccacaggacaaaaaccacctactgggctctctcctaccctgccctcctcccttttttttacccctctcttttttattttttctttgctctttagaacccagtgaaaaataccagggtactggggtgcaactctttcttatgataggtcattagtgctttaagcaaaagatattagcagctttgactgcagcattagcaattaggaaaaaaaaaaaattaagttccctgcggacatgtaactttgccatcagttttgatgtggaaacactgtgatatataaaatgttgttggacaacagtagttttaagagtaaaatatgaaacgtttaaaaagttccaaaaaaagctagctctgtcctttacttattgagacactttaactttttcctttgtatttccattgtattagataaataaatgtgaatgtaaaattgtataaattactgtacttgaatacttctgtttcccagtgttgcttgctggacattttagtgccttggacttctattgcttctgccattagcatcaacttaccagaccccagatcaataaagggcatgtggaaggaaatcgtaggtccatgtgaccccagcagtccagcagtggttatgccaaagggaaattgaaaaagtatttttttaagtcattcaacaactttgtctagagcaggtgtaagatgagtagggtgggaagttaggttggcatcagtggttaaaaacagaaagttctgtttcgggaatagtgaggagggggtgttgtaacaaaattggacaacttaaaagaatggtgtgtgctgggtgaaagacaaagactaaagaatgaggaaacaaacgtgatgcctggccagtgactgtcatataaacctttcttatttgagctaggcttgaacagacgtgacctagaagaaactgaacataaagagaagggggtggggggctagttttcaagttggggaacctgatagtgaaaagtcacagatggagaaaattgctctcagaaaaactgttt

SEQ ID NO: 10639 - DNA, 1051 bp, Homo sapiens
agtgatggacaagcttttcaaaagtgctcagctctaactgcagtgggctctcagtcagatcctcttgataaggttcagaatgaagcaagataaatcgcaatgacgttcattctccagcagcgatgaacaatttcatgaccaaaaagtagttttccaaagtccctttgtgacagagtccaattatgtggcctgagcctcagttaagatggatcatatttccttttcttcatgtcctggctcttcctatgagattcccagtttcctatggaagacaaaatggcttaaatgtagctgccataattttaaaataaactgacagctaatgatttctggattatattaatgatcctaatttagactaagcccaagaatgagaattactgttaggaggaaggcagatgattctcctagaccaagtggcctcgtgctcatgacagacctgctgctgggagggacagctctccatgcagtcgtttccgcttcctgctattatcaggagctgaaaagggctgcacctgaagtcaggagcccaaaggaaacgttctggctcttaaatcaattctgttctacttgcagtaccattccctaatagaagttcccgattctatcaaactttaaatgaaatgtcatccttcctcaaaaattcccagaattaaagctaggatctccccttaatttttgtgcctaaacacctctctgctacctgttgtgcgttggtcagcgctataagtttggaggtcccaagatccagattttgcttgtggtttctggtggcaaacgctgtgtggagtcctgttctgggtcaccatctggttgttcaaggctaatgtgtcagaggtctgggctgggtctgctctagacgagggcttgaccacaccatcccctgcatcgggagtcacagcccacttttcagagttgtcttcaagagtctctacagaggtcaaggaaaagtgcgtcatcagcaaataatgaagtattctcacagaaagcactggaaaaactggccctcagaaattccatgtcttcagtaccttctgaaagtttttggaat

SEQ ID NO: 10640 - DNA, 1073 bp, Homo sapiens
acttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccaggtaagttctacgtgtgtttacctttattggctgaattcatgtatataaatgaaatagcctttttttcccctttcctagatttttcccttcgtagtatatgtatcttcctttttcctattgattttactgttttgtgtcctccatttctcagccctttccaaatttggtcctgtaccctgttttcttctagctgcccatgtctccttgctcccattcttgcttggttcttttctctggtttctctttctcttcgtgtctttcctttcagcatatgttatcttttttttttttttccaattcttctgagagtataa

SEQ ID NO: 10641 - DNA, 1062 bp, Homo sapiens
tctgtatttgtgaaggttaactgaaccttttttgtttgcttaccatctattcagtgttttccctattctttgttctatttatttagtaatttaaaaaattgactcattttaaaaaactgaatcttattttaaaatgaaactgtcactactacacgtggaaaacatttgccaaaaaataaaaaatgaaagtgtaaatacataactattaagaaaaaggtcaggccgagcactttgggaggccgaggcgggttgatcacgaggtgaaggaatcgagaccatcctggccaacatggtgaaaccccatctctacaaaaaaatgcaaaaattagctgagcgtggtggcgcgttcctgtagtcccagctactagagaggctgaggcaggagaatcgcttgaacccgggaggcggaagttgcagtgagccgagattgtgccactgcactccagcctggcaacagagtgagactcagtctcaaaaaaaaaagtcatatatgtaccactctgaagattatttttaatatcattttgggaactactagcgattctgatacagatagttttgtcatcatacttggagaaatattgaactagagacaaaaagtttcacttagattgcatgattttcagctactgttgcacacttggaatctggggcatttttaaaatacttttggtcagcccccatcccccgatttaattggtgtgggctacaacctggacatcaggatttttaaaacactctcctaaggtaatcgtaatgtatattctgggttgaggatttagaggttaaaaagcatataatgcagttagactaagaagcataaattcatgaatactaaaatacacttatctcggtataattagaaataaagaagactggctgggcatggtggctcatgcctgtaatcccagtggtttgggaggccgaggcaggaggatcacttgaggcgaggagtttgagaccagcaagggctacatagcaaggcctcgtctctaccccaaaaaaaaaaaaaaaaaaaaaaaaagggcagaagaaaaattagacaggtacagtggtaggtgc

SEQ ID NO: 10642 - DNA, 1033 bp, Homo sapiens
tgttaatgggtgtgtggataaatattaattatgaataaatattgcctttttggtgataataaaccgctgtgttttatttcacacttttgagtacaaggaataaaaaaatacaacttttctgggcttgagataagtgctctttaggttaagctataacaccgaagagaaaatagtgctccattaacttgtttcatcagtcttttaggcaaccaaatgagaaaagcaaagaaaaacagtacagtctagattgtatactccatctgagaaaaaacattaaaaagtattacgtatctgaaaatgaaattgtcggacaggcgcggtggctcatgcctatagtcccagcattttgggaggcggaggagggcggatcacctgaggtcgggagttcaagatcagcctggccaacatggtgaaaccccgtctccactaaaaatacaaaaattagccggacatggtggcaggcgcctgcaatcccagctactcaggaggctgaggcaggagaatttcttgaacccaggaggtggaggttgccgtgagccaagatggtgccgttgcactccagtctgggcaacaagagtgaaactatgtctcgaaaaaaaaaaaaattgtcagctgcaatcattttatcctgtttttctgtttgaatagtttatttgaatagttcatggaattaataagttgaatttatttctatatctagaaacttgggaggggaagggtaaactgttatgtatggtataaaaaatttaaaagtgttgtgaaaatactattttcaattctaaaacgcttgttcaattctaaaatgacttgtttcccctatgcttgatatagatcaagagggaaaaagtattaatgggtattatttattcagcaaacattgagtttacattcaggactgtcaacttgactatggaacaattcaagtagctttcgttagtcttgcctagcttttcgttatgcattaaatatgtgcttcattcaggaggagatcaccccaccccagccaggttagttttgtcaggtagaaataatg

SEQ ID NO: 10643 - DNA, 1024 bp, Homo sapiens
ctccaactcttggcctcaagcaatcctacccactcagcctcctgagtattctcttgctgttttcagaatattcttttttattactgtgattattattatttttagagatagggtcttgctccattgcccaggctggtgtgtgatggttcagtcatagctcactgcagccttgaactcctgtgttcaagtgatcttgcctcagcttcttgaatagctaggactacagctaaaagattggccatccctggctactttttacattttttgtatagatagggtcttgctatgttgcccaggcttgtgtcaaactcctggcctcaaagaatcctcccgcctggcctcccaaagcattgggattgcaggagttagccaccgtgttcagtgtagaattctgtttttatcatttacttttgacaacttggcaataatgtaccttagagaggactttctttgggctgaatatgttttgggatctgtgaataccaaagattcgagggatatatgcctgtatctctgctgagacttcggaagttttccgctattatttcattaaacaggttgtctatgccatttaccatctcttctgaaattcccaaagtgcaagtagttgttcacttaatggtgtcccatatgccatgtgggctttattcttttttatcctctcttctttttcttctgagttttttctttttttttctttttctttttttgaggcagagtctcgctctgttgcccaggctggagtgcagtggcacgatcttggcttactgcaacctccgcctcctgggttcaagtgattctgctgcctcagcctcctgagtagctgggattacaggtgtgcaccatcacacccaactaatttttgtatttttagtagagggagggtttcaccatgatggccaggctggtctcaaactcctgacctcaggtaatctgctcacctcggcctcccaaagtgctgggattacaggtgtgagccaccgcgcccagccctgtctgagattttgcaaaagacctgtcttca

SEQ ID NO: 10644 - DNA, 1040 bp, Homo sapiens
tgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggtatgtgactacttttttagttttatgatttgttggttatcttttttttcactgattaatcagcatcttggccccagtgaatctacgtgctctgccgtgctggtggaagagaatttcatcctttgtatttaagtgcgtcactgatttctgttctgatttgccctgttgtatgggatgacattgtctggtatgtatgctggctcagtgactttctgggtcttttctctcctgctcccctgattttgagagttcatttgttgctaaaggggtaaaaaattccttgatttttcactcatctctagatctgttcatagagacaacaaacacaacaaaaccagaatcagaatagctaaccattgcttaatttaaaaatattagtaaaagagagtaagcggttatctcagcttatgtgtgcttataaaagtccttggcagcaataatggatatttgccctgtggtttccatggaaactgttgccttgctgtaaaagatacgtgataaaaatcattggctgccatggaggcatagctggagagagtgatgtagagacacagtgttacttatttttagctgacctaggtgactactgataattttttacttttctaaataatgtatcattttaagaaggcgtaaaggaagaaaccatcttatattgaattaaaaaattaatagccataataacttttctatatatagttggacttcaggtaattttcacttttgg

SEQ ID NO: 10645 - DNA, 1060 bp, Homo sapiens
cctcaaaaacaaacaaacaaaaccctaaatttatgataaagttttgtgtcatgatttatttggaggcatttccactatttcttttcagcatgtacaacagtggtgtgtcttataatcagtggcatcttagatttgatgaaataagatagcattaaaatggcatttgtagctattagtagtaacatttgtaattagttttacgttttctttattaacatgattttgtagctggcaggtaaataattctcccccccaaaagccgagaggtaaaaagtaagatttcaatgaagcattgtattttctgtttgtactcaaatcacattgttgtttgaccgcttattcttagcttttgtattatttcgctgtagctcctttcatttgactgttagaagagtggggacatctcttggacaaatgctgaattacaggcaagacttggttagtgctgagggcttgacaggtgattctgttatacaccaacatttgaggccccaactttggttttcagtccgctagcagaggatacctaagttggctgtggaatttttgggtcttcaatccatatgcataccaaacattgtctataggccaactaaataatatatttcagtatgtgctcctacttacttaaatgctggtatgctattgtgattaataaaatacaactttgttttaaaacattattgcagcctactagttttttgtctgtattttaatcaacaaaccgtattagtacaactgctatcgtgttaggtttgcaaaaatctttgaggttaaaagtgctaatatttgaatatgttctaggctagggaattctgaatctaactagcatatctgaggactgcttgtcagtttgtcagtattactggcagatagaaggtataagcagaggagattaaagaaaaaaagaaacatatatatatgtttatgtgtatttatttatatataaatatatatttttctatatataaatgtatatttttctatataaatatatatatttttctatatatatatatatatatatatatatagaaaaacatagaaaatgaataggaat

SEQ ID NO: 10646 - DNA, 1031 bp, Homo sapiens
gcagtggcgtgatcttggctcattgcggcctccacctcccaggctcaagcagtcctcctgcctcagcccccgcaagtggctgggactacacatgagcaccaccacacccagctagttttatgtgtttttcatagagatggggattcaccgtgttgcccaggctggtctcgaactactgagctcaagtgatctgcctgccttggtttcccaaagtgtttggattacaggcatgagccactgcacccagtcaggactttttattcaaatggatttttcggttttctttaggaattaggtgatgctcaagaggagaaatcagatgaaataagttgaaaatctaaattgtgtgttattttttaaaaaatgcagttttaatattttcaagtagatacagaaataccaaataaaaatgttgtaaagtataggttataaaattttgttaataaatgaagattgtttacagttagcagagttcattttatttttactcagacaatttaaagttcgacactcatttattgaacaaatactgttaaatatctaccgtgtgcccagtcaatcaccttgtagtgtgcagaacagattcaacatggacaaactaggctgggaggaggctgacgagtttgtcgttttaaggcaggtgagagattattatggcctaaactaattaatgtgttaggtgttgggatggaagaaaacaaataattttaagagattttaaaaactcttttttgatacaatatggaatgcatgtaagaaatagaataaaacaggtgtatagttaagtaaattataaagtaagcaccctcataaccactacctaggtctagaaatagaactttcacagccacccagaagtcctgtacgtgaaccaacccagccagaactctcccttccctctaaaagtaaccagtgttctgggttttatagttatcatgcctttgcttattatacttatcacatctgatccttactatcatagtattgttatcttgtattatatgttaaattaatatcattcctaggtatca

SEQ ID NO: 10647 - DNA, 1043 bp, Homo sapiens
acattcttaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaaggtaaggtacaggtgtttcgagttcagtggcccattcctcatacatcttcactcctaccactaagttatttctaaatgctgtcagagtttcttgctcatttttcagtttatatttttgtgattagtaatttggaactcttgttgcggtaggtagattgttaagactgctctatatattcagtttttaaaaatttaaacactgttagtatcttccagtagtgcttttcatgctgtttctcaaaagtgccttgtaaattgccaaagtgtttgaactgacattcttttgccccttctgtcttttattgaaactgtaccaaattggtttagtacatggacttgggatggtacaacttcatttatgtgtttaataagatgacaattttaagccgagaccagtagcatccagaccaacacataattcatatatgagcaaaaaaaatgtgtgtgtgtctatttcaatacaaatcttactgttccttagtgcttgttatttccccttttttcagttaatatattttggtattctttccaagggtttcttcattgttgttactaacagcattgtatggatatactatagcaaaatttctactgatggacattaattttgctaaaaatttcttcctttacataaaatgattaatagtaaaaaatgttgtacatgtttagtttatacatatgtcaagtcaagtatatttctaggataaagtccttaaagttgaactgctgagtgaaaggatgtgcatttataattttgatggattttgccaagtaaccttaaagagactgtaccaagtttcatttctactatccgtgatgaaagtgttatattcccacatacttgtctgcagagtgtgttaataggc

SEQ ID NO: 10648 - DNA, 1023 bp, Homo sapiens
ccgagatcacgccattacactcgagcctaggcaacaagagcgaaactctgtctcaaaaaaaaaaaaaaagtggattctttaaaaacttaccattgtcttttgaatatagaagtttgaaattctgctaaaagcagaattacagtcatataagtgcaaaagggaatttcttcacatgttgatatattctctcatcaggagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggttaagctccccaaaatggaattagtttgtttgcttaatcattgcatgtgtctgtatgttggtgtttacataatgcatataaaaaagtattcgatggaaaattttcttaatattcttttagcaggcttttgttgaataccttaaggaatatttcagaaagctttgcagagacatagcggattggttcattcattttctaagtattactcactttgttttatgttggttttttacttactaatatttttatagacctaaagtaactgaagctcagatacatttggagaaatagtgtgctaaagataagaaagttgacagataaaaggaatatgcaaaaggaggaaattttatgtatagcaactatcaaagaacacaacagctattaaattaggtgacttaatatactttggtcttgtttttggagaatcctgttaatatgacctaaatagcaaagatgcctcatgctatgtaatcagatgatgataatgcatgagctttagcatctttctgtggattttctttctaatatctttaggcaatgttatggaagtttaaattcctaatagaatttttcttttaatagggaaaaatgtgattttttttttttcttttaagagactgtgtctcactctgttgcccaggctggagtgcagtggcattatcatagctcactgcagtcttgaactc

SEQ ID NO: 10649 - DNA, 1004 bp, Homo sapiens
ccccttggcctcccaaagtgctgggattacaggcatgagccaccacacctggtgcatgtgcgcacgctatttctctctctctctctctctctctctgtctgtctctctgtctgtctctctctcactctctctctctctctctctgtctgtctgtctctctctgtctctctacacacacacacacacacacacacacacacacacacacacacacacacacacacacatatatatatatatattttttttttttttttttttttaagacagattttccctctgtcacccaggctggagtgcaatggtatgatctcagctcactgcaacctccacctcccgggctcaagcgattcttgtgcgtcagccttccgagtagctgggaatacaggcatacaccaccatgcccagctaatttttgtattttcagtagagatggggtttcaccatcttaaccaggatggtctcgaactcctggcctcaagtgatccgcctgccttggcctcccaaagtgctggggttacagggatgaaccattgtgcctggcctagatttttgttatacagatgtttgaggttaaacaactggtcctgcattacataagtaggtagcagagtcatgcctaacaattccagtgtctgtctctccttcctgaaaagaaatccttttcaggtgttcagttttcattaatgacctcacctcctagaagaggaggctgtagacagctagatgattcagagtctgttcacttgaggatcttactgaggccagagtctttcccacatgctggaatgcccacttacaggacaggtactgcataactggcatgtgggttgttttgctgctaggggccagtttttctacacatgtgctttttaatgcttctctcagtctggactcagttaagggatacgtctggctcaaagagactaagactccatcaatacagaagctattgtcatttcatttatagattatgctagcattggcgtttatctatagcttgt

SEQ ID NO: 10650 - DNA, 1041 bp, Homo sapiens
taagggagaaaataatagaggtagaggaagaggttatatacacttatttctcttactatgaacattttacttagaagtgtaaggttgtatgtcttgtttgatacagtgataaaaattatgataatgcttaacagaaatgggtgctttgctccataaaagtgctccgtgctttcctctgtcattatgaattaatcagcaagaaatccagaagtgaacaacataaaagtattccctctcctcctttttttaaacagtgaaaaaagttgacaatatatttattctgtcatagatccaaaaagccaagcctgcgttttaaggcagggttttctttggttttctatttctcagccacaccttcagatttcttggcacagtacagtcatagcattgtgtcatatccttggtctgttttatcagactttataaattgattctgactgtaccagcagtactagattcttatctttacacagtttgggaaatggacaatgactcttttggaaaaacagctctataaattgtgctgtggtatgtgagaatgggttctctgctttgcttttcctctagcctgctgccattcctagacagtgtcatttctctgatttagggcattgtgtagctgttctgggtagagtaaacctgcctctaaatgtggaacagattgttacccgtcagaattctccaccttggaatggtgacactgaaagatacaattcagctctggccaacacctcctgtcttcccagttcacttactctcgtctccactccaattattgcatctaattaggaccttgaaacaacaacctactacttttttttgtttgttttgaacctcgtatggcctcacacttccttccttacccgggtcagatttcatggtccagcagtataattactcccttctaaatccccttgacttacttgcttttctcttttgtcacacttgcttgcaaaacctcaatcctgatttaaagcaagtgtcttcctacactgcctctgccctgagcagctttatgttaccgggcaagaagagtcacaa

SEQ ID NO: 10651 - DNA, 1050 bp, Homo sapiens
tagtgtagtagtgagaataagcatagaaataaaagacactaaatgtaagatgagactaattatcctgcagtttccttgctgattaaaaaaatgttgaattgatcatttaaagtatttttgcagaagttaaaagtgtttatgtaaaactccaagtaattaacacttttacgttctgtattgatatcttttctccttttcatcatgacttgttttctttagacagttaggaatatggttccgtgaaaataaaacccatatttaaaatggcttttaaatagtcaaaagcattttaattagataaataacaagtgaaactattagcattttatttttagttttttggttactctttgggcaggtattttttaaagcacaattagatatttaagtagtattataaaattttatgtcttaatttttatgttaactgtgagtggagctctttggaagaaggtaaaatgagagagagtgtgtgtatgtgtgtgcacgtgtgcaatatatatagtcatgagtcattgaataattgggatgataggttctgagaaacatcactatgtggtatcattgtacaaatatcatagcgtatactaacacaaacatagatggtctagcctactgcacagccaggctgtaaggtatagactgttgctcctaggctataatcctgtacagcatgttaccgtactgaatactgtaggcagcattacacagtggcatttgtgtacctaaacatgtaaacatcagtaacaatccagtattataatcttatatgcatctgcatacaagatgcagtctattattgaccaaagcattatcatcatgtgctgtaggactattatgagtgtacatattctctttttttttttttcttttttgaggagacagggtctcgctctgtcacccagactggagagcagtggcgcgatcttggctcactgcaacctccgtttcctgggttcaagcaattcttgtgcctcagactcctgagtagctgggattacaggtgccaccatgcccagctaatttttgtatttttggcagatacggggt

SEQ ID NO: 10652 - DNA, 1084 bp, Homo sapiens
tcagttacataatccaatggtaggaaaaatggtctgggttcgttttggtgagtgcaaatgtggttaatagcagttgaagtaaaactctaaagatactgctttcattttaggtgatatgaactatttaaaatgataaagcatgttcctttgctatctctagatagctattaagtgagatgtctgtgacacacagtacatttctaaattttgggttgcctgaattgtttaagcagagtaaaatagccaagttagggcaggtgcatggaataaaactctctctctacttagtcttattcccctaggctgccaatttaatgcttttttctaattagtgagtgctataaaatggcttatctccaaacagtacctgtgttaatggcaaaaaccacaattactttggcaccaacctaataattcccctttgtaatttttttaaattttatttttattttattttatatatttttttgagccaaagtcttactccctctcccaggctggagtgtggtggcatagtcttggctcactgcaaccaccgcctccccggttcaggcaattctccctgcctcagcctcccgagtggctgggattaccggtgtgcatcaccacccaggataatttttgtatttttagtagagatgtggtttcaccatgttggccaggctggtcttgaactcctgacctcaggtgatccacccaccttggcttcccaaagtgctgggattacaagcttaatttttaattgacaaataataatcgtacgtatgtatggtgatgtttgaatacatgtatacattgtggaatgatcaaatcaggctaattaacatatccatcacctcacatacttgtcatttctttgtggtgagaacatctcaaatccactttttttttttttttaatactttaagttctgggtttcatgtgcagaatgtgcagttttgttacataggtatacatgtgccatggtgagttgctgcacccatcaacctgtcacctacattagctattttctcctaatgttatccctcccccagccccaaacccccccaacaggccccagtgtgtgatgttctcctccctgtgt

SEQ ID NO: 10653 - DNA, 1043 bp, Homo sapiens
cccaaagtgctgggattgcaggcgtgagccaccacgccctgctttcttgggtatctattcccagattcctttctacacccataaaattcctcctgatatcattgctactataaaaacacatcatcccttactaattgcccttggataatccatacatctgctgtttttcttggaaacattcatttcctttctctgctgtagtgtgtagttagtctctaggttgtgtcatgcttgtggttcccttcaccactcacctatggtagagctcttttttctggatcccacatcttctttccaggtttacctcttcattttcatagagtataccgtagtagcttcctgagagagtcgttgagtgagatacttttttggggggattttgcattcaactcccatatttgattggtagtttagatacagaattctagattggtaatcatttgttttcccttagagttttgaaaccattactcaaattgtcttctactttcctgtgttgcctttaaaaactccagtgtcttctgatttgttgatctgacaagtgatcatttttggcctttctaaaagttttcaagatgttttctttcctctagtgttctaaactttacagaaagagtattcatattatcatctaagcaccaaatgatggatttaatctttttgcaagagcgaggacaagaaagagtgattataaatattacctagcagtgctgttgatactctggtatttgtaggactcaagggctttcctgtttatttcttacagtggctcaacattttattaaattaaataggagattcaagctgtggttcaacacaagagaaacttcttggtttattttagcagagctctcaaaattccaaaactaaaactagtgccagattttacccactcgatagattaagtaattctggactttgtaaatgaaggtgagagagatatttgccgtcttctttctcttgtattttactatcctagtttgatacagttgcgttagagcaaatgcttccatacttagctttacatcgaaatgttatgtgac

SEQ ID NO: 10654 - DNA, 1032 bp, Homo sapiens
tgcttttttaaaaaacagtctttaatacccaagaaattagatctttgcaactctttaaattttcgacgtaaaacatttatatatcaagttaaaatcattctgtctcagtatgtttgtgagcagaaaaaaagaagtataaaaagatacattttaaaaatcatagttgtataaactcttttaggaggtatagaagcaaaaatgtgtagagagacttttggtctatgcaagaggttgggcagatcaggcaatagctgaagagattccacagtgacagtggagataaagagaaatagatagatttaaaacgtcttttggaaatagagctaaaaggatttggtgaattacatgtatggataaaggatagaagagaaaacaaagatggccattggatttctggttggccaactgggagaatagtggtataattttttgagatgagaaagcctgagggaaaaatttgaggataagaagcaagacatggtattaaagaaatgttagctacattatcgtcagttttagaattgttatcagatatttttattattgatttagagatgagttctcgatatgttgttcaggctggactgtagtagctatttacaggcatgattatagcacactatggcctcgaactcctgggctcaagctacctttccacatagctggcactgtatgcgtgcacaatttatatttttagccaagttttctcttctgagatccaaagttatgaaatagacaacaacccatttcatatctttacaccaatatttccttgatatctcaaccagaaactaagttcaatcttttgattctcaccttccaaccagtttttcccccaggcttgctcatctcatctgagaggacttctttgtaatcttacaaagctgaaagtaggcttactgaatgtgagggaagtcgagtctgagagaggcagaagtgataggttaggtacagaaatttttacactgtggctttccagttcaaaaggtcgttccagaaccttagggaagctgtattccataatggcgaaga

SEQ ID NO: 10655 - DNA, 1049 bp, Homo sapiens
tagtaaagcagacacacagagcaaaggaacagaatagagaacccagaaataaggctgtacacctacaactatctgctcttccaccaacctgacaaaaacaagcaatgggggaaaggattccttattcaataaatggtcctgggataactgcctagccatatgcagaagattaaaactggactctttccttacaccatatacaaaaatcaactcaaaatggattaaagacttaaatgtaaaacccaaaactataaaaaccctggaagacaacctaggcaataccatgggcgcgggcaaggatttcatgacaaagacgccaaaagctgttgcaacaaaaacaaacaatgacaaatgggatctaattaaactatagagattctggacagcaaaagaaactaccaagagagtaaacagacaccctacagaatgggagataatttttccaaattgtgtgacaaaggtttaatatccagcatctgtagggaatttaaacaaatttacaagaaaaaaacaaccccattaaaaaatgggcaaagggcgtgaacagacacttctcaaaagaagacatacatgtggctaatgagcatatgaataaaagctcaaagtcactgattattagataaaatgcaaatcaaaaccacaatgagataccatctcatgctagttggaatggctgttattacaaagtcaaataacagatgctggtgaggttgcagagaaaaaggaactcttacacactgtcggtgggagtataaattagttcaaccattgtggaagatgatgtggcgattcctcaaagacctaaaaacaaatacagtttgatccagcaatcccatcactaggtatgtacccaaaggaatatcaattgttctatcatatatacatcatgaaatattactcagccgttaaaagtaacgaaataatgttttttgcagcaacttggatggagctggaggccattattctaagtgaagtaacacaggagttaaaaaccaaaagccttatgttctcacttataagtgggagctaagctatgagtatgtaaaggc

SEQ ID NO: 10656 - DNA, 1073 bp, Homo sapiens
ttcttttcaactccctgctgcccactttgtggtgttgtatgaataatgagtccacaggccctgtaaacatgttaggtgaggtgtttgttgtttattagtagttgggattaaatagaagttgcacactgaaattgagtgaagtgacttttctgcagttaacttggatgtcattggtttgaaggagtttttctgttgcagctgcttgtcctactacttttagctgtgggtgcatcctttctgcgtcctgctaaaaattatattcttgttttcacttttaaaacctaagacggttccagagctgtgtttggtttttgctttaaactaatgcccgagcgcccctttagttagtcaccaatcactgtttaggtaagttgatgattcctttttgctacccaagatttttttatttaaaattgagcatttttaacttgctttttaggtcagaggatcaatgtcctctgtggtattcctcctccatctaagcttcttaaagcagtattataaatagaggctttcaacctaaaaagtactgtgtatttcattgactagaactgaactgaactgtaggctaataaaaagtaccaaatgaaaatattatggtatctcattgcactccattgtagatgtaatgtagtgtgaccagcagtagctttgattcattgtaaatcccatctgaatactgacaacagttcaaaacatcaggagataaacctcaaaggtcacatttgtgtgaatggtcattgtgcatataagacatcattttattatttgaaaactagtagtgtagctcttaagacagggcagtgtcctaacctctgacagggatagaggcgagaggagaatcagtgggctgccaaacagtcatgtgttcataggtgaggttctgtttcttctttagctgttactattgttattattattattattattatttgcatgaatggtagcagttacttcacaggcaaatttcctatgaatcccagagtattgcaacagattagcagcaaataaagacctgagataaagaaaaaaaaaatgcttttattcagttatattaaaattaggacatttca

SEQ ID NO: 10657 - DNA, 1113 bp, Homo sapiens
taataactaattcataagaatgctgtaaacataaaatgagtattactaactgagaatgtacagtagatagtaggctctcactacatgctggttttccttcttcctttccattctcttaggaaaactgatactcagaatggctaagtgatctgtgcatagtcaaaaggccaatttagtgatagaactgagactggatccatcactttgattacagctagattctttccattataccaagcagcatccatagtaatttactttcatttgtacaattttctatgagaaaaaatgagcaacaactatcagtttgtcttcaatcctgataaaatctagcacttacagaaattgctaagaagtaaacatttattacacaaacccatgccagagaggggtatgttgagttctagtctaaacatctttaataatgataattccataattctcagctgtttcttttagattgaccttttctcacctgataaaattttccaattctaagctctttattctgattgaaatctgacataacttgtctcagtcatcatttttccattctgagcttgcttatattttctaaacttttaacttggttctccagcctggcgaccttaatttgtccattttagaacagccaaaatatccttgattttgctggattaattcagttatctcaaattatctctgacttcctttttcacacctgattttccttagttttgttgattaaagattaatatgagtttgtatgccctgacagtggatgatacaaaagaaaactggtctaggaattaggaaacctactttctgtttcatctctcttcttattgccaagctgtttcctcactatgatgggaaaaattatgttgtaatcttatgtcttataaaagagggctcaaattggtatagactgtatattttgtggggaattaattatgtgactattcaacatttgacaaataattttggacgtaagtgtgcaatgtctaaagcccgaataattctaattttaatgtcaacgcacttgatgagttgaagtatggtgcttgctggtaatggggaaaaaaaaaggctacaaccaaaagtattgtgttatataaaattacatgtgatttg

SEQ ID NO: 10658 - DNA, 1026 bp, Homo sapiens
atgttatctgttcagtggcatcagccgctattaatatatgctcatgacgtccaagtacaaataaatacacaagtggtttactctagcccatatctctgttcccaactttgggcccctatcaactgccaactgcacctgacagcttgaacattccataaacgacctcaacatacctaaaatcatctcatcattttttttttttacaaatatgctcctcagtatcttcatcatcaagaaatgtcgtttactcagttgttcaagccagaaactaattaaattgttcctaacaactttttttcccttgcctctcatagctttttcaacctttgagacatatctccacatcattttgcttctctcttcacaggaattattctattttatcactttgtttttgcaacagcatcttagctaatttgtaactaattttaccctttgccagtccttttcttctgcttcttccaggttaatacttggttgtttgtttgtgtttgtttgtttgtttttcctttggagatggtgtctcattctgtcacccaggctggagtgcattggcataatcactggtcactgtaacctcaacctcccaggctcaaggaatcctcctgcctcagcctcccaagtagctgagaccacagatgcatgccatgatgtccagcttaatttttttttgttagaagtgaagcctcacttcgttgcccaggctggtctcaaacccctgagctcaagtagttctcctaccatggcctcccaaagtgctgggattacagacatgagccactgcacctgcccttaatacttttgaaaacacgtgtatggtcatgttatttcctcttaaaattttccaaaggcttcttatcctttcaggataaaatgcagactccgaagcctgacgttgaaggttccccataatctgacttctcctgttgtacgccacgcccatgtgacctcacgtttctcctttctctctctttcgcttccccctcttgcctttttcctttctcccccctccccttttctccctca

SEQ ID NO: 10659 - DNA, 1051 bp, Homo sapiens
tcattcatagatttggtctctttatataataccacatttcttggaggttttgtttattcctttatactctcttttctctattattgtctgacttccttatttcaaaacgtcagtcttcaagctctgagacactatcctcaccttggtctattctgctgttaatacttgtgactgcattatgaaattcttatagtgtgtttttcagctctgtcaggttgattacatgttttttctttgctggctattttgtctgtcagctcctatattgttgtactgtgattcttcgcttccttgattttgtttcagcatactcctgcatctcaacgatctgcattcctatccatattctgccttctgtttctgtcatttctgccatctcaacccggttcagaacccttgctggagtggtggtgcagtcattttgaggaaagaaggcactctggctttttgagttgtcaagagttcttggattggttctttcttatctttctggggtaatgtttgttcaatctttgaacttgctgacctttggatagttttttttttcttcttcttcttttacactatttgatgaccttcagtgtttgattgtggtataaggtggattcagccaactgactgtttctggaagactttagggggccaacactcagctctgatcttctagactgtgtgctctaactttgggggacttatattgggcaatgactttgttctctggctcctctgaggttaggagtccactgtgctggtggggccgaagtgctccacgatcactggtcactacactctaatgggtggtgtctgccaaagtgcttcatagtgtggcggcagcaggatccgtcctcatttgcacatgccagcaacagcagcagcgcagcagagtgcacgctggacaactgtgacagggtgctagcaggtgccagggtgcctgcccccatgtaggcattcaccgcagtggcagaggcagctcagctggacgactgtgacagggtgctagcaggtaccagggtgcccgcccccatgtaggcattcactgcagtggcagagg

SEQ ID NO: 10660 - DNA, 1055 bp, Homo sapiens
aaaactttcctgctaaacgtctccactaaataacagctatggcgttatcttagcagaagcaggagaaatagtgcagatgaaagcagcaatggtattcaaattgctgttgcttccaagattcggaaggtatagtcctattatgatgacgtttcctaagccagttgaggcaagccttgtattttagaaggaaaacaatgtaaatatttaatgtgggcaaaatggagagctatctgcctggtgtcagcagtctttccctgccaagagatcattttaccttttctgcctgcttcctgatacctggaactgaatttatgccagggtatataagatgcatgtttgattcctcatgaaaacaggtttttgataatagaactggatgcctggagtaggaagagacaaacagagaaaggttgaaggaaaagcaaaacataaagaaaaacctccaacttggtaattttgcccagatccagccctgagatagagatagcatcttggaaagtaggaagaaaagaagtataatgacaaactacagttgttcctgagtatcctcaggggattggtttcaggacaaacccacccacaaatgccaaaatccatggttgctcaagtcccttatataaaatggcatagtatttgcatataagctacacacatcctcccatatactgtgttttgttttgttttgtttttgagatggagtcttgctgcgttgcccaggctggagtgcagtggcatgatctcagctcactgcaacctacacctcctgggttcaagtgattctcctgcctcacccttctgagtagctgggattacaggcacctgccaccatgcctggctaatgtttgtattttagttagagacagggtttcaccgtgttggccaggctggtctcaaactcctgacctcaggtgatctgcccgccttggcctcccgaagtgctaggattacaggtatgagccaccatacctggcccctcccatatactttaaatcatctctagattacttgtaacctaatacaatgtaaatactgtgtaaatagttgttatactgtat

SEQ ID NO: 10661 - DNA, 1093 bp, Homo sapiens
cgtggcagtatctccctttgatctgatgcccttgaggtttgactaaggaaatccttttcttagaaaaagtaataattatgattaataagttcacacatatttggtggccttgcactccctggattcactgcccatgcctatcagtgatctcactcccctggagtcagttctccctgaaatgtctttgtcttggtgttaaacttcttaaaatgatgaggacatgtgtagatctcttaacgttgagcacaaccaagaaggatggagaggtaagttgtggaaaggggccatgcgctgtgaggtgggaagctgtccagatggctttatcctgagggcatgaatgaagttgaaacgcactgggtcaaccagaaagctcttcaggttaggatgctgcatgtcagagaaagctaaagctgagagcagtcaatgtgctaattatctgcactggacaagggtaggtatttgtcatcatcaagcatgtgagaccgtgcagtagctggatgtagtttactggtctcttagaaatgagcatgcccctaccttgtctattttggcagaacataggagcttcttagcttccttcagctggaagcaccacatatgtggacatgattatatttttgtcgcaaatcctttttctggccaatcagaggaagcctgttggtattctaggaaacaggcctataggtaacttcaccaggagactagaaagtaagcaaatcagtatataaacttgttcctgaaatcttcattttcctttctctaccaaaataggataacttagctttttccaattatcgcactattgagcatattgcactaatatattaactttcattggtttaacaccatgcaattgcaattagccagccataactggcgtttctatgatatggtgtttccaattttataaaatgtgctgtaaacctcattatatcataaggattttacctaaagaaatgcatgagtgacccctaaaacactgcagaagttttgactggctatccactttccttctcctgtttcctcactaattttacagaagatagattttctttagaaattcaaacttttgaaattgacgatttaccttatc

SEQ ID NO: 10662 - DNA, 1044 bp, Homo sapiens
tctcaaactttatgctatcattggcatacattttattcctccatatattataaaagccatagtacattgttactgtttttgctttaaatcagttatctttttttattgtttattgtgctaaaacatacacaacataaattttaccatcttaaaaatttttacgtgcacagttcagtgttatattcataacgtaaactatcaccaccatctatctctgtagctcttttcatcttgcagaactgaaacgccatacctgttaaacagtaactccccattctcccttgccccatattccatctgccttctgattttactcctgtaagggtttcgtataaatggaatcaggcagtatttgtcgttttgtgactgacgtatttcatgtagcaaggttcgtctgtgttgcaccttgtttaaggaaatgctgtgtcagaatttcgttcctttttaaggctactgttttatataccacattttccttattcattcctccattgatgaacactcgggttgcttccacattttagctctcatgaatagtgctaccgtgaacacgggtgtataaataccttttcgagactgtgctttccgttcttttggtataaaatcaaaagaagagaaattgctggactatgagttaaccctattttcaattttttgaggaaccaccgtactgttttccacagcggctgtaccaactgacattcccaccagcggtacacaagcgttccagtttctccatatcccggccaacacttgttattttgtagtctttcgtgtgttttttaaatagtagccaccctaatgggtgtaaggtggcatcacatagttttgatttgcatttccctaatgattcatgatgttgagcatctcttcatgtgcttattggccatttctgttttttctttggagaaatatctattcaagttctcagcctatttttaaatcaggttttctgttgttgttgttactgagttttagaagttctctacatagttagatagttatccctaatcagatatacgatttgcaaatattttctcccgt

SEQ ID NO: 10663 - DNA, 1052 bp, Homo sapiens
tgtagctgttgggggacagggcctgaggggcagcagggagagaaaagaacaaagaaagaaagaagaatggttctttgtggggcagcaaactttcttctggttcccagcctgaatgtttctgatctggttttcttctttttgtgatgtttgaacttgtttcctcaactcagatgctgaactcttgtccaaaaaacctaagggcagcatagtgtgagagactgtgggaggcaagtccagcaatccagcaaaaagaattgcagaactgtgaagataaatgtgtgtccgtatcaggactgcgctggagaacgggaagagaggggttggggtgctaagactgtgtgtgtgtgtgtgtgtgtgtgtgtgtgtgtgtcttgacaaactgatgagaaacactattgagtagttttctcctctctgctctcacacacagtctggcactttcttcttctgtgacagctgccattaactttttaatgcgaagacaagggtatcttgccaattggatgttgaaatctctggcaaggaaaagcttgctttaaaaaaaaaagaggcagggaatatggggaaggttgggcagacataccaaaggtccgggggaagacagggtactaagttggaccttacaatgcagaatggctgccctgcttctgataaaatcccctcaaatgaagttgggaaaagaaagaggaaatgggagtgtgagtgtaagggagataaggaactcttttacgcagttgcaatgacacagatattaagtattatttgcaattcactcccgatggatgtgagaactcctcatggagttttggtgtatatgtgggaccttgtgctaaatgtagaataatcttgtttgtgcagaaagagaaggaaagagaaaatattaggagacctctgtagaccaaaacattatgatacaaaagattgttccagtcatttccttccatagcttatctcagagaaggggagttctggtgttcgtggctcgcctatcaggtcttcccctcacctctaaactacggcagctcttgatccttattactggtacctacccc

SEQ ID NO: 10664 - DNA, 1112 bp, Homo sapiens
ggttttcctccatctcaaaatagtgtctgttctcgctttgacacacaagattcgtggttataaatagcaagaaggaggaggtgtgtctccttggaaggatggcagtgctgaaagagacctcttaggcacccttgtgagaggagtgatggagctggcgtcttcatggtgatgacaagtccagcagtccaagggaagggtcacaattaaaaccagggctttttactaacagatgcaggtggcgcggacaacagggcaggacgtgaagggagtaaaggaacctaaagtgacaatggatgggtcaatacccaaaggcagtcaggagagacatctccccttccctttctttctcttcttaaagacagtcaggccaagggcgtgtgacactctgtgggatctgcctgccaggggagcaggagccaggctcggaggagctggctggtctttttccacccatggatttcatactttcccaggctctgatatcttatgtatttgaatatgaataggtgattgagcgtgtgtgtctgtgtgtttctccaaggtatctgaaaccggtcccctctttagttcatttggtgattgtaatatcaccaggggtttcttattgacttgaaactacccttttctaaaattttttctgtccaaaaagcataagttaaagggatattgccaaaattgctgggagccatatgctgcgaaaagaaaaaatctggaattcttcttcccttgtgtatttcaccctctgactctaggggcagctgaaagattttttgtttgctcttcttcaaggtcaagaaaggcagaggactaggctggtctgttctaatttttaattctaggatggttctgctgctttctggattgccgcagcctggcttctctagcatggagggaagtttttacgtgtggtgatagtccttgtcttctctgaaatagaaaccagtcagtccaaaaaagctctcgtgtcagcgagagctttttctctctggctccttttcaaaccgcctgccatttatctccttcatcttctaaccaggtcttcagagcccatctttgctccagcgctagtcctggatgcagtcctcagagtgtgtggtcgtggtggtagttac

SEQ ID NO: 10665 - DNA, 1046 bp, Homo sapiens
cctggcccatggatgaaacttagcaatatttcatccatgtcgtagcatgcatcagaatttccttccttttttaaggctgaataatattccattgcatgtgtatacaacattttgtttatcccccaatagaatattacttttttattttttaacttcaatttttatttgtagttgacaaataacaattgtaaatttacagggtacaatgtgatgtttcgatatatgtataccttgtggaatgattatatcaagctgacacatctatcacctcacatacttatccttttttgtagtgagtgcatttaaaatctattgttttagcaattttgagatatataatacattattattaactgtggttgccatgctgggtaatagatcttgaagaattattcctcctgtctaactggaactttctaccctttggtcaacatctgtgcattccccacccctcacccccagtatctggtaaccaccattctacactgtaattctataagtttgactttttaagataccacacataagtgatattatatggtatttatctctcttgcctggcttatttcactcagcatagtatcctccaggttcattcatgttgtcagaaatgacaggatttcctcctttttaaaggctgttagtaatccattgtatatatgccacattttctttatccattcatccattgatggacacttaggttgattccatatcttggttattatgaataatgctgaaatgaacatgggagtgcagatacctagtcaacatactgattccaatgattttggatctatatccataagtgggatcactagatcatatggtaattccatttttaggctttaaaaaatttatgaacaacagaaattcatttctcagttctggaggctgggaagttcaaaagacaggcaccagcaggtttggcctctggtgacggcttgttctccacttccaagatggtgccttcttgctgtgtcctcacatggcagaaggggtggaagagggaaggagcaagagcactcctctcagccattcttata

SEQ ID NO: 10666 - DNA, 1033 bp, Homo sapiens
cagcatcacaagtagctgggaccacaggcgtgcaccatcatgcctatttcattcgtttaaattgccttgaacagaattacattaataagggctctgatctcataaataacccaagattccttggtgttgaggctggaatcacagagccacctcctagaaaggcccatcgaagccttgggggagcctcagaactgcaggcttagggcggctgatggttcttttcctcctgtctgtgccagggtagcaaactgcatatcacagcagattacttggaagataactaaatgagatatagggatgaactccttgggatgctgggatatcagtgttggatttcataatatgcaaccacttttatggtgagggatttggaagccaactgctgtcggaattactgaaggtgccaacatgaggccaatatacgcaatataggcaaaacctatttatagtaatgtcccaaacaccatccaaattcttttgcagtataatactaaactgttgctgattaaatcttactgaagtctgtagaccataagctgggtttgaatttttttaaaaagtaaattttctctgtagcaatacatttaatggaatctgatctatattacttctgccaagaaggaattcagaattaccaattggagttaatgtggtacaaagaactagaaacctctcattctcaggaaatggacagggcagggggagtccttaatgaaaacactgtgtcagtaatttttgtggcttaagatcaccacgtgtagttccatgggttcagaatagattctcagagatgggggttatagtagaaagagcaaaggattaagcatcaggaaccagatttacccctagtcccgtaaccctgggtaatttacctgccttctttgtgttcccatttcctcacctataggaatggagggattgcgcagggtgcagtggctcgtgcctgtaaccccagcactgctgggggaccaaggtgggaagattgcttgaggccagaagttcaaggctgcagtgagttatgatagtgcccctg

SEQ ID NO: 10667 - DNA, 1048 bp, Homo sapiens
gtttagtttacaaaaccaggaaattattcctctggaccagagagagagagagagaacaagaaacaacaacaaaaaacccaaatggaatctataaagggaagacagatatattctacattgttcccattaaaatggaaaccccgtggggagaggaaatgcatctgtggaatgtagagtggatttctttcacatatgggcactcagtaaacattattaatgaatgataatgatttgtcagtgattgaaattgtttcagggcaggaacagggaatgaaatacgtagacattcctctatctcatggggaaactgctaggcaggtcatccagatgtattttctttggggagttgtgaattccttgtgtgtccagctatcactatgtaatgatattttacgttctcagtaatacatatcatcattatatatatcatcatcttatatgtatatatataatacccctgtacatagatatatgtacacatgtatatatttatatgtataaaattaaagtgtggaacttgtagtttcctgtcgaagaagcttgcaaattgcaattccatcctagcaagtaaaaagctgaacagactgaaaaagcaagtctccttggatccataaaggaagcgaggtctcagagcaaaccactgtccccagaactggagaaaccggcaggagaatgcagcttcacaaggtaccggagcagaagccctgggcagcagcctctgcccgagcagtgacaggcagggaaacctgagctgtcatcaccagagtgccggaggcgcagagcgggcaagtctggaagttaaagatccacgggaaccatgtcgttgtcccctctccctcaccttctggagcttccccgagttctcacagtgaataatggagaaaaatcccctcgtgcctcctgcagtgggaagaagaaaaaggaccattttgaaagagactgccgcactctgctcttcctaacgaggtcgcctcccctaaccccaccgcggctttatcagcgcctaactgacctgggggaagggaaactcccacgccagcccactcta

SEQ ID NO: 10668 - DNA, 1085 bp, Homo sapiens
cacactcacggcctctttacagcagctgcctttacccggtcacagccactatcaagaaaaagatataagacatactaaagggcaaatagggcctggcacggtggctgacgcctgtaatcccagcactttgggaggtcgaagcgggcggatcacctgaggtcaggagttcgagaccagcctggccaatatggcaaaaccccatctctactaaaaataaaaattaaaaaaaaggaaaagaaagaaaagaaaaattagctgggcgtggtggcaagcacctgtaatcccagctgctcaggaggctgaggcaagagaaccgcttgaaccgggaggcagaggttgcagtgagccaagatcgcgccactgtactgcagcctgggcgacagagtggtactctgtctcaaaaataataataataataaaatgaaataagaatcaaataacacatgttgaagggacagagcaagcttcacaaccagactcagagacagcagggatgctggaattaccaggcgggaaattgaaagcagctctgattaatgtgaggggctgtaatggataaagtaggcagcatgcaggaacaggtgcgcaatgaaagcagggagatgggaatctaagaaaaaaccaaatgaagtgacagagagcaaagcacggtgacggaaatgaagaatgccgctgatgggctttgatggatttgtggactggacacagctgaggagaggatctctgagcataaggttatctcaatagaaacctccacatgtgaaaagggaaaagaaaacccacccacacgcacacgcgcgcacacacgtgcgcacacacacagaacagaatatccaagaactgtgggacatctacaaaaggtgtagcatgtgtaatgggaataccaggaggaggagaaagaagaaatacttgaaatggtaatgacagatttctccaaattaatgtcagacactaaaccacagatccaggaatctcagagaatcaggacaaatgccagaaaaactacacctgggcatatcattttcaaactgcagaaaatcaaagataaagaaaaagtcctggaaggggccagagtgaaaaaaaca

SEQ ID NO: 10669 - DNA, 1037 bp, Homo sapiens
agggaagacagccaatcaagagtgggttatcacaccggtgatggacgtggccactggggccaaacctgctggggaagtcagccggggtacaacatgtgtccttatacaacggctcctgcctgtccctggttgagggctgtcacagggagcactcatctctggcatctccttcctaccggggtgggcaagagggctccgcaaaaaaagtgcaggagctggtggtcagaaggtggggtctcgtgcctgaagggtgaaggtgggaaatgtgggtgggcatggctgtgtgctctgcctggaatacctgcctgctgagctgacgctgatttcacgccgtggggttccctgtaggctctcctgggtctgatggtgagtagaatgtctagcattttgtctggttttgcaagtgaaaaaagtgaggcaggggaagggcagtcaagttaaggactaagtgagcaaagcagaacggaacccaagtgtctcgatcacttttgcccatcttagtcagaacatacactgaatagtcaatgaatgaatctttgatgacgtgaccatcgagaccaagcggtagtaattctcctcggcctctcttgatctttttccctttggtggtcctcccaggtggtgtggtcatgatgggaggagcagtgatggtgtagaccaagctgcctagtgtcgccatgtaatgcagctccatctacccttgtctgctgctcctccagatgagcggttgctgcaggacagtggtaggttaaataggccattattgtccatagtcctttctctgtgtggcatgtgtttatcactaataatcggtcattgctatgactgcctgattgcatggtccttcagccactattttagaatcttgtatatatcttatactttatacatatactcatgtatcaaaagcatgctattgcatggcagtaggtgtaaaacagtttcttttttctggtggggttttttttgtttgtttgttttgtttttttgagacagagtttttgctcttgttggccaggctggagtgcaatggcatg

SEQ ID NO: 10670 - DNA, 1057 bp, Homo sapiens
gctagaaatgcaaaggtaaatgccagtactgtctgggaggcattctctgacccctagaccaggtcagggcctcctgatttgggttacgttagtatctggtgttacattttttgtctgtcttctccacaatactgtaagctttgttaggctggaactaaggtctgttctttgctgtatcctcagcccctatcacaggacagggtgcctcgtagaagctcagcacatacgttcaaccttgtcagctgaatgccaccccagccacgcacgactagggggtccttctagggacagcagtgatgtaaagaggatgtaacattgcggggccagaagtgccgataccggaggctcaggcagctgaggggcacagagatagcaatgggaggctgcacagtgttcattcaagccaggacttaaagggtgaggaagagttctccagtcaaacagagagggaagaacattctatgtccatgggtacaacatacataagtgcacagaagagtgaaatgaggccgggcctggtggctcacacctgtaatcccaacactttgggaggccaaggcgggcggatcacctgaggtcaagagtttgagaccagcctgaccaacatggagaaaccttgtctctactacaaataacacaattagctgggcgtggtggcgcatgcctgtaatcccagctactcaggaagctgaggcaggagaatcgcttgaacctgggaggtggaggttttggtgagctgagatcgcaccattgcactccagcctgggcaacaagagcgaaactccgtctcaaaaaaaagaaaaaaaaaaaaaagagtgaaatggttgtgtgtgaccagaataagaggctgcgattcaggaggatgagaactggcaggagatgtagcttggggtgtaattgggaccactgtaatggggttaggactttgttctttatgaaacaggaagtgagtggagactttgaaacaagatagtcatacgatcctatgacatttttaggatgaaatctctggggatagaatacagagatgatgaaacctgccccctgaaaaatgcag

SEQ ID NO: 10671 - DNA, 1051 bp, Homo sapiens
tgggtggagcctggggtgaggggaggctggtggcagccgtgtgggtggaggctggggtgaggggaggctggcagcagcggtgtggatggaggctggggtgggggaggctggcagcagtggaggcacctcgggaggcagggacaaggatagcaactgagtgctggtaaaggccaccctgctaagtagccagaaagtttgcagaaccttcttttgagggatctgaagttcaagttctcaaatgctccagatcctcagtgttcaagaacctcaggaagcttcgcagtcctgcctcgtgcctgcttgaacagctggatgtgggcaggaggctgtgggagcgggccatgccagcagaatcccgccttactctggggacttactcttgtcacagcccctggtgtcctgagggtcatttcagtgtcatgtgagtattactgtggctattggaaaggatttggtacgagtttatttgagaagttaggagctttttttaaaaaaaaaaattatctttgataaatttagtagaatattttgaaagtactttttggacagtaatgaatgaacaaattgctcctgaactagaaggagggatctaaacacatcatctaagtacaacagtatgtctgaaaaatatctctgcttgtcttttatttgccctttaaagtctgtgcaaacaaatgtgaacagcctcaggactctaagaataatatttttctatggatgtgtatggacagataaacaaaaccccaagggagaaaaaacttctatttaaataaaaataaagatcccctacagctccatcctcctttgctcactgggtttgctgtatttcattttgagataaaagtagtttggatgattaacagttgaacaaaaagaaagtatttgtgtctgtctaaatctatctctatcaatgtaatctatcttatttctctaatcttatctatctgtcttatctatcgacctaactgtccatctggttttgaatattccgtattccagccataagtagtagatcttttgcatccctggggttaatggttccttgagcaga

SEQ ID NO: 10672 - DNA, 1054 bp, Homo sapiens
gtagtatttgtgcttctctctatccagttctcagttgtttagggatcttctgagggcaaaccaaaaatgtcagtaaagcaaaaatatatcaataaggcatcatactgacgaaaacaaaaccagaggttttaaaaaataatctgggccgggcacggtggctcacgcctgtaatcccagcactttgggaggctgaggtgggtggatcacctgaggtcaggagttcaagaccagctatggtcaacatggtgaaaccccgtctctactaaaacacaaaaattagccgggcatgatggcgcacacctgtaatcccagctactcgagaggctgaggtgggagaatcgcttgaggggagtgggaggttgcagtgagccgagatcgcaccattgcactccagtctcggtgatagggtgagactccatttaaaaaaaaaaaaaaatgtagttatcaattttttgtttttgaccaaaagtatttcaggaactttgaagaaaggacctgaaaattattactcaggctggtatttagtttgctgacttttaactctcagagctgaacagtctaatccttgatcattccagagtgagtttaggaatttgtagtcatttcctttttactgggtatttgcatacatcactaaccagctgggattagaatgagcagtctctcgatgctgaaatggaatgatgagaactcagggccagcctgaaatgttcatcctcatcgattaatccttaatgaacactcatgcatagatgacatcaaagaaggtcctttgcaatgtacagggaagacaaaccagcttccatagtgtacattcttaaaggaaggttccaatagaccgatacacatagttaacattttgtatttttatccatgttttgccccaagattaaacattaggagtaacgtggacatttgctcagtgtcgagggaagggtcagtgcatataactaggaagaaggctatctggcagggttgggaacgtgacctcttgccctccaaagcctgggatgctgaagtgaatgcctccaatcttgcggtgtatggacacaga

SEQ ID NO: 10673 - DNA, 1045 bp, Homo sapiens
tcaaaaaaaaaaaaaaaaaaaaaagatcaagaccttgtctcaaaaaaaaaaaaaaaaaaagacaggaaggcaggaagacaggaaggaagggagggagggagggagggaaatggagaaatggagcctaggtttgaatcctggctccctcacttactggttgggtaacttacggcaggaattatgacttatctggaaaacagggataatacctgtttcagcaggttgctttgaagattaaaacttacaagtaccttgtaaaacacacataggttctcaacacgttaattgctttccatccaaaaaggttgagagatgagcagttgaccttcactaaccactctaggtggtttatcatctttcccagagaagctccggctatatactaagtatgcctcattcaggataaggatatagctagacccatggtcgtaactttcaaacatcaatttgccgacctttagtcaagcgtatatttaacatttaacgtaaaaaggagacaaaacagaagaacgtgcttcacgttacaggtggtaggaatattttgcctattaaaatgaagaatgtgaatacagagcctaagacttgggtgctcaaatttttatcaattgaatctgtacagccatgcagtctcttggaagaaaaacagactaagaacccactgccgtgtaaccttcaggagttgtgtcaaatgctggattagaaagctgaccctaattcagagtccctacttcttaataggcttcacacttttttttttttccaggcattaagcactgtaacctaagtgggaagaaagagatccacaccttccccaaagaaacagaagatggatctagtgtcaggctcaattagacccaattgtgatgactctccaaaaaggaacaatgcggcttttgtgatatgctcaggcagaaagcttggacattttacaaaacaatcttatcccaagagaaacctgggttccagccctcttcctggaaagaggggttgatccaggaaagttttatactactcttatcagctcttgctgagatcagtatttttt

SEQ ID NO: 10674 - DNA, 1032 bp, Homo sapiens
ggtctcgatctcctgacctcgtggtccgcccgccccggcctcccaaagggctgggattacgggctgagccaccgcgccgggccagggacttgttttcttccgggtggtttcgcagggctgagctggggcccagcggcggaagtaaaacagcagatttcagcccattataaagagacgtttccaagcgttagagctacgggaagcgaagccccctgccccaggggtgtcagcagagccgtggcgtgcgggtccgtcgggggagacggggggaaggacaggtccccgggagaggagagcgcacccgcttaccgccctggcctcattctgcaggcagccgagagaccgccttcacccacgcggtgagcgccgcgggcgtggtcaacgccatcagccgggcctgccgcgagggcgagctctccacctgcggctgcagccggacggcgcggcccaaggacctgccccgggactggctgtggggcggctgtggggacaacgtggagtacggctaccgcttcgccaaggagtttgtggatgcccgggagcgagagaagaactttgccaaaggatcagaggagcagggccgggtgctcatgaacctgcaaaacaacgaggccggtcgcagggtaagctgggcctccccggcctccccagcactgcagacctagggggctgttcccgggctgtgccaccagccgtggcctggccttcaaggaaacgggttagtctgaccgtgaagattcttacctacgattgcaaatttacatgtccacgttattgaacaaatccttttcaaaatgccccacttcccaatgggcatacgtgctttttcttttcttttcttcttttctttttacttactttattatttcacggttcctagaggacttaggtgcaatgtttggatcagaattccagacgtaaggattagagcagcgctcttgtcttggccacccctcctttgcaacttgaatagataatgcgatgggatgtttaggccgttagacctcatctagggtttatgctctgttaaag

SEQ ID NO: 10675 - DNA, 1034 bp, Homo sapiens
attacacttttttttagcagctttagatgtacagaaatttgagccgatagcacagaaagttcccatattcccttcccttccctcgtttctcctattgcaaacatcttgcattaatttggcacatttattgcatttgatgagcccatatcaatatgttgttatttattggtctatagtttacatagggcttattctttgtgttgcagttttttttttttttttgttttgtttttttaagatctcactctgtatctcaggctggagtgcactggtgccgtcatggctctgcagcctcgacctcccgggctcaagcgatcctcccaccttagcctcccaaagtgttagggttacagacatgagccactgcacttggccgagagttattttttacaaaaatgggatcaagcccagtggtggcttgcgcctgtagttccagctacttgggaggttgaggtgggaggattgcttgaggctaggagtttgagaccagtctgggcaacacagcatgactctgaccagtctgggcaacacagcatgactctgtctcttaaaaaaaaaaaaaagtgggctgagggtggtggctaacgtcggtaatccttgcactttgggaggccaaggcaggtggatcacctgaggtcaggagttcgggaccagcctggccaacatgaatgaaaccccctctctaccaaaaatatattaaaaaaaaaattatctgggtatggtggcgcgcgcctgtaatcccaactactcaggaggctgaggcaggagaatcgcttgaaactgggaggtggaggttgcagtgaaccgagattgcaccactgcgctctagcctgggcaacaggagcaaaactccatctcaaaaaaaaaaaaaaaaaatgacgaaacccgtcattcagcagtcattcaccttttttggtggttttcaggatatagtgcttttggactttctaatgtaaacattcttgatttactaattttcagattaatgacaatttattttgggaatggaaggctggcttggatgttactttttc

SEQ ID NO: 10676 - DNA, 1062 bp, Homo sapiens
caggtccccttccatgctgtggaagcttttttctttcgctcttcacaataaatcttgctgctgctcactctttgggtccgtgccacctttaagagctgtaacactcaccgtgaaggtctgcggcttcattcttgaagttagcgagaccacgagcccactggaaggaaccaactctggacacatcttggtgacccagacgggaccattggaccccttttgcttgctattctgtcctatttttccttacaattcaggggctaaacaccagggcacctgtcggccagttaaaagcaactagcgcggccaccggactaaagacacgggtgttaggctttctgggaaagggctctctaacaacccccgactcttcagagttgggagcgttggtttgcctggaaccagcttcctctttgcctgtacttctgggctgagccaagggttgacaagaggggaaagccattcagctgcggggtcccaacaaaaagttggttgaccctgtagccatgaggggaactctgtaggtcagccaaaggttcagtgggtcggtccaggggtccttggtagaagttgttagttgaactcatttggggttccatttgtaagaccatctatagcttgatggcatcgatcctggaggaaacaaatttgacaaggagtttaaaaatacgggcctgaaggcgagtaatagcaagatggctgttacgggacctagaaaggggagaagccatgttgcccagctccagaggttggtataagagtttgaaaggcgttgtctgatttcagaagccttttcctgtaaacgccaggtggcgtctcatactatccctcactggttagtgtaaaagcaacattcttcccctaagaaggtgcatagtcctcctttctcagcagtgaggaagtctaggccttggcggttttggagagtcactgctgccaaagagtctatctgggattgtagaggaaggatagattttgttatttcttgcaagctgtctgagaaatcctttgagagtgtgtggtagtaggataatgaagtagataaatctgctattccaattcctg

SEQ ID NO: 10677 - DNA, 1017 bp, Homo sapiens
ttttttttttttttgaggcagagttttgctcttgttgcccaggctggagtgcaatggcgtcatctcagctcaccacaacctccgcctcccgggttcaagcaattctcctgcctcagcctcccgagtaggtgggattacaggcatgtgccaccacacccggctaattttttgtatttttagtagagatggggttcgagctcctgacctcaggtgatccacccaccttggcctcccagagtgctgggattaaagccttagccaccatgcccggcaaaaatatatttttcatcagtctttaaagaactcagaatataagacattatacattttgagatgtttgcctttttaaaaatgaattgtttttcccattataaaacagtgtgataagacacagttgttaggggtcagtgttggtaaattgacaactaaaatcacaaagatgtttgataatacctctctgccaggtatgggaaggtcggtggcgagtgatccctcatgatgtactaccagactggctcaaggataatgacttcctcttgcatggacaccggcctcctatgccttctttccgggcctgttttaagagcattttcagaatacacacagaaacaggcaacatttggacacatctcttaggtatgtaatgtcagtgatgtaatgagctggtgattcactttcttcctttttattttcatgtatttgagggtaagcacagaacttcagaaatgtatttggatttgccattttgttttctgaatttctaatgatgaattttctgactggtttactcgtagtttatcctggtttgcactatgattttgttataacttaagttatatttctttctactagattttcagatcttgtcctcaaaccaggccaagtaaaagttgctatacaaaatgtggtttcatattgtagtgaccactgagaagaaagtattatttaatagaagtaatctgatcttttaaaatgcattacttatatgcactgctaattttcagtttggcctgaagt

SEQ ID NO: 10678 - DNA, 1034 bp, Homo sapiens
tctcagtggaagcagcacatgagtgggtgacaggatgttagataaaggctctagttagggtgtcattgtcatttgagagactgacacactcctagcagctggtaaaggggtgctggaggccatggaggagctctagaaacattagcatgggctgatctgattacttcctggcatcccgctcacttttatgggaagtcttattagagggatgggacagttttccatatccttgctgtggagctctggaacactctctaaatttccctctattaaaaatcactgccctaactacacttcctccttgagggaatagaaatggacctttctctgacatagttcttggcatgggagccagccacaaatgagattctgacgtgtccaggtttctcctgagctcatctacatagattggtagacccttcctttggattaggaaagatgagttttacctctggtacactgtcttggtaagcctggatgtgacagacacctcggctctccttgaataagaaagccagcagaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggcgtcctcagtaggtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtca

SEQ ID NO: 10679 - DNA, 1473 bp, Homo sapiens
ttcccgggctcacacctttgggaaatgctgctctgtgttgccccaagaaccgatgcattaggagaaaggacagagctggaaacgggatgagacacgttgcaaggctggtgtaggaaaggagcaaagaccacaggactgtcttcatcaggaacatggcatttcaaaatagatggcagcttctggatgggtctgtgcttcatctcatggtcataaacccgcagagagcctggggcaattgtttgactcagggtttactcactaaatatttcagagagaggagaaagcattgtctgctctgcgtttgccagcggatgggaaaagagagatgatgatttgaagtctaaatatggtgacacctcttgctccagttttatccatctttattcattttttgggggagaatcttccaaataaattcactgtttatgtaatagaacccctttcatgtaccaaacttcttgtaatttaagtatatttgaaggaagtctttccagaatataaaatacaaatccctggatccttaaaagaaaaatctgaacatatttcatcctttttctgggactatacaattcttaggaatttcaatgattgcacctgttgtaatgctggggagctgtcaggagagctaagcaacccgcacagggtcccggaacgtcctgacctggggaagatttgggatgtgcctttcatgcaccaccctgttggggtgtcagcctcctccagcaccagcctgattaatttgctcccccctctctcctgcaggcttgggaaccagttgatcaagtccattacagttatgtgcaaagttagagtaaatagatcctgattgaggacctatggggcttacttatgaataaagtgcattagctttaatttatgggttttataacattgattttggcttcttagaagccatttttcccctttattctctttgttctctctagtttctgtatgattgaagttgttggattggcgccttctaactaataataatagcagcaataacttcagcccttacgctgctggcattgctctatggtccgtgtgttaactcatttagtcccctcgactaccccatgagacctttcttttttttttttttttttttaatgccaaacattacattttattacctttgagcttattaaccagctttgcgtttattagcaaatacatttaaatatctcttttttttttcttttctttttttattatactttaggttttagggtacatgtgcacattgtgcaggttagttacatatgtatacatgtgccatgctggtgcgctgcacccactaactcatcatctagcattaggtatatctcccaatgctatccctcccccctccccccaccccaccacagtccccagagtgtgatattccctttcctgtgtccatgtgatctcattgttcaattcccacctatgagtgagaatatgcggtgtttggttttttgttcttgtgat

SEQ ID NO: 10680 - DNA, 1064 bp, Homo sapiens
tgcttcaacccaggagttcaaggcagcagtgagctatgattacaccagggtgatggggcgagaccccatgtttattttttaaaatgctctggaaaaatgcaaagtgccatataaacatagaggcattattgtgatcattattactgttatgattcaaactagacagatatatttgtctctaaaatacttactgtttttttttttctggcacattcctctgtgaacctttttcctcagcctcctctcaagataacttagagatgcaaaagaactagaagccaagttccaaatttagttcttgacctttccaagatgggtggtgagtggtgtggctgcaacctgcctgctgccaagagtctggcagggctgccggggtccgggagcgccaggccagtggaccctgtctttgtgtgcagtcctggagccgacacatcgcctcacacaggcgcccctgccgggagctcatgcgggccactccctgttttctcactgggtctagctgaactctggcacagcgagtgtagctgctgagtagttcgtttggtgctgtcctgtgacttgcaaaccccttcctcaaatgcatagcagaaatagtgggaaaaccccagggcttttattatctgggctctcgggcacacagtcagaaacatggcctggggcagcctctcttctctgtgcctttgagtcctgaggaacaaggtcaggcatcaagaataaggaaggccaggatatccaggaggagacctcacgtctgcaccgaggcttcatcagatctgactggaagtgctgtggtccctgtggccaggccagccttcacagggctggggagcacaagccttggtgtggcctgtgcttgcagatggatcctggttgtgtgggggaaggcaggtggcaggtggtggatgctatgcttgagggctgggctgtgtacgcagctcacagtgtggaggtgcttgaaccctggcagttgggcacggttgatagggacgggccttgtgggagaaggtgtcgaaggccagggtgtggctccgagtcccacttctgctagactgaccagagagagc

SEQ ID NO: 10681 - DNA, 1048 bp, Homo sapiens
gggctggctctgggcagacctggggaggaggctgcgggcaggggacagcagggccaggaccccgaggtgagcagggcccactgtggctgctgctcaggaggggagatgaaggaggatgtgagtggggttggaggggcagacaggggctgaattatgtgggtcagcatgaggagtttgttgtgagtgtgacgttggcaggtctgtgtgcttcccaaggctccagaggagcaggaaggatctggaggagggttaggaaggtagcagagataggcgagggttacggccttgactttagcattcccagagcagttgatgtggttgccagagggcctggccagagctcactggggaagaaagccctggacggtgcaagctgccatttcttgaagggaagtcggtcatggaaacatgtcaaagggacctgccagaagcttctgggacacaaggctcttgtgaggtgttttcccgtctcttttgtgtacactgtgggcttggccatccagccttcatttccctagcaacttctctacatccagatccataagagaaacctttctggtcaccccataagggatgcaagctccgtaacgagcactcaggctcctcgctgatgggggctgcgaggttccagaaggttggcccatgcagcaggccactccttagcgcctctggccctgggtagactttggcctcaggggaaaggagcgtggagacagctgtggacacccagattgctgtatatctgacagcgcttggcccccatctatctggaagtggggtgaggcagactgcattttcaagctcaaccctttcctttatggcagctggggtgggtgaccagccctgtgtaagccataataacccagcctgcatgaggataccataaagcggaagccgggcggctctttgaagggatgacgtgggaagggtatcctctcctttccagcattccttcatttggggagcactgcctccttgggacaagactctgtattggggaggcagcactgaatggggaagtccctggtctggtgggggacagccacca

SEQ ID NO: 10682 - DNA, 1061 bp, Homo sapiens
tctaaaaattaatattactaattatgataatctcacaattttatgtctgcttttcttctgaagagctcaaaatgcaagtattaaaataatatgtccaaatatcctacattaggaagaaaggaggacccacggagaagttgggaagatggcatccaacgttaagataaggctcccgtctttctcttgtctttatctctgacttcataaagatagctagtctttcctggcaataagccagaatagtgataggattagggaaacgggattatcttaacgtcacagaaaggagatgaggcacaaataagggaatgaagctaattagatactgcaaaatgccaagattggagaaaactggaatagacttaccctgatggaccttgtctgtggagaacggatatagggtgggtccagggagactggccagccttggctggggcctcatgggaccagaagtggcagtggacagcagagttggtgaggagctgggagggggattcaccaggaaggactgagttctgaatggcagggacgtttgcagacaggagactggcgtctgtccaggagagagcagggcttactgtgagcgagggaagcagtgggatgagtgtgtccggcggtgtctcttacttaagagtgacaaaggaagagtgcaggagtttccgtgtttggccctaacccaggtccacttcactgccctgagagatgtagtgggatgatggaggggactgggggcagagtggatatttaagtctgaggggagaagttaggaaagggttgtgggtcacagaattagagagttaccaaggaaactgcagagaccattacttagtcagttctccatttccaggaaggtttgtcaccataggaaagaaattcattaaccttttattcaacgggtattaattggctatcatgtgcttttcttaccccacaagagcttatgatggaaggtgatcatacaatttatcatccaaattgggatacatttgagaaggaaaggcggcagattatgtgggaacaaagactggcccatgccagctgggacatgtggtcaccttact

SEQ ID NO: 10683 - DNA, 1035 bp, Homo sapiens
ctgttggtgagccttctggtcaatagtaggctatgagtagttaagtctctggggagtaagaagttaccttggattttcaactgtaagggagtcagcgcccccagtccccacattgtttaggggcaaactgcattccatcttcttggactgctcttcccacaggtgttgcccccctcccttttcctctgtcaggtcccagagcatgggttaccaccacagagaggcctctgtggatgcctatgtaaagtggcaccatttacttcagccgagaggtgaaggctgccgtgaggcaggaccatatcactgcactcagtctgggcaacagagtgaggccctggctcaaaaataataccaataataaaaaaaagtgctaccatcctcccagctcctcactcccaggaatcactcaggagcccatggttctgtcttattttgttcatcgcacaattactatctgaaatgatctcatttatttacttattttttgtctgcctcccaccagaatgttctctgttctctgccgtatccttagcactgagcagtgcctgcacatggtgagcactcgacaaaaatttattataaggatgaatgaatggatggaccctcgattctgttattattatgttttaatccagacaacactcaggagtttcactgtatcagtatatccattaggaaggttagtaatgtgtaaaaactctcctgtgaatgctttcattcagtactcagtctgtaaggggtaaatccttcagcagactcttgaggagtgtttaccaagtgtcaggcactattctagagcagtggctctaacctagggatgattttgccttccaggggcagctgtcaatgtctaggaacatttttggttgtcagggtgggtggtaggttgctactggcatctagcggatagaggccagggaagccgctaaacatcctgccatgcacaggacagccccacaacaaagaatcatctggcacaaaatgtcaatagtgtcaatagtgtgaggttgagaaaccttgttctggagtctgagg

SEQ ID NO: 10684 - DNA, 1024 bp, Homo sapiens
agcctctcactccctgagatgcagggccctcagtggatgtccagtaaatgtttattgacaacgcgtctcctgcaggttaatcatcaacaacatgcaacaatatcccagatatgaccggctccctccaaagagagaaacctgctttatggcaaactcattgacttttcttcaggaagaaaatttctgctggtgcagcaccatattctgcaggagtttggatagggtgtgctggaaagacagggatatttttccctaaaggcagtgcataggggcagaggggcaaaactcccttttttattcctgtagtgcttgtactggggcagaggaagcagatgcattaccaagagcgtggaaagaagtcctacgtccagcctagagctcagcgcatctttcagctgccaaatggaaggtctctctgtggcaatgctggggagggaaattgagttaggatggcttgttccaaataaaatgctatatttaatttcactctgggaaacatttgatgtccgggctactgtaatacgtgaaatagatttaagaagatcctttttttgttagaacaacagaaaatacaaaacagggaggttctcagatcagttgcaggttgcacgtaggggtctgatcatttcagtgtggtttttaagcatctggcagctgctggccaacggttgactagtcagtatctagcagcctgagtgtcactgtatgcgttgaatctgtctcagtagttcagcctctgaaatgcctttcaagttaagccaaggcattcggcacaggaatgggaaactgtcagtttgtaaatctgggatgtgtatttgtgtgcttgacatgtggaagggaagggttgagtatgaaccaatgctgagttagatcaacaaatatgtatctgactatatgatctaaaaatcagccaggtagagttccatctccagaactgctgtcccttttatgatggtcataagcgccatggctgctggacgcttctctccctttgtggagctctgccctggtgcatttctgggct

SEQ ID NO: 10685 - DNA, 1032 bp, Homo sapiens
agtgtgcccagcaacctgagcagaggcgatagttgaagtgaaccaagttctcctgagaaatggaggggagtggtgccgggcccacactaggctgtggtatcttcctccctacagtgaggggcttctgtttactctgaagactccagacactcaaaatctcctcccctccctccagtcctgcagttagcctccaggggtttctggtcctaaacttccaccaccatgagattactacaatgccttgtgatactcttgttcttctggtttgagttttggtagataagcacatctgagtcttgctgtgttaatgtgtctgtattttggtgtatctgcttgcttgtcgtgtggggcatatgccaagtccagtagtggatgggctggggaagaccagaccttatcacatggtgcccttggggggaaatcttaattccaatgtgtgaaaccagtgaaagtatgattttctgggtcaattttaaaaatatacgttcaagcaaaaagcaacctgttatctcttctctttctgcctctgcacacagcagcctccattgcctagggtatgatagtgtgggttcactttgtccatctcatttggatgacatcagcgaagatgcattctgtatctctccactgaggcctgtgacaggacctaatgttttgtggagctgagagaaaataaaccaaaatgacccaatggaatataaatgctgatttctgttcctgttgtttgacagaaaggaagtaatgaactaagatgcagtagcctggccacgtgatgtcttgacaggcagctttcagatttggagatgcttcagagtgttgtattgagtctctgggaagaccctaagcactcaattcctagtggtcaatggttggcctgttttgagacataaccagttggaaggaaggatgggcctttctgctccctatgatgttgccttaaaaagacatttcctgggaagaactgggcagatggtggctttaatctcactagccttgttcttcatttttatatccaagcttcaaaaaaccagc

SEQ ID NO: 10686 - DNA, 1190 bp, Homo sapiens
attcggggtgtgacaggcaggccctctctcctagatccaggtccatttactaatgtccttgcccatccatgcctgcaagaaggaagagatgtctgaactgccaggaggtggtggctacagatggtccctggcacagcaagaaggcagtgccaatcaaaggaggtcggcctcttcaattagaactctgagcagatggggctgaggcagccagaaggggcacttcccagtttactaagtgtgtgacagtaagctggtggccttcagaagaccaggagggtcacctggttcatttcctttctggaaggaagggcagtgtttaggataagtcagatgagattcctcctcattggacagataataagctttattgtgagttaagcaatatgcttggccctacggatatcacattaaacaaaatagacctgaccctgaccttactagtttacaatcacacgatcctgaccttactagtttacaatcacaggatcctgacctgactagtttacaatcacacgaccctgacctgactagtttacaatcacacgaccctgaccttactagtttacaaccacacgaccctgacctgactagtttacaatcacacgaccctgacctgactagtttacaatcacacgaccctgacctgactagtttacaatcacacgatcctgacctgactactttacaatcacacgatcctgaccttactagtttacaatcacacctcctgtttcttgccacttgcacacaactcagggatggggtaggaggaggaatatcataaatgcaaattcctgtgccttacactggagctactagatcagactacctggaggctaagcccaggaatctacatttttaacaagcttcatagttcagccttgcacatattaaattttgagaactggttacttctccatcaatgcatggggtaatcagtcaccttgggcacattggtgtcttaaaaatgacttaaacacataattggaactgttttgctaagtctagcctgtgtctacgttgctagaaaagccctttttccccttattctgatggtatagaagaaaacaactgcttaaatcaaatgaattaatgtgttgattgagctttcattacctgtctagcttcatgctgtttggaaaataaatataaaagctataatcctggcccctgatgagcgtacagggttc

SEQ ID NO: 10687 - DNA, 1022 bp, Homo sapiens
taagtagtattattacacacaaggaaactgaggtgctcggagaggctacataactgaacccaagtcagggaccccaactcaggtttgtttgactccagggcctacattctattcccttcagttccctcaacaggaaagatggggcaacatcctgtcctgtcctctgcctcccagttaaaaaaaaaaatatatatatatatatatatgtatgggaataaagacttcttgatgtgtatcaccaacatatctaatttggttttgaatgtgggggaggcaaaatgacattgacagataataggacttacatgaaattctggtttgtttagagatgctataaagagcttggcattgtcgactcatttggaaattcgacttccaaaggagcaaatgcaaagtatttctcaagccccagccctccatttttagatctgaagagggaaacaacaaggtaggtaactgaaagtctggagttgtttctatttagttgttcctaaaggcagggggatggactagaggaaacctgcaagggctttcgactcacagggttctttcattctgtgggcaccagttctctgggcatgagagatgccaaggagctggtgtgttttggagagctcatgctctgaagcacatcagaagaaccaatggttgccgcaagacccccttcctaatgcagatggagttttctgtgaatcccggaaggtgcacttgggtgggagggagttgaggggtagaaaaaggaagacagcccctacgttcagcagaacccagggctgatgtctgcaacagcataaagtgccttctagagtctaatcctggtcatccgtgtagcatctcttcttctctaaaccctcatcctaggctttctttcacgcttatggccacacacagtgaggctttcctctctgcccggaatccacagggcatcacccttcctctggagccagcttggggctttcctgacgtcagtagttttgggggaagccagtgtcacctcatctctgtcttgaagcatatttaac

SEQ ID NO: 10688 - DNA, 1053 bp, Homo sapiens
ttgctggaggctacctacttaccctctctcccccaaaggagaaagacttcagtatcctgcagcgtggcagtggggcaggcgtgcgggtgtgcacatgcgagctgttctgttgttgagactctagttgttgccggttcctccctctttatatgaagcaaggcaacacccacaacaaagcactgtaatctctccattgaccatccttctgccctcagatcaacacaagggccaattccattccaacagcattatacgactttgaaaatactctttgtgtcccgccagaacctcctcctcttctcttcagtttcttcctcatatgacacagcttccagaccctaaccaccctgggtgtctgctttgggtgtacagtagtttttcaggataatgcccagaactaaacccaatactaatagtggtctgctcagagaggggtatgggaattttatcatctgttctgttttgacttccatatgtccaacattatcccccaatgttgcatttcaaccgtcataccatcctttccttaaaaaagcttgtgatcatctgaagcctcagggattttttttttacatgaatgactgttgagcaagggctccccagtcctgaaattaggtaaatttatttaacttaaactcagaaatttactagaaatcttattcattatgttaaaatcagggcctttgatatccagatactgagtcctgactccctcacccactgtccttccctagctttgggtgtgtctatgtcttcatctgagttagaattctatatagcagaacttgattgaaatgctgtacagaattggcctgggagtacagagaccaccttttcagtttatatcaatcagagtcatgtgggtgtggtaaggccgccctgagtccacccagccaccaccatccagcttgggcttctccactttgctcccaaggattgatggagagtgtgcgaggactggttaaagagatgtatgctgtgatagacagggcaggctagcagggggatgtggtgcctggcatgtggcaggcatccactacattctgcgggctg

SEQ ID NO: 10689 - DNA, 1021 bp, Homo sapiens
tattcagatgcccagggacatgttccagcggaggctacccaggataacatttctatctcactgaggtttttttggagccttcaaaattccatgatctgatattttaaagtaaaagctttaaatataaatgtcattgaggtacagcacacagacggcaaaatgcaaacattgtgagtgcacagcatgaattctcacctcgtgcacacggctgtgtcgccagcacccgggtcaagacacagaacgttactcacacctctcgtgccccaactagtcactgcctcccttccccaggaaccactgccctgactcctaaatggcatagatccatttcccctcttgttgtacttgatataaactcatgaagtctatatttttgtctagatttcttgactcagaatcatgttcatgagattcatccatgcctgtagttttaaagttgttcatgttcatcggtgtatagtattccattgttcatgttcatcagtgtatagtgttccattgtacaagtgtgccacggtgtttctacccattctgtcattgatggatattttctgtctttttttaatggagaacatatgcatgtactttaattacctgtaatgcctaggagtagaattgctgggttgtagggtgtgtgcctatgtttagctcaattattgccagttttacaaagtggttttgcaactgagaagttttttcaatgtagaaaatgtgagaacatttatctcctcagcccctgccgacttgcctttatgaaagaaaacacagaggtggggacttgtgcaaggtgaggactgctatttcttgattcctggcctagttgcctttctattagcctgcaaggaacctctcttttgacggacatgagagaaaaggacacgtcctcctctctcccgggtcacactttcccccaacccattctatagctcatataattttccacaaagtgccttatttgaacttcaaatcttcaaggccagatgagcaccacagacgtggccttttcttgtttatccagagg

SEQ ID NO: 10690 - DNA, 1033 bp, Homo sapiens
gccttcctccttagtaactaaacctgatttggggcacattgctacctagactgtaatagactttccagtgtcctgcatggccaggtgagctctggacgatgatagagataaactaaattactgtaggctataatttaaggaagcctcctttaaaaaagtaaggaaaggatccttttttcctttctcccttcctcccttcatttctccttccctcccttctgcctccctccctccttcccagggtgcagttgtaatggctggagttctagcagccactttggaccataagatggaagccaagcattgaggatggcaaagcagaaagctgaaagcctgggacaggatgaccatggggctgccatcccatcccaggactgtctcccttcagacatcttttatgtgagagaaaaataaagccactattatcttttgttttatttatgcagctgcaccaaattctaatgaatccatataagttccaggtgagctggcttagatggtgagaaccaaggtcaaaggcaaagggtagccctgataagcaaatgccactgctgagttgctcagagcagtagacttttgctataacatagcacaggaaaggagagattttggagacagatggagtgtgacgtcgagctctgcctgagaccgactgtgatcttgatcaactgattgtcttgagtctggatttcctaatttgtaaattagagtaataatctccaccccgcaggccattcattggcattagacatcgtatgtattaggtgtcttgtttagtacctagcacacagctggtgcttaaaaatagtggctctgtgtgtacataggcacatggtatgtccccctggccacagacactgtgctatgcgctggggacatacagaggcatacggtgtagccccagctctgagggggcgtgaaggccactgggacatctccagtgttgtagcatggggcccaggtatgcagcctgtgtgtgccttcatgctgtgatgcaggcttgggaatgcatcccaagcctgtgtacagtgcc

SEQ ID NO: 10691 - DNA, 1091 bp, Homo sapiens
gtcagcatggttcgcgttgcaatttcgattgtgggaagacagccaggaaatactaaagaaacaccccatacctccttcaccacagccacaggtactgagcattgagcacacgttatatgttctttatctcctccagtctgcactgctcacttaaaaggtggggcgtattatccccgtttcacagctgagtaaagtgaggttcacaagaatgttgtggctggcccaagttcacacagctaatgaggaggggaaaggatgccaagtgagtccgcctggctcctggagctccttctgcttctccatgatttctgaagaacacacgaggcctccctgtgtcctgtgggagaattcactgtctctactacgtgggaaaatgtgaaagaaggtaggcctgagtgctcccgtaagctttggggaatgagagctgagtgaattggccttactaagtgatctggcagtaatctggtggtcttgagcctagaagagggttggggtgagtgtgaagagtatgatcccccgcagagccgagtcatgacttctcttctgccaggagctcactggactcccatacccttctttggactttagtttcttccagtaataatgattataaagtctagaaataatacgattaacaaccacaactgagtaaatacttgggaattagtgaagtgctaggtcttgtgagcagattctagaggtagaaacagccccagaaacacaagctagaaaaagaggaacagcttccaggagagttccaggcatcctaagggaagcacgggcctctgcatgtggatgggttcgaatgccagattccagcacccctctatggcctctgcaatctgcagtcttttaaaactgtttttacattagaacatcacagggttggactgtgccgccacaaaagcgcctgtcttcattacccatgattcctcaaatcatcaaacgtaagcacatagatgccaaccagtgtctacggggtgtaccaagcacaggcccatgggagccatctaccctgtgcgggcaagaggggagcagttgtctatgggaaatttaaaaacaatcataaaattcacagaaagatggtctac

SEQ ID NO: 10692 - DNA, 1032 bp, Homo sapiens
catttatgatagaattgccttaggtatttcctccacacacatgagaaatgcatgtgttacgatttttgcttcaactgtcaaaatttagaaaactctagaggagacagaaagtgtattcatttgcccatattcttgctctttctgttcttccttacttcctgataacccaagattccttaaaaaaatcatttcctttctgcttagagaacttccttttgccattcttttagtgtaggtctgttggtgaccaagtctattagttttctttcatctgtgaaaatacctttatttccccttcatttgtgaagaatatttgcactggatatataatttggttgacactttccttcattaggcacttgcaaaatggtatgctacctctttctaatactcctggtttctgatgagaaatatgctgtcatttgaattattttcccccctgggcaaggtgacatttcccttgcactactctcaagatattttctttgactttggttttcaagggtttgactgtgatatatcttggtgtggatttctttgggcttatcctattttggcttcactgagcttcttgaatctgtaggtttatgtcttttgctaagaaattttcagccattatttctttgagtactttttcagccccatcctcctctttctctccttctggaactctgatgacatggatgttagagcatttgttataatcccacaggccacccaactctgctcactttttaaagattattttctctccattccttatattaggtaatttctattattctaccttcaagttcattgattccttccttcgttgtctataatctactattgagcccattcattgagttttgaaatttcatttattgttctttttacttttaaaatgttcatttagccttctttatgtcttccatttttttactgaggctctgtttctttgctgagactttctgcatttccacggtttcaagcctgcttgtaattgcttgttgcagcattttacagtagccacctaaacatttttgtcag

SEQ ID NO: 10693 - DNA, 1024 bp, Homo sapiens
ataaagtcaagagcaccgtcagaccaggaggttgagaatggaggtatcaccgtaggtgtgccctccttgatgagtttttgctgatggatatattaaccagcagtggacggtcactacaggtagaatcttcaacgagactcctattttaggtttctcaccataatttcttaatttttgttggcaattgtgcttgaagcaaaaaccaaattagaaatgatgtttgtctgttgttccccttgaagttaggtgccttgattgcgggtcctctttctgtctgccacttcctcgcagtcccccccaaaccccttatagtcctccctgaagctgcagtgttcaccctagcaaggcaagtacctgtgctcccttggtgcctcccatggcacttgtgccaaatgcaagaaagaggagccaacgcagggcccgctgcccagcaggggaggtggaggcaacgcaggtgtgatgtacacagtccctctcaggtcagggaggagagggaagtagggctaggaggaaaatggggcaggagaggaagggagagcacaagggagaactagtggaagggagaggtggatgagcaggacagctcggagagacaggaacgcaaacagaggagaattttcgctcggggtgggaatgaatcatcctcacctgccagccgcgggcctcagcaagctggcagcttcgtcctctcagactgtgggttgcttttagctgtcagccttggatggtgggctcatgcattctgttcccactccaatctgccagagggacagggtccttccccgcagcactgaggcttggccagtcgtgatgcctatggcgaccgcagaatcgacctcaacgagctcgtcgccgggcaccgttttagcagccccaccacccatttttggaaacacaaccctggcctcccattcacagcagaaaagggcacaaggcccttcgtgtcccaccacctcccttctctctggaatcactgtggctctggttgtggaagtttgtcatgagtggaccccagcaaggaatt

SEQ ID NO: 10694 - DNA, 1062 bp, Homo sapiens
ataaagttttcagattgtttttctcatacttccaacccaaacgtgcagaatatttaaagcttagcaaaaaaaattatagggaacttagaaatatataaaacatgtgatgattgtaattttcttgtgttaactgggtttgcaactattttgctaggataatctgcccaattaacctctcatataacttctgaaacttgtttcatagaacacgtaagggcaaaggaaaagcaagactcagtcaatgtctgaagcaaactggagtcaatgaggcaatgcctgcttagaactttgcacgcttgaagtttcatactgttaattaaatctgcctcaattcttttttgagggacaaatgggattcaccatgggaaagagagttatctgagaggaacatcccagattggagaaggaagaggtcaactcagcccaactagagtagtccaacagtttaattctatctcactacaacataagcgttctgtcaggtgagcctgctaagttcctttcctctcttctcttgggtctgtaagagtatcgcaattctggccggacacagtggctcacacctgtaatcccagcgttttgggaggccgaggtgggtagatcatgaggttaggagatccagaccatcctgtccaatatggtgaaaccctgtctctaccaaaatacaaaaaattagctgggtgtggtggtgtgcacctgtagtcccagctacttgggagtctgtggcaggggaatcgcttgaacctgggaggcagaggttgcagtgagccaagatcatgccactgcactccagcatggtgacagagcaagactctgtctcaacaaaaaaaaaaaagcatcgcaattctctgtctcttgtcatggccatgctaggacatgggcaacctggtagtgaacaaaatacctttctctgttcctccactcagggaaatctactaatacttggttagactttaatttttcaattttgcaatctagaaacagaaaatacccataaatatcccaaaatagaaacaaaatgcggcccattcagtttccaaaaagtaaacaaagtgattcttc

SEQ ID NO: 10695 - DNA, 1069 bp, Homo sapiens
cgtcctccatcgaggattagcttggaagggagctccgatgtcatctagcatgatttcccactccctccatctagtgggggattgtgcaagataacatccgagctcccttccaaccctagaatcgtgtgatcctatggtaactttgtgagagggccctctctgctccagagtgaagctgcactttgggacggatgtcagctagtatctagtattctcatggtgcgttttatagttgacagagcacttgcatgtatctgaccacagtcacatgactctggctttattttcatcatcttcattttataggtgaagaaattaaagctaagtaaaggccaagtaaaggggactctgggctcaaactgcctgggttcaagcacttgccgtagctctcacaatatgtgtggtttgggcaagttaatctctcagtgtctcagtaccttcatcggtaggatggggtaatatacttacatcataatgatgtttcgaggattaaatgaaacgattcatgcaagctgcttgggacactggttggaatatagaacacatgtaataaaatgagttgatagagtgagtggtagaggtggtggaggtagcaattaacagcagtggtagtagtatagtagttacacccagcaagtaaatggcataactgggactcttctcagaaactgaccccacagtctgtatgtgaccccagtgaccccagaatttactgcgctgtgtctaccttaggatttatatccacaggtcagaagcagcaggcaaggtaatgagaaaaataaagatgatgtttaaagagatgttttccccatctagccctgagagagtattggctggggagctgaaattctcccctcctcaacctccgataatctggtaaggtcagtggcaggtgcagggtgcttgttatgccattgctgtactatgggctcatggcaggtggctgaatggacaagctcgtgctccctcccgctccccctcccctcctcttgggagagactgcctgcgatgtcagtgtttcttcagtaacccgcgcacattatgtggttccatatggatcagtaaattt

SEQ ID NO: 10696 - DNA, 1027 bp, Homo sapiens
tgtgctgtgacactcatggtcccactgaacttgcaacccaatgagatgtcctcctggttggctggacatttccttaaagacatgagagaagaaagagagctcattaaagtcagaggtgctctctgcttgccctgggcagtgactttgcagcgggaaaccaagaggctgatgctgatgtttagcctgtgtccaagccttgtcacgctgattctgtgcaaagaggagaagctgggagcatcttaggtgatgtccttgtgttagttacttaaggttgctgtcacaaagtaccatgaacagagtggcttaagacaacaaaaatgtatacttttgtatcctggaggccagaagtctgaaatcaaggagttggcggggccattctctagggagaatctgttccatgcctttcttttcgcttttggtgttgccaacagccttggcattccttggtttgtagatgcattaatcactcagctttgcctcggtggtcacatggcttccctctttgtgtgtgtctgttttcccttcttataaggacatcaacatattggattaggggcccacaaactccaggatgacctcatcttaactaattaaattggcagtgaccctatttccaaataaggtcacatcctgaggtctggaaaagacatgtatttggggaagggaggatgctgttcaacccagtgccagcctggattctgtaacaaactgactgggaaggagtctgcgctctcctcggctaacagagagaattctgggacctaacatctattcagcaggcacacaccaagttgatgtgggggaaaagcactggggttggagtcagaaaacttaggtataagcccagtctccaccgtagtccagtggggtaaaccttgctttccttgtctttcccatggggatgataataccctttcctccctcccagggttcaggttaagaaaatccactcacacaaaagctcttcgtagcctgcaggcagtatgcacatggtggatggtaccatgcttctttttgtccaggagat

SEQ ID NO: 10697 - DNA, 1028 bp, Homo sapiens
ccatttctgttgggggtaccccagtagactatgtggtgtatgaccccaaggatatacagaatcacatcgggaggggaaaaacttgttggtatatatatacatatatacaaacattagccaggagaaatggttctgtgcctctcacaaaaagctcacaaaacactgtggtctgtggcagcagcagatgatattgatgatgatagaaaagttctgtcttcactcagacatgccattgatcaagagcatttattcagagactactatctgccaggcatcgagccacgcgacacgagccaccagtccgtttcttcatctatgccgcattgtgttgatactggcaaaggactgaaataggaaatacactcatgtcataggaggtgtcaagctgtttgtcagggcagagaagaggagagtaacgtggcacaagttgtagacatcttccttctgaagacatgggtgattggaacagcatgtcatcaggtgagttttcagtgttgcttccagttctaagctgggataattctgagtattcttaaaatgtactgctgttggaggataatggaaaagcgctgaactcagaaaaagccttgggactgtgagcaccatcaactgcattgaggagacatccaaaagtataatgccttcttcaggctgtttttactagaccatatagtcctactaataaatacttgtgcaaaacagaaatacttttaaaaaaataatatatttattcacttaattttcccagaaataatgccttgatcatatgttttccccagaaattgttagacttaccttctatggtcaacaagagctttcctgaatttcttgagatttagtgaaagcaggtagatgtaaactatattaattacattgcattttccagaaataaaaaaaagcttgaatacccctgaaattcctctgagtattatcatcctgtgctttgttgatagagaatagcagtgacctaataatttcttttttaaccactaattctagacctgaggtgtcatgacagagtatgaccc

SEQ ID NO: 10698 - DNA, 1093 bp, Homo sapiens
gtgtaacagctatggtaggaacagaggctgtgtggaggggcctatgagcagcaggggctgggtcgggtgttgtggaggccacactgtggttttggagggacaagagttaccagggagccaccgggacctctcctgcagtttaaagtggatgtggatagagagcagctgtgttcctgggatcgctggctagccagccaccctgcaggggcagagcaaacaggctgttagctcttgaactgccaggcacactgggggtccttggcagggtgtggagcatgaaggccctcttcctctccagggcctggaggacagcatcctctgcctgcccgccagggtcccagcccaaaccagcatcttccgagcccacttctctctccagaggcttcttcatcttcccagttccccaggatacaaagccgccttcctctttcctctcctgtgcccttccacagttatcagtgcctgcgttcagtcagtcaagtcgtatgggctgtcctcttcgcttcttcgcttggacttctcactccttccctcctctcccctcacctctctccgcctggactcgcagccaccttgctgccctgccttccagccccgttcccacgcaacctgtgtaatgcagccaagttcatatttctgcagccgactgtgtcactcccttgttcaaaagctttgaatgtgtctccatgggtacagaataaagcctgaacatctctcagtatttcaggcatctccaacctgtcccagccaatagcttgaaccttatcactccctactgccctgccgcaaagccagactgcatcttgttttccagaaacgcctgctgctgtcctgtttctgcacctttacccatctcccatccctctgcctacagcacctgtttcctcccctgctcctccgtggcctcctagcccaggtcgaagagcacgtcttggctcaggcctcccagagcccccatctcaggacaggcactgtcagcactcaaccctcacctacccaccagtcggtgggggtggcccagccgtcttgttatatagaaagctcttgggaggcagcagcgtgcattggtaacttcttattcactctcccactc

SEQ ID NO: 10699 - DNA, 1072 bp, Homo sapiens
gggctgtggcttaggctgcttcctattgttaccatgtagaaatcactcagggattgctctctgatttcatcgcgagtggttattcatttatgagaccacggaccttgtaaacagctcctcatgtggaaacaggtgtgagcggtggtagaggcaacagtgtcctagctactcaaaaatgccctgtgaacagcatggcttaaggctcaagaaaaacttaatctttgagtctctagattcttccaaagttggtctctttggagagttgtcattaccggggcaggagaatgccacacagacatctcagagcgtcctcattcttcctctttctactgtcctcatagctgctcctgactttctcttgtctgccattatagagacatgccataggaaatgttaaatcaatacatgttactaaaatacaaaatactatcaagattatctgaacagatccaaagtcaagtcttgaagtgaaatatgacttaaataaatgaggtcttaaatgggagctataaaatgcaacaagaaaaaagacagttaagacaaatgtttaaaaatcccaaatgaaggattctgaatgtttaagaagtaaaacaggttttttttggttttgttttgttttgtttttgtttttttgatgcctagaggttggttcaattaggccaggcaagccaagtacctgggtgcgttgtcagaattatctccattttggtcctgttcaggctgggattgacccagaagaccttcaagcatttgcccagggttcttagaagtgatgagcagctgtgatggttttcaggatggatccaagaggccagcaatggctcaagcttcctgggagctctgcccaacactcaggagttaacatggtgtaggttacctccctctggacctccctccctgccccactgaagcctgagaaacacagaactccttgtccatgagcaagggagctcaagcactgggccaggagcggggcagaaaggtgccagtggatagctagacctgaccatcctgggcaactatcacacaccagagcaaaaggggtttaggtgctttgccaagaaatttcttc

SEQ ID NO: 10700 - DNA, 1157 bp, Homo sapiens
ttctacgagattgttattccaggaaagctcatttcccctttgatccatcattccttcccttttacctttctactcctcaaagcccctgtctattcttcgtggaagctttcccttggagggtaaccacacacctaccaggtggcgctaaagaagcctttacgtttctgggaaatactccagccctggactaactaccagaggaatactcagctcccaagtcagagtttaaggtcccatggagagcctccgggttcacctataacctggtttcttccttacctgttttgaactgtttctattctcttcactcatactcctctcgctctcctgtctccaaaccagaccttagtctgacgaccactggcatgaaggaagaaggaggaagtgtggcataaatacttccccctttgccgattataataataatctattattcaaccttttactggtctaatcttccaacaactgtaggagatagggattatcatcactgctttacaaataaagtgtggagaattttaaaaacttaccatacagcggaaacttgaactcagatctctcagccttttgtctcctttttcaaaccaagtcttgctgcacctcaagaaagacaagaaggttagttgactcataagccaagctgctagtaactgaatctggagggacaagtaggcagaggaggatgaacacagagaagtccctttatgttccctctggaggcttgcaggcagtgctggtgcccctttctgccccaaaccctggggtactcactttctcccccttcctcccaggtcatcaagagagagggcacaggtacagagatgcccatgattggggaccgagtctttgtccactacactggctggctattagatggcacaaagtttgactccagtctggatcgcaaggacaaattctcctttgacctgggaaaaggtaggcgtggtcagtgggctggtaggataggttcgaggtggacacaagctgtcacaagcagaaaccattttctcaggaccaagctcagggaggaatggtttatcacagtctgttaactctttcggtcactcttttttttttttttctaccgttctgtaactatattgatctctgtctccccttctcctcatcacctcccaacaccttactcccccttcaaa

SEQ ID NO: 10701 - DNA, 1021 bp, Homo sapiens
gccaggagagtaggagtcagtggatactagagcatatcccaagggattggggtgagagggagaatccgtattcatgtatgcatttgttatgtgctgagctcccatgataagccaggcatcactcaaggcactggaattgccatagtgaataaatagacaaaaattgctgccctcctgggccttattatgaagaaacagaaaagaaacaatataggctaggtgtgctgcctctcgcctgtgataccaacgctttgggaggctgagatgggaggatcacttgaggccaggagttccaggctgtagtgagctatgatctcaccactgcactccactccagcgtgggaccctgtctctatttaaaaaaggaaaagaaaagaaaaactatacattttgtaagataattaagtagtatattagaaggtagtaagtacacggccagacgtgatggctcatccctataatcccacgactttgggaggccaaggcaggcagatcacttgagttcaggagtttgagaccagcctggcccacacggtgaaactctgtccctactaaaaatacaaaaagtagccaggcatggtggcaggcacctgttatcccagctactcaggagactgaggcaggagaatcgcttgaacccgggagacggatgttgcagtgacccaggatcatgccactgcactctagcctaggcaacagactccgtctccaaaaaaaaaaagaaaataagtgcagccgaccacggtggttcacgcctgtaatcccagcacttcgagagcactttgagaggctaaggcaggcggatcccttaagctcaggtgttcgagaccagcctgaccaacatagtgaaaccccgtctccagtaaaaatacaaaaattgggctgggcacggtggctcacgcctgtaatcccaacactttgggaagccgaggagggcagaccacaaggtcaggagaccgagaccatcctggctaacacagtgaaaccccgtctctactaaaaatacaaaaaaaaaattaac

SEQ ID NO: 10702 - DNA, 1031 bp, Homo sapiens
acacacacacacgcaaggctcaggggctcggtgggtacaaaaagccagtggaaacggataaatacctatagcgttaatagcagaagtatgtccaaggttttgcacagggtaatcaaactaactggcttcagacatttgcagccacaggaaaaaatagctctcagccttatgagatggacattcctatactaactcccgctctttgttgtattgaattctggctgtttcttcccccactcaactgtgagcagatgtgcacagactccgagaggcagacaccaggaggtccagggacataggttggtgaggcatggcggtctagttgtgggagataatgaggcccagaaggtgtggtgagagacatggtggtgtgggaagttgagttgtgtttggggtggtattgggtgatggacaaggacagcagtcagcagagccttcgacccagcccaagcaggcaccccattgtgcttaggttcctatctgtggtcttgatttggctttgcttttcttgggaggaagatgaatcagaatcctggcatcgtgggccctctagtgaaaactcgtcctggggagtaggacagctgctgagaagcagagaggaatgcggccagctggggaaaatgggacagcaggggtcagggaggtgattggaagggcagacaccatagtccccagctacctggcttcaagagcccccgttccccacacgcctcttcttctaaggcaaggtctttccctctggggactgactgagacagcagtcactggccaggctcttggtacaaaggcaggaagggtagctctgagaacggggctttcagccgcagcactccgtgctccaggtcgatgcagcactgcggggtgtagagcagtcatgccaggtcacctcagcccgccacctgcctcccggcctgctccttttgttccccctcccacttcccacagcttccacctgccttttgctcttcccccatccccatttccctagactcctgttgaagggggtgacccagttctcttgatttttcact

SEQ ID NO: 10703 - DNA, 1002 bp, Homo sapiens
tgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccactaatggtctttgtttccttaaccactactcattaatccttaatcacctcattcaaactaattcattctgcatttttgagtaccaactcttgtcaggctcagtggcagcttctacgacctgatggatggaaaaaaatcaaactctgtgactctatggttgactgccacctctgcaaccttgactcatctgctgaaaaggcaagaagaagaaagggcagcaagccctgttttagggactacataagatgaggggagataagggggacatagatgagttctttaggattgcgtgtgttttgagtttttgtttctaactgaagaaatctgtcaatattaaatagggtgggaaaatggtttcttagaataactgttcaactgtgtgtaaataaggaaagttttcaatgagtattacttattgtaattaatgcagaaggacttccccagtcaaccgaatgtctcggccttttactcagacaagtagcatctcattaaacccattcatttagcattcattcagctggacctactgtgtcaggtccagccccaactagatcaagcagggattactgtatattttacagatgggagtttgatgcagagaatgaaccatgcacaggtcacacagtgagtgcacgctgacccaggcagtgtaacggtccactctcagcgtgtgcctcctaaagtactaacttgtaggttcaaaaccaatgtggaaacaactttgaccttagaacgccataaagccatttgtgcagtgacttgtcaggactcaggatgttttgtagggactataatgtgcatgtcggtagggagaaaggg

SEQ ID NO: 10704 - DNA, 1024 bp, Homo sapiens
cactccagcctgggcgacagagcgagactccgtctcaaaaaaaaaacaaacaaaaaaaaaaacaaaaaaaacttggagacggctgtggtggctcacatctgtaatcccagcactttgggaggttgaggcaggcgcgtcacctgagatcacgagttcgagactagcctggccaatgtgttggaaccccgtctctactaaaaatacaaaaaaaataaaaaattaaccaggcgtggtcgcactcctgtgttcccagctacaggggaggctgaggcaggagaatagcttgaacctgggaggaagaggttgtagtgagccgagatcgcgccactgtactccagcctagcgacagagcaagactctgtctcagaaacaaaaacaaaaaaacttggattctaaagatacgttgttctgtagatggtctctggaccgtactttcctcctttctcctcaatttcatttagagcataaaagcactttcttaggctgtttgaagcacttggattggaaatgttgcctgcagtaacctgtataaacatcaatatatcaataacagattattagtgcaaaatttaaatgtccaaaaactgaaagggaataatgatcggtgactgggtctatgaaattacaaaagtaaagcctaagggagatggcaagctttcctattctgctacccttgtcagctgatgtcttggtagaattaataaagtactctttttaaactcaaaaacatctgttttgaataatacttttttttttaacaccctacctttgaggtaactattgttaatagtttgtgtatatccttctggaattcttctattcctgtagaccttgcagatactttttttttttctacttgcagttatttttattttttgttttttgagagtgtcttgctctctcaccctggctggagtgtggcggtgtgacgatagctcaacctcctgggctcaagcaatcctcccacctcagcctcccaagtagctggaactataggcatgcgcaaccaagccgaaatactttt

SEQ ID NO: 10705 - DNA, 1063 bp, Homo sapiens
gtgctgggattacaggcgtgagccactgcgcccagcctttttttttttttttttttttttttttttttttttttttttttgagtcagtgaatttagagacataaaattttataggagttttttttacatgcctaggagtttcaaaggaatattttaaaattaaaaaatctctttggatcagatgtatacattctggtgttaaataacgtacgagaagctggcatggtagtgtgcacctgtagttccagctgcctgggaggctgaggaggaaggatcccttgacctcaagtgttttagttcagtctgggcaacacagcaagacaccaccctccatctcttaaaaaaaaaaagtgtatgagaatgttgttagagccatgaaatgccaataagtgcttaagaaggaagtcactcagtagggggtaagggaatttccacaaatgcaagctgagctttcaaatggtgtataacagcaacaaaggcagcaccacataatgaagaaaacattgggctgggaatcagaaggctttggtctagttctggctctgccattattcagctgtgtgattttaggtaaagttcttaaagtcagttggcctcagtcatttcatctgtagagtgaagttagactggataaaataatagaatgttagaaagaatcttaagcgtgtctaagttagagccaagatggaggcatattgaggaagggcaggctacagctcagcccaggcatcccaggtgggcagtatcttggtgcgagcttcacagtccagagtaggccagcctgcccaagggatacagtgcacacccatcagtgacggtggcacatcctagcagttaccctcaatggaggtggcagaggctggggaagccctgcccagatgtacattagattagactcaggaattctgctatggcagtgtccctttggttaagtgtcactggtcatgagctctgtaggataagaaacagctaaaagcaaccaaagttaatcagtctcccgaggattggtttgtattagccagtctcgtaagtgatgaatctgaatctgagaatcactttctag

SEQ ID NO: 10706 - DNA, 1094 bp, Homo sapiens
cactaaattcttgggaagatagattcttttacagttcaattcccaagataattaggaaatttaaaagtgattaagttttagtttatatgacacttaaaatcacgaaggcagtgtgttttaattgcatttagggcatctaaccatcagctctggctttcttcctggctccctgacttactctatcttggtaatgagtccttcattgatgtagcctcgtttaaagcacttttaggttttcagggaagtaaaatatagatggaataggaattgacattgttacattcaaacacaagtagcacttctctcctcccccatccaaactgcatgacggttttcaccaagatggcagcttgcacatatatgtttaatggtatttttcttatttgtaaacttggacagtagtaagatcattcaatactgaggtatagtagctgtggccctgattacagtttgagtctacagttgtttttttcttaagtcattggtctaaatgagtttgatttgtctgtaagtagatagagagaggcttccccagataccttggcaggaacactgtggtcaggggtctagtctccccttaacaagtgagagcttagtttgtcagtgaactggatataaccaggtcctttggcacaaattcacgctagttaaacccacaccagtaagttttaaaaccagaaccccaagttattaatttataaagggagctctactctttcagtgtgtattcatgtctactgttcataatactcttttcctgggaatacgatacctaagaagttaaacttcaaattagaaggcttattggtgagcaaggaatcagagggaatgaggtcaggagtttgagaccagcctggtcaacatggtgaaactccatctctactaaaagtttaaaaatcagctgggcatggtggggtgcacctgtaatccccgctactcgggaggctgaggcaggaaaattgcatgaacccgtgaggcagaggttgcagtgagccgagatcgcaccactgcactccagcctgggcaacacagcgagactctgtctcaaaaaaaaaaaaagatacttctctttcttggacaaacctgataaccct

SEQ ID NO: 10707 - DNA, 1048 bp, Homo sapiens
taagctcaaatttagtttatgatctaattttttctgtctcaggtcagctattgtgaggctttgtcccattttgatacttactcttcattactctcaatattcatatacttaatttaacttttcagttttcctcattctgtcagaagactgaagacacgggtaaattactaagttgctttgtccactaagtgtttttcaaagagaatcagattttgagtctcggcctgttgttgctcatgtatggctgtcctttcaggatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaaggtatgagaattgatttctaagaaaactcttgagagagagaagaatgttgtgggaatagattgttgatgggccttagggaactaactctggtattagaccaagccagctggaagtagattgtatctttcagtccccagatgctgtgttctcattttctgcaaagagctcatggtctaataggcagcaagctctaccctcccacaaataagagctttatccacgaagtgggaaaatggacgggtagttgttaatgtaattattttcacctgtctcccatgattgagtttttgaatgttactgtttgttcttttggtttttctttttattacggaagaacatgacattgtggaaggagagtgagttttagggaataggaggaattagaaatacagaaggacctacaagttaaatgtcttgtttctcaccctagaagttctaatttattttataagtttgagccagcgatgaactttattttattaattttgtattaataccaggtcttaacagatgattttaagagcctagaaataagataatgatactaggtgttaattcttctaaccaccatttattgagtgtttacga

SEQ ID NO: 10708 - DNA, 1031 bp, Homo sapiens
gccccggtgactgtcacaaagcaatgcctgttgccaaacctgtggctcctccttctccttcccagtggaagtggaggacgttggtccccagctttggaccttgcctttcctgcagttgaggtcagtccagtggcagttggaaattcagggcttgtgagggtggctttaccttgcctgtcttcctttgcccccatgaccctttgttggccggggttggacgacagctccctttaaagctctgaaattggagctgaacagctgctgtccagtaaaggggggtgagggggctgtcagcagccaggagggcccaggtggaggtgggggcagggctttgtcactggggagaacacggtctccagctcctatcttctaattccacttttgcctggacgctttctgagatgacggttcttcccttgcttttggtttttcccgctactatctgggagattctaatcacacctgtgtgatctggccctggggcccttagctggtggggactggatatttgggaaaatttccactagaactcaggtctccaagatctatgcccacgtcctcctgcatttaatacaggggggctcctggaagggccagaggatgggccaggctccctgtagcgggggctggctccttggcttggtgtgggcaggcgggcccccatgggtggggactctgcttcctttgacccaaacttcatgggaacaatagacttcagaggagtcaccaggggcaggaaatgggaactgtgcagagccaggggtgaccctcctgggggatgggattgcatatccggtagagggttgggggcagtgcagagggcgctggggaggggctgatgacacatagggtgggcctctggggtggggccctcctccaaagggggccgttgactcagtgtgaagctagagctccgtgccggttctgtgctgagctttcggctcttactagcacagggctcgtgtttgccagcctccgctcgtgccacgctcgcccctgccaggacttggtcttccccttcccctcaagcc

SEQ ID NO: 10709 - DNA, 1033 bp, Homo sapiens
aacattccacagagttccagaaagcaaaacttgaatttgctgctcactgaatgctgcattgaatccatgcaaatgaagtgatgtgcatgcgttgtgttaggtatgataagttctctagaaatgatttaaagcacatgggaggatgtgcgtaagttatgtgcaaacactgtaccgttttatatgagggacttgagcatcctcgggtttcagtatccttagaggccttggaaccgatcacccacagataccaaaggactactgtacatagagtttcattatgtagaacttactagggatgctttggaggagtctctgccctgcatgggaaaggactaggtcacctccagggccactgcttcctcgaagattttgtggtcctgggcctcagtttctccacatatcagcatgcggggattccactagatgaaacacttcgggattcctgctacagggaggtagtacagcgaagctgcacctggagttggaggcaaggcttgggacgagggtgcagtgtctgagcagtcagaggaagcagaatggggagatgagggaattattgcgtggctgccatcgtctttgtccaaacaagcacggtgttaggaacaggcggaatctgggtcttgccctgaggctggagggtggggaagatgaccccccacaaccccagagagcagtggctatcagtgcagactccagagtggtgctgtccaatagaaatactatgtaagcctaggagttacatttaaaaagtaaaaagagctgggtgtggtggcttttgcccatggtcccagttactcaggaggctgaggcgggagagttgcttgagcccaggggtttgagaccagcctgggcaacatagcgagaaccctgcctctaaaaaaaagaaaggaaaacttaactggtaaaatgcattgtaataatatattctttaacctatgactacaatattatcattttaacgtaatcaatagtaaaaagtatcaatgagatagtttaccttctttccacacaaagcgctagaaccgtagtgtgt

SEQ ID NO: 10710 - DNA, 1071 bp, Homo sapiens
actcccaggtccctgtgaggctgggccaggatctgagctcaggcgtcttgagtccagagcccaaacgctaaatctctgccccaggcgtctctctctctctttctctttctccccttcctgctctctctccctttcccccttcccttctttttcctctctcttttgaccaggcattgctcaaggggtccagctctctgacttttgttccaacatctccttagcctgggaaggattgtggggcctccccccctctcacctgctccccgttccccatcctgtcctgaagccaggtgtgatgaaggcctcacaccaaaggatggccgggaaggtgctgccgtgcattgccttgcaggggctttacttgcttttctcaatcctcagtggctctgcaggcaggaatgctcatccccatttgacaggtgatgaaacagaagctttggggaggttcagtaagttgctgaacagctgtgcaacgtagctggtgagaggcaggtttcactcaggtcataggactctgaggcgtctttaacatgtcccggacttcacgtggcctttcccgagaacttgttgcatttcaggagaggaaggggcactgctcagcaagaggaaggcactccagtggtgggagctcaggccctgggacacctaggttttcttggtcttgttttctgagaagggcccttttttggcctccggcaggccctggcccttccgaaatcacaatgggatctgtttgtttctaactgagtacacagcctggcccggcccagcccaaccaaatccatttctctgctgggttctttccttctccaccaatccctttccttccatccctcgggactcacctgcctgtgacctggggactctcctgtccttctcttttcttttccagctgtaaccaggccctttcctttgctcctgtatttcgggcccaggtcccctgcagaccctcttttccttctctgccctcttctttttgtcttctatctcctggtgcgctttaaacaatttttttggtgaaatatatgtaacataaaatttgccatttgaactccaagtgtgcagtttggt

SEQ ID NO: 10711 - DNA, 1658 bp, Homo sapiens
tcattctgtgttcatcagctctgtgcagcgtgctgaggacttacagaggaagacagctgtccctgtccccatggtgtctaaagtgtggtggagaccagtccttactgggagatgggggctggatatggaaatgcaggaatctgctaaggttggagtcatcttcccagagggagtgacatatggctggaccttaaggctgagcaagagttggtccggtgaacaaggaatggaagggaagtttcaggtagcagcacctccaccaggagtggagaaagagcctagcatgttggggggtgatttggatggctgagtttggggcttggaggtgggttcaaagaaggaagtacagagggtggtgcctgtgtgcggaaggtatggccggagagcagggatcagcagatggaagcgctagaaaatcccatcatggagtgtgtagtgttatcttaagaacaaagaaaaggcattgaaaatttttaggtagcagaatcatgtgatcaggtttgcattttagaaaaatcactggctggggtgaagagattatggagcctgaatggggttgcaccaggtcatccagatgtgcatcgctggaagcttggattagggctgtgagatagagtagattcaggagacatgtaggcgacagaaagacaggatgtggtcattagttagatgtgggagatattaataagagggaaaagtcaaaacagtcatgtgctgcttcacgaaggggatgcctcctgagaaatgtgtctcttggcgatttcatccttgtgcaaccataatagagggtccttacacaaacctagatggtatagcctacgacacacccaggctgtgtggtacaacctattgcttctgggctataaatctgtacagcatgtgactatactcagttctataggcaactataacacagtggtaactctaagtgttagtatttgtatatctcaacattcctaaacatagaaaaggtacagtgaaaataaaatataaaagataacaaatggcacacctgtatggggtacaccatgaatggagcttgcaggactggaagctgctctgggtgagtcagtgagtgaatggtgagtgaatgtatgctactgtaggcttgactgtacactactctacactaggacattactgatactactgtagactttataaaaacagatacttaggctacgctaaatgtatttaaaatgatttttcttcaagaatatattaacttggctttctgtaacttttttactttataaacttcttaattttttgattcttttataataacactttaaaacgcaaacacctcacgcctgtaatcccagcactttgggaggccgaggcgggtggatcacgaggtcaggaggtcgagaccatcctggctaacatggtgaaaccctgtctctactaaaaatacaaaaaaactagccagtcgtggtggcaggcacctgtagtcccagctgctcaggaggctgaggcaggagaatggcatgagcctgggaggtggagcttgcagtgagccgagattgcgccactgtactccagcctgggtgacagagcaagactctgtctcaaaaaaaacaaaaaacaaaaaacaaaacccaaaaacgcaaacacatcgtacagctgtacaaaaatattttcttaatttatatctt

SEQ ID NO: 10712 - DNA, 1045 bp, Homo sapiens
agggacgggcaatgtgtgtgacgcggtgaggtcctcctttacaagtggactcggtggctgggatggggagaagttgggggctctgcgagggctgtgggaggtacgtggttcccagctggtactcataacccaaaaactgccttaagattactggtatgtcctgctccttcacaaacccctgagaactatgtttggaagcttacagcttggatggttggagccaagaggtcactggatttgtctcatgttaggggaaggtggggttgtgaccatgagcctccagaggcaccagaaagtcaatcctgccgttgctccagtgtgtgaggagctgccaagactgtttctttcagaaagagcctgagttgggaagggaacaggagaatagtgacctacattatattgtatatgcgtttttaaaaatttttcattgtggtaaaaaagaccacaaaatgtaccatcctaaccctcttgaagtatccaggttggtagtgttacgtatattcacaatgctgcgcagcaggtctccagaacttcttcatcgtgcaaaaccgaaactctgtacctgtcaagtcacaactctgtgtctttctcccacgagctcctggtaaccaccattctactctgtttctatttgtttgaccacttaagaacattttgtaaaaaaaatttttagtagagatgaagtcttgctaactcctggactcaaatgatcctcctgcctcagcctccctaagtgctgggattacaggtgtgagcctctgcaccctgccgactactttatttttattttattgtattcatttattttgagacagagccttgctctgtcacccaggctggagtgcagtggcgcaatcatggctaactgcagccttgacttcccaggctcaagtgattctctgccctcaccctccagagtagctgggactataggtgcgagccagcacacctggctaattttttttaaattaattttttgtagagatggggtctcccgatattgcctagactggtctgaaactcctgggctcaagggatcctcctg

SEQ ID NO: 10713 - DNA, 1042 bp, Homo sapiens
gtcctctaggaatcctagctcaaaacagtggtcttggggcaggagtgagagccctgagtgggtctctaaatggctgaagtcagtgacaacggggcccctgcctggcttccaacaggatggccccagaccagctgcccacccccacgggtttccattcatttctcccccacacccaacgctggtgccacccccaccattgttgcttggctcggcttccccagggtcgcccttacttctgggtcggccctctagactctccctgctttgaccacttcttgctctgatggttgcttattttttcctttttcttttctctctctctctttttttttttttgagatggagtttcactcttgttgcccaggctagagtgcaatgggcgcaatctcagctcaacgctacctctgcctcccgggttcaagcgattctcccacctcagcctgccgagtaagcttggattacaggcacgtgccaccactcctggctaattttgtatttttagtagagacagggtttttccatgttggtcaggctggtcttgaactccagacctcaggtgatccgcccaccttggcctcccaaagtgatgggattacaggtgtgagccaccgcacccagcttttcttttcttttcttttgtttttgagacagagtcttgctctgtcgcccaggctggagtgcagtggagcaatctcggctcactgcagcctccgccccgtgggttaaagtgattcttctgcttcaccctcccgagtagttgggtctacaggcgtgcgccaccacgctcggctgattttacaggtgtgagccaccatgcccggccttgcatctgtatttctaaataaaatacttgaatgtgtttgtggcagttaagataaaatttgtctttaacagatcccaaataacagtggcttacataagggaaatttccttctctctcctataaatgtctggagggtaggtagtccagggaaggtgtggcagctctgctccatgaagctctcagggacccaggatgcttccgtcttgtggctcatgagca

SEQ ID NO: 10714 - DNA, 1102 bp, Homo sapiens
cagctgaaggggttcctgggtttatttctcctgagaactggcatgggctctgagttttgccattcctggcttcggtcctagcattctaagctgcctgaccttgggcatttgtcaacctgtctgaaccttagtatcctttcctctctgtagagtgggaagagatggagtctgtgaagcgcctggtgcaagctgtactaatacacctaacaatgagctcctccctccctgcctccttgcctccctgcctccctccctcccatggggaggccagaatctggctgcttgctgccacctagtggctctttggggtcatcttccctcataggaaccacagatccagtagcctagagcagaaagggaaggaagattcaacctaggggtgtttatgtttaccgtgtgtctggcactcgtggagatagtgcatgggactacataagtaagacagcatcgaagaggtgtcttggagtgtggttaggagcgagggctctggagtcagacaagctacagactagctgagtgaccttggggcaagttatttcatttcactgtgcctcagtttccccatctgtaaaatttgtataacgataacctacctcgcgtatctacagtgcctagcatagtgccccacataaatgtgttcactaaatgtacgtcgttattaatcataggagcttgcagtctcactagggccgactggaaaactattaagtgatcctcaaagccacaggcgctcagagactggagagatcaaggtgcagaagactcagggaagggtagtcttgagggcagctgcccttaaagggtgggcagcatttagtgaagcagatggagggaagttgaccggcatcccagatgtggggaagaggccagcagcctagtctcctccacggcccagcccccactgtcttaccaaagaacagctttaaccaaacccctctgggcatcaggaccaccgctacacctcttgccaggctgcagagctatgcagtctggaggcccagctctcgtcagaagctggggcatgggctctaggggaacctggggtcggatgagcccctgagcaggtggcaggtgcctacatgtcccagtgtgggttcgtgtt

SEQ ID NO: 10715 - DNA, 1051 bp, Homo sapiens
tgtaatctgataacattaaggaagaaggccaacaggtttgttttattgagatgttactcacataccatagagtttgtctatctgaagaggacagttcagtggtttttactatattctcagcgtgtgaccatcagcactgtcaattttagaacctttttatcacccccaaaagaaactccattagcaatcactcccatgccccccttccctgcccccagtttttctccctgtctgagtcaaccattaatgtatcttttgtctccatgatttacctaccctggacattcatatgaatggaattatacaatatgtggtcttctgtgactgacttcttccacttagcataaggttttcagggttcatctgtgttgtagcacgtgtcagaattccattcctttttagggctcagtaatattccagcatacggacagaccacattttgtttatctgtacccattcgtcattgactgacttgtgagttattaccaccttttctggcttagacataatgtggctgtgaagttcatgtgccatgcttttgtgtggccatatgttttcagttctcttgggcaaatacctgggagtggaattgcaggtggtcttagctcaggctgctgtatatcacaaagtcccacagactgggtggcttataaacaataggcatttatttatcccagttctggaggctgggggtcccagatcggggtgccagcatggtcaggtgctggtgaagccctcttctgggttctaaacttatatccttatgcagtggaaacagggcaagagagctctctgaggtcccttttaattagggcacaatcccattcctgaagtctccatcttcatgacctaatcacctcccaaaggccccacctgctaataccatcaccttggggcccaggatttcaacatgagaatattttggggacacaaatattcagtctgtagcactgggtcatacgataactgtgtgttgaactgtttaaagacttccagactgttttccaaagcagctgtaccgttttacattcccactagaagtgtgtgagga

SEQ ID NO: 10716 - DNA, 1026 bp, Homo sapiens
agccgtggcttctcctcccagctctgcctctcaccagctgtgatttggggcaagcagctgaccttgtctgggtccgtctcagttccccatctgtaatacaaggggtgggctggctaatttctaggatttgtggatggggttttaaagaacagttttcctgagatataatttgtacaccatcacactctcccattgttacaggctcaattttgcccctgcaaatcctaaccccatacctcagaatgtgactgtatttggagggagagaagatctttaaagaggtgactgaggttaaatgaggtcaccagggcaggccctaatccaccatgactggtgccgttataagaggatattaggggcctggcaccatggctcacacctagaatcccagcactttgggatgccgaggcaggaagaccacttgagtccaggagtttaagaccagcatgggcatcatggcaagacccctcatctcaattaagaaactgtatatatagagagaggatattaagatagaaacaaacacagagggaagacaacgtgaagacgtagggagaagacggctatctacaagccaagaacagagaaaatggaagaaaccaatccagctgacaccttgatcttggactcagcctccagaatcatgagaaaataaacttctgttgtttaagccacccagcctgtggtactttggttatggcagtcctagcaaactgatacacctatttgtatatttaatatacaactcaatggtttaatctgttcaagttgtataaccactgccacaatttatattttgaacatgttatcacctcagaaagaaaccccatacccactggaagccattctctatatcctcccaaccctcattcctcccccagccctgggcaaccactaatctgtgttctgtctgtggtgttgcttatattgtggatgcttattttaaatggaatcatgtaatacgggttttgatttttttgtgattggcttcttagcatacttagcataaggttttcagggttcatc

SEQ ID NO: 10717 - DNA, 1003 bp, Homo sapiens
tggtgcaatggcagacttcctccctggccagcagggaggcatccttgctttgttactaaactccgctggttccttggttctatagtctctattctgtttcagtgtgcaatgaggtcagcagaaacacagataataacgaggctcatgataagagtagtgaagactgtgttctccctagaccacttccatcatgtttggtttcagcatgcatttggaagcagtcatttaatcagcaagtatttattgagtgtggctgtgtgcctggcactgtgcacagtcactgaggggagacggggcgggagaagggagttgggggactcggcggataagctatctcagacagtagcaggttagctcctttctttggcctgtgcttttggtatctgtctcatgttgttagcacttggaagatgggtgctgtgcttgttctagctttgctggaatttctaggggttggcagggtggggctaggagtcattttgctgtggaaactcagggggtcactttcagaaatggaatgtaggcgtgcccaatgcagctcctgactcactttccccatggctggtggatttgagggtgggcctgggagtttccagtctgtgtagagaaggggtggtggtaaggggatgaccagtctcccccttcggagcgcctcaggtcagcactccttagtgagtttgcttccctacctccaccccggctgccagcctgctgtggctctacgtgctgcagctgggcccgcagagcttaaaatagcagcgtgagctggccgctgggcatgtggggagcccgcctgaggcctgatggggcagccgcctgggcttggggctctactggctttaaccactggggtagagagtgttttggggggtttcttctaggcccagagctggagaatggggaatggatgtagctggagttcgggtgtggctggtgcagaggggaagcaaagggcttgtctttcctagacctttgaataaagggaatgcctcgaacctgacct

SEQ ID NO: 10718 - DNA, 1170 bp, Homo sapiens
ggactgtcctgggatagtcctgtagtaaatgaagaaatcagcttcttcgccctggggagtagcttagatccagggagaacctggtttagttgaatatcgagggtgagttgggtgacaggtaccaggcaggtgacattgaagtttgggttttcttctcatcctgtcacccttctcacagtctgatgagttaggagaccgctccccaccaagtttccagcgactcttgtactgttctccaaccttataggcaagagcagaaagtgctgctctgtgggtcttgggcttttgtacctgagtctgctggtggcatgacatctcgccagttctgcagggagtaagggtgggtttctagtcctgctttctcctaggggtctcggaggaagcatgtgggcagttctctgctctttttccttcgtgcaccttggggtttcaacctggttttctcttccaggtcctaccccatttcctcccaagtggaggatgctgctctacttcctgctgggatttatagaccatactatgggtttcttggaacctcttctttccaggactgtgaaatctggttcccatggagtgtcccagcccccgacgagccatcctctgcttgatggctgctgtctctgcagcatccaagaacaacagtggctgcttgtcctattacaaactcaactgactgaaacctgctgagacactgtgggaataaattatccccaacaagctctcttgtgaaaagccaggcctgtctcctgcacctcctgccccctcttcgctggcatctcagcagggttcccagaggcagcctgctgcctgtcctgttctcacaccctttctacctactgtgatggtttctttctaaccacaagtgtgataggtcaagagactttgggcgggaggggtaggggggcggcggggaggcgacttgtgcagcaggtgcccagaggtggtgagggtctgattcattccttctgtttctttttgtgttcatcagagaaagagacctcagaggaggaggatcttagatggttctgcaggacaagcaggcccttccccccaggcagaggtgtggcctgagcaaagccatgtttatgggatgacaaacttccctccctgtattgtggagtaagatgttcacaatggggctccctgggagataaacctggggtcagctca

SEQ ID NO: 10719 - DNA, 1028 bp, Homo sapiens
cccatctgattcggatgcaatgattaatcttcagtgcttagttagagccctatgttagggttagaatcctctgccctaatgttctgagggttcttgctgttgggccagaggttgggaactgggtggaactcagcccccactcgcccactccctgcattgctgcttctctcatttccttttttagatcaaaccttttttttttttttttgggtgggggtcatattaatcctcaatgcctgtccagagactataacaagatcccatctgaattagcattatgcatagattttgcccgtttctcccatctccttgtactttccctccttctcacatctggagcccctggtctgtcctgcttgcatggcccatggggtaccttgtctgcactggtctcaggcattctctgctctgttcccaccatcacctctagaggagactatgactcgctcaccttgctccccccaccagggtcaagaatgttaactcagacatgcttaatatgactgggatctggggattggggaccttgaatcctctgtgcattcattgtgtgcgcttagataagctgtcttccttccctgcctcagtctccttcgtttaatctggaacagccatggtgatggcaaataaacacaggctccttgtgaaagaactcgagggaggacatgcctgtagggcacggggtcactcgcgccgctgacctgctgccgtcctgtttctgagtctctgcagtctcgggagctccaggatccaaattcgttctgtgccctgaccttctgcctctcattccttgcagactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggtaggtggccaccaccttcttggctaagtccagatgtctcttctcagctcagggaaggagacgacggatttgattatgttgtg

SEQ ID NO: 10720 - DNA, 1178 bp, Homo sapiens
tggaaatttccctcctgggagttgctgctgagtctcttggcttttcgagaccgcaggcaagtcagtccgtcatctcatctggggaaactgtttgcctttttctgatactacgtagccagtccatttaagtcagctggccaactctgttaaatggatatgaagtgggtacgaagctggtttaggggtgtcctcctataaatcctaactgttggtcaagttgatacctcatttctataatgggcacacgccgtgtttcctaactggggctgcctgtgtgtgcctcattcacaccggtggacctgggttgaacatgttcatatttaaaaaccaagagtgaacgcggtgaaatgtacaattcataacactttttcaaagaaaaatctgagccctcaggaagttccaggcttacctctggcaccccggaggctggttcgctctccctgaaaatgtttttagtggaaaggttcaagcagctctgggctaggctgtgtgtgtgtgtgtgtgtgtgtgtgtttatgcacctttccaagtgctaaatctcctcccatccatcagcctgtgttctctgaaaagctgacgctcagagggaagaaaaataaaaggactagaatttagaacacattagtgtttggagggaggtgagttgtgcttcctgagctctgtttaccatttcacgagtcacgaagtggtgtatttccttcattcgtttctggaagtctttactgaaggcccagttgttgctagaagttggggtggatggtggcatctgggaaatagaggatgagattcctgccttcaaggaacttagcagttgtatgatgaagcaagagtaaagcgtgcaaaaccctagcaaattaagaacgtaaacaaaggtgtgctacgtaacgtgttacgaaccctaaatgcagtaggaaatcaacccaaaagaaggagctcatcaggcctaacgtagaatgccggcctcccagcagagaaaacttggtgatagaaactgttcttagagtagagaaacaaaatgtatgggcacgcaatggaatattattcaaccttaaaaagaaatgaaattccgatccatgttataacatgggcgaaccttgaaaatactatgttaagtgaaacgagccagacacaaaaagacaaatactgtatgattccacttataccaggtacctggaata

SEQ ID NO: 10721 - DNA, 1027 bp, Homo sapiens
ttcccagacacacagtcttgactaaagattgtcaggatcttgacacacgcttcattagtcttgactaaatgcgaatctatacctcatttcaaagaaatctgaattctttaggttccaggaccagtttattgttatacataatcacgatcatttattgagctccacttagcactgcacatatatcagtatcatctcagttgccctttactctgattattttgtggggaaactgagatcagaaaagttaaataacttaggtgccacctgcaagtatagtgggtgggcagcagataccacccttcctcatttcattgttccaggtgatatttcgtctctgcctttggcctttagtctgtggttgttcctaatcttagttttcattgaaagctgtagtttgaaatgtgggatagatgagagataggaaaggaaaatttaggggtatggaaattttgttccttagtggttagttccagctttattttgtttatttatatgtttgtttttaaagatcgggagcttgctgtgttgtccaggctggtatcgaactcctggtttcagcttcccgcctcagcctcccagagtgctgggattacaggcatgagccaatatgcctggccagctgtgttttagatctttgggaaataaagagaatgcttttgggcttggcaaaatagaaacctctgggtggggagaattgcacagtaaaagaaacaaaagggaagtttatattaaactatgaaaagacacagggaggttcaatttaacatatttgccttatgtatgtgcttcttaagagagtgcacaaaggcacctttgcagaggagagaggctagaaaatgcccgttagaagcaagtctacggtttgcaccctcttactagcaccagcaacggtccctgtctagtgatacccatgacttgtcattgcattgcatgtcatctgcctaagagaagctcctgcctggggcagacacactgtcaattacccctacaatatagactgatactaaagcaaggctgcatattcttg

SEQ ID NO: 10722 - DNA, 1867 bp, Homo sapiens
gaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattcc

SEQ ID NO: 10723 - DNA, 1035 bp, Homo sapiens
ataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattca

SEQ ID NO: 10724 - DNA, 1251 bp, Homo sapiens
tctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatgtagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacctaaattatctggccgtttttgacttatttataaaccagcagtcctcagaatggaatacacttgtctcatgtcagaactgtttcatgccgctgcaacatttggcagtggcataaaagacacattctaacctggaatggaatctacatgtgcctctgtgttatggcggtacaagtcattgttgacattgctaggggacgaggggtgcctatgcagccagcttataagctagaagcctcagtccaccttcagaaggtgggtacatcacagacactatgactggtcctcagaggatcgtccctgattgttgccagctactcattctgggctgtgaggaagcatctcctggcatgagaggtaccagaagcctgcggtgccatctccagagtctagggagtctctgggaaccctgcccctgcagctttcctggctcctgcctgctgttcttcgtggctcccacctgatttctgatccttcctgcacccctcttctgagacacaggccac

SEQ ID NO: 10725 - DNA, 1028 bp, Homo sapiens
attcattgctcagctctgtgagcctctggacatcttggtgaataccctcagaaaatcttgaagcaccacaggttttaaaagcagtcactcacttatgtttttcatatgtcactgtaagctcatcatgaagggactatggaagatttgcttccatatggcactgcctaggtattagggccaggacacctaggattttagggcctagcggtcttctcttttccttagcattctgtcagggctctggcaagaacaagaggattggcctttctagccaatgtcccccccagtgcttgctacttgcctggaatattatggactgtatcatacatttctgtattacatacaatcattgtgacagagtcaggatgctgtggtggaaaaaggcttaggtaataagatgatctgactttgaatcccagggctgccacttagctttacaagctctgagtctctgctattcttttataaaatctctctggattattagaaggattaaatgaggtagtctatgtaaagtgcctaatacatagaaagctttaacaagaatcagctagtctgaacatatgcaaacacaccaaggaccgtgttcattgcttttgaaggcattgtagatgcaatgttattttcccaaaaagtcaggggtggaggtggatatgggttttctgtggatcctgatgagactactatcaagagcacagcagtgaaacaaaagcatttacaactctcataatatccccttggtgctgccgcccttcttccagacagcaatgaacttgggcttggggagcgttctcttccccactaagtaacaggctaacaggcaaggcatgaaaagggattagaggatgcatgtattcaaataaaggggagttccccagaagcacggcaggctgagaaggcatctttcgactgtccatcagtaggaaagctgtttgactggcagatataatttttttggaaccagcaataatggggagctattggtgacagatgtcagatgttggcagagcagctgccaaaacaagtct

SEQ ID NO: 10726 - DNA, 1325 bp, Homo sapiens
tacatttggtaaagttgcaggatgcaaagcaagatacaaaaatcagtagcatttgaatatgccaacaatgaataatctgaaaaagaagaagtaatctcatttacagtagccacaaataaaattaaatactcaggaattaaccaaagaagtgaaagagctccacaaggaaaactataagacactgatgaaagaagttaaagaggacaacaaagaaatggaaagatattctatattcatagattagaagagtcaatattgttaaaatgttcatactacccaaagcaatctacagattcaatgcaatttctatcaaaataccaatgacattcttcacagaagtagaaaaaagcatcctaaaatttatgtggaactgcaaaagacccagaatggccaaagccatccttagcaaaaacaaaattggaagaatcacagtacctgacttcaaattatacaaagagctatagaaaccaaaatagcatggtactgacataaaaacagacacatagaccaatagaccagaatagagaacccagaaacaaatccatgcatctgcagcaaattcatttttgacaaagatgccaagaagatacattgggagagtctcttcaataaatagtgcttggaaaactggatatccatatacagaagaatgaaactagacccctgtctttctccatatacaaatatcaaataaaatggattgaagacttaaatctaagacctcaaactatgaaactactacaagaaaacattggggaaactctccagaacattgttctggccagagatttcttgagcaataacctgcaagcacaggcaaccaaagcaaaaatggacaaatgggatcacatcaagtttaaaagctttggtgcagcaaaggaaacaatcaacaaagtgaagagacaacccacagaatgggagaaaatatttgtaaactacccatctgacaagggattaataaccagagtatataaggagctcaaacaactttataggaaaaaatctaataatccaactaaaaatgggcaaaatgtctgaatagatgtttctcaaaagaagacatacaaatgacaaagagagggggggcggttccaagatggccgattaggaacagctccagtctgcagctcccagcgtgagcgacgcagaagacgggtgatttctgcatttccaactgagctttgaagagagtagtcgttctcccagcatggagtttgagatctgagaacggacagactgcctcctcacatgggtccctgacccccgagtagcttaactgggaggcaccccccagtaggagcagactgacacctcacacggccggg

SEQ ID NO: 10727 - DNA, 1044 bp, Homo sapiens
tttcttcacagacttggaaaaaactactttaaagttcatatggaaccaaaaaagagcccacattgccaagtcaatcctaagccaaaagaacaaagctggaggcatcacgctacctgacttcaaactatgctacaaggctacagtaaccaaaacagcatggtactggtaccaaaacagagatatagaccaatggaacagaacagagccctcagaaataataccacacatctacaactatctgaactttgacaaacctgacaaaaacaagaaatggggaaaggattccctattcaacaaatggtgctgggaaaactggctagccatatgtagaaagctgaaactggatcccttccttacaccttatacaaaaattaattcaagatggagtaaagacttacatgttagacctaaaaccataaaaaccctagaagaaaacctaggcaataccattcaggacataggcatgggcaaggacttcatgactaaaacaccaaaagcaatggcaacaaaagccaaagttgacgaatgggatctaattaaactaaagagcttctgcacagcaaaagaaactaccatcagagtgaacaggcaacctacagaatgggagaaaatttttccaatctactcatctgacaaagggcttatatccagaatctacaaagaactcaaacaaatttgcaagaaaaaaacaaccccatcaacaagtgggcaaaggatatgaacagacacttctcaaaagaagaagtttatgtagccaacagacagatgaaaaaatgctcatcatcactggccatcagagaaatgcaaatcaaaaccacaatgagataccgtctcacaccagttagaatggcaatcattaaaaagtcaggaaacaacaggtgctggagaggatgtggagaaataggaacacttttacactgttggtgggactgtaaacaagttcaaccattgtggaagacagtgtggcaattcctcagggatctagaactagaaataccatttgacccagccatcccatttctgggtatatacccaaaggattat

SEQ ID NO: 10728 - DNA, 1020 bp, Homo sapiens
ttactaaaaatacaaaaattagctgggcgtctccaaaaaaaaaaaaaaagaaaaagaaaaatcactgagctactgtatcctcatagagaataattacagtaatgtgtatgtgcgtgtgttttggtaatcttttatcttggatttatcaaacctacagaaaagttgcaagaacagtagaaggaatggctgtatactcttcacacttattcaccacttgcttacctgttgtcccacttgctttgccattttttctctctccctctgttttcccctgaaacattggagagtaactttgagtcctcatactcttcccctataaaatttcaatgtgtgtttcctgagatcaacaatgttcttatatataacccagaataaatatctgagtcaggaaatttgacattgatattgcctattagctaatccttagaccaaatttaaattctgtcaattattttgttgatgtacctgtggctttttttttttttctgaatcaagaatccaatcaatccaggactgtgtgttgtgttgcatttagttgtcatgtttcttcatgtccttccgtctactcctttgccttcctttgcccttctttttttctcccaccatctatctaaccagatgaactttgtctttcttgatcttgttactttttaaaaaataggtgagttcttgtggttttttttcctgacatatcctcattattagatttggattgtatacttttgtcagaagcagcccagaaaggatgtgtccttggtcatgtcaggagggacaggacgttgtatcaatatgtctggttcctcattaaatttgcaactactcttttagcctttattgtttattttctgactctgttttttttttctttagccaactcacgccatgactctacttttgcttctatgtttattagttggcattctgtactaagacagctttacccttcttgcctacttatttatgtcagtatgagctcagaagttcttattcaggggcttataatacagtactcttattatt

SEQ ID NO: 10729 - DNA, 1034 bp, Homo sapiens
gaaggaagtccttagagacccaaaacttgcagtatggagaagagatgggcggaaggggaatattaacaaatggaacatggcatatataatgttttactgccacaagtttctctatgaaaagtgagttagcctggagaaacttacctcatgtcatgctcttttttgcttttcttttttttggtttttgtttgtgagtttcttgtattacattttaaatatatagaaaaaggaacccacacgtgggagaaaatatttgtaaatcagataactgataagggactgtatccagagtatacacagaactcgtaaaactcaacagtaaaaagactaacaacacaatttaaaatgtgcaaaagatttcaatagactttctccagagaagataaacaaataaccaataaacacatgaaaagatgctcaatatcattagctgtgagggcaatgcaaatcaaaatcagaatgagataatacttcacacccactagatgacttaatacaaaagacaaggaatgtggagaaatttgaaccctcatatattgctggtgggaaagtaaaatggtgcagctaaattggaaaatggtttagcagttcctcaaaatgttaaacagagttattacatgacccagcctatgtatgtatccaagagaaatgaaaacatatgcccacacaaaaacccatacatgaatgttcacagcaacattattcataatagctaaaaaaaaatggaggcaatctaaatgtctatctgctaatgaatggataagtaaaatgtggtttccacaaaatggaatatttttcagccatagaaagaaatgacaactgataactgatatatactgcaatatggatgaaccttggaaacatcattctgagtgaaagaagccagatatacaggtcacatattacatgatttcatttgcatgaaatgtccagaataggcaaatccatagaaacggaaagcagattaatggttgctaggaggggagaggggtaaacaggaagtgaatgctaatgggtatggggtttctttttgg

SEQ ID NO: 10730 - DNA, 1036 bp, Homo sapiens
attaaataatgcaccttatagcattggaatttaatagtaccaattattatgtcttaaagtcctcttagaatgctttgggtcattttaaggttattataacgattggagagttcttaacgttagtaaaagcatggatttgcctacacagaattgatagtttattgaccatttcctgtatattaggcacaataataagcaattcctatgtgagatccacatttggtcttctgtaataccactgggtaagacactatttttatctccacattatagatgaggaaattcagtcttaggataagcaacttgcccatggtcatatagccagtttacatggtagagcctgaatttaaacatgttagatttcagagcccagacttctaaccatatgttaacctctctgaataaaattattgtgccagttggagtttgggatcatttatttatatctaaatgctattacattttagtactaattttcctatatctagacattgattaagatatatctgaattttctttcttattccttatatttaggcattgaaaaacatggcagtagtaaaatagaaacaatgaataagtctcctcatatctctaattgcagtgtagccagtgattatttaggtaagttttttatattaataatttttctcatcaacaatgctgtttctctgacttttgtttaaattgctgaaattgtggctagaagcaagttctttaaatttgtcaagactctcttgatgtcatggcctttatttctttgtgttttagtctcattctgtcgtactgcagacacacattcttccctgaagggtcataactacccgtggcttctagttggagcaactgacctttgaagaaaggggctgcatattcccaattctagtttgaaaattttgggggaaagattatctctgtttgggtcttggatttatccctaaaactagaggtgttcccagggcactgatgtaccatggttgacccagattgggctaatagtctattactggaagcatgggagggatgaacctgggca

SEQ ID NO: 10731 - DNA, 1044 bp, Homo sapiens
aagtggagactcggcaaaagcaggaggccatttagtggaaaagttcaaaccgtggaaacaacaaatgaaaatgtcctttgtcttgcttgagcgatttgatcacctacatgtggtcggtatgtaaaacctaggagttcgaagaaattcttcaaacatgcactctaccttattgtttctgttacttaaatctgttgtttctcttgtttgttttggtccttatggagaaagcagaggtaaatcggaagggactctctagcaatatgccagccactcttccctgactttgccctctccaactccacatattgttgcctgcaacttggctagaatgcatagtcctcaagcgtgtggaggacccagtgctgggatttagtggttttagctgactctaagcccatcgtgagtgtgttgtgatggctccccaaagagcaaatgctggtggaggctgcattcatagaaatgcaatgaccacatcaaagaatatggtcgtgctgcctgacttagcaatgagtagaacataatccagactctagaaactgtagctactttgagatcacaaagaactggaaaataggaacaaccacaaggcaggctctctctgtcaggcctgggtgtgccatcacatgaagagaggtttgaaaaaacttcacagaatgcctggagatgaggagatgcaagggagagaaagcttttttctactcaacttttgaacattcaagaactcttgagtagaaaagagatagatttgttccttggtactctgcagaggatagcaaggatcagtggaggaaattttgctcaatatagtttattcttccaagaaatatcaagtaccaaccctatgtaaattaacagttgagtgtgaaatgggttgcctagaaaaacagtgcactctgtcatagaaatattccagcatagacagagtgattgccaggaataccatagaaagaggattcttccccagggtgggaaaatggatgacatggtctccaaaacctcttctagctctttagagtctgggagtcagtgaaccctcaagagtct

SEQ ID NO: 10732 - DNA, 1033 bp, Homo sapiens
agtgctgggattacaggcatgagccaccgtgcccagccaatttattgtattttaatgtgcattttgatgatgactgttaatgagattgaaccgtttttaatgtatttattggctatttgtgtttcctcttctttgaaatacttggtcatgcctttattgtttaagaatttttctgttgtgctgtttgtccttttttattgatttacagaatattttacatattctgtctactcatcctttgtcagttgtatgtgctgcaaacagcttctcctagttgttggcttgtctgttttttatttatttaatttttaaagagcagttttaggttcccagaaaaattgagcagagaagtacactttccatataacccattcctctttacagtttctcctattattgacattttacattcatgtatagttggcacaattgatgaacgaagattgatacattattattagctgatgttcatagtttacattagagttcctcctttgtgttgtacattctaggagtctgacaaaggcataatgtcatttgtctactattataggatgataccggatagtttcactgacctaaaaataccccattgtccatctattcatcctttccccccaacaacaaaacccctggcaaccactctttatactgtctccttagttttgccttttctagaatattgtatagttggaatcatgcagtatattgccttctcagatggcttttttcatttagcagtaatgtcctccatgtcttttcatggcttgagagcttatttccttttatcagtgaataatactgcactgtatgggtgtaccagtttgcttatccattcactgactgaaggacaatttggttgtttccaattttttagcagttataaataaatctgctataagcattcatgtgcaggtttttatgtggacatacatttttttagttcatttgggtgaaccaaggagcatgattgctggattgtatgttaaggctatatttagcttcataagaaactgctacactgtcttccaaa

SEQ ID NO: 10733 - DNA, 1018 bp, Homo sapiens
tatattgaatacagactttgcatgctccctttctaacttgatatgctccctttctaacttgataactctcttgccaagtcacaagactcagaagctgtctaccccaaatcaatctgacagtttgaaaacttagtcttatatttgtcttatgttttgtttgtttgttataaacttggctcacttagattcactttcctacgacagtgcccacgttggagttcgttatcaataaagcagggacagtcacacctcctttataatcaggttgctggcggatttgatgctgtgatggtgtaatgggagttctaagtgctggccagctgcacttccctttcactgccagcgggggcgcagtctaactgagaagttgtcctgggggagagcgttctggagggtaagaagtttgtcccacgaggtttctcttactttgcctccgcagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggaggtacgcggagggctggcggtcggctcccacggagaccgtgggcttggccctcagacacggggctgcaccagactcgcccaggaccatggcctgcataccttgttgttgttgttgttgttgagtattccctaaaaggagttttgaaattgtgtactcccttgtacttgtcaagtcgacatctaacgttttatcataaatttaaatagttgcagaggatgtcatttccatcatattgtaaatagtgacattttaaaataaaattacaccgctctttcaaaaatatccaaaagaatgcaaaaccagacggacatgacacccattaaaatctatctgatagtatgtgaacaggttcttaagagttgtgccatgattttactttgttcttttttcccttttgtttctactc

SEQ ID NO: 10734 - DNA, 1066 bp, Homo sapiens
gatatgctgtacgtataaaatatacactagatttcaaagactcagtatgaagaaaacaatatacgattcatcattaacaattttttatatttgttacatattaaaataatattttggatatattaggttaaataaaatgtattattaaaatgaattttacttgtttcttttttacctatgtgcctcatgttatatttctattgaatagtgctctataaacataaaaaaatcacaaatagggtgttttataacttggttgtttagtatagatttaacttagaacagtcctttctgagcattccctttgtcgtcctttaatctacaggttctttagggcagtagttgccaatgcggtgaggcaggggaaagagggtagaggagggccattaagggagtgattaatggaactctttgattgtcacagtgattggggagctgtcctggttattaggtacaggcacagggatgctaaatatcctacggagcacaggacagtctctttccacaaagagttgtgctgccccaaatgcctgcagccaagctattgattgcgatactgtctgggccttgatgcttaaatctactgatcttatagctgacttcctacttgtgttgtcctgtaaggaatggagttatacattttcccttttaaaaaatacttgctaaactttcttactatctctggtaatattcatacagattatttgtaatccctttaaattttgatttattttcatttcattttcacattttcatttattcttgactcagtgttcacaagctaagtataatacttgtatcagaaatttcttatttccaaaatgtttttcttctccaaaatcttactattaagtatattcttggtattaaagttacagaatcttagcttattcctagttctttgtccctcaagtttgttggtcaccttgtcagagcctcaaaattgaagtatttaaaaagtgataggtgaaaacttttgaaccattggaattaaaccaaatgacatctattccattatttctgcagagatttatttcctgaatgtctagcattgacctgtgctctg

SEQ ID NO: 10735 - DNA, 1106 bp, Homo sapiens
cttttacagagatacaagccacatgggaacgcagggagcacttcactggctgaatagggagttaggaaaagcatcacggggaagctgacgtgtaagctggatctcacaggataggagtttggcacaccatgaagcgagagaaaaggggaaggacattctaggcaggaggaacaaagacacagcgctatgaagaaacttggctggtcaagtagcgggggtcaggcatgtacacgtacagcacgttaagaggcttggacctcatccagctggaaataggagccacgaaagggcttgaagcaaagcagtgaaagcagatttgtgctttgggaagggctctctgattgtaccacataaagggagtcagaagggggcggagctggaggcgggagactggctgggcctggggaagtcattcaagcaagatgtgaaaagtggatagaaagatgtgggtcagtctgagggatgtttagaaagttgaatgcgtgcttccggtgataaagtggatgtggaagatgaagaatcacggatgcttccgaagttcttggcttgggaacctcgctggctggtggtaccattgaccaaggcgtggaacactggaaaagaagcagatttacaaggggaagaagataaaatcaaaactttgagggtacctgtggaacatggaaatattcaaaaagcagaaaggtatttgactaataagtttgaaaaaggcaaacctaattagtgaccaaagaatgcaaatttaaatgacaataagggattttttttcccatgtagcacattagttaataaacattttgaacgttagccttagtgctctgctgactccttgttctccttctgacccttacatcatccccactgcatccgtatggagtccttagagcttctcagagcatgatgggaaaaaccactggcttagagcactagggataaaaagccaagctccttggaaaggtagaactagtcttagttactggcagcagagtttcctaatggcaaactgcccaggaaagggaaggatggccagaaagccttcatctgcagctgtgttggggtgggagaaggaacactgggaaggagggtcaggctctgtcccaggatcc

SEQ ID NO: 10736 - DNA, 1047 bp, Homo sapiens
gactacagataaaaccccaggccagctgacaccttgattctggcctccataaacattcagcagagaacccagctgagactgcccagacttctgacattcaaaactgtgttgttttaagccaccaactgtgtgatgatttgttactcagcaataggaaactaataaatatacttactttttgttctatttttttgtttgttattctctacataattgtagatatgtatatttaactttagttctgtcagtttttgctttatgtattttgatgatctgttatgtggttgttgactgaaatgaaggctgttgagacagaagttattttatttattttattttttatttttaatagagatggggtctcactatgtcgtccaggcggatctcaaacccgtgggctcaagcaatcttcctgccccagcctcccaaagtgctgggattacaggcatgggccactgtgcccagccagcagaaataatttgataaaggtttattggaagccaaatgtaaggactgacttgggaaaacacaccaacaaagttacacatgttctggagtctgttacaaattggaaggcttttatagaaaagtttaggagcagggagggggactccttataccaaacttgtcctttttcattggagggttcaatacaaagattgcaatcattgaatacacattacaacatacaggttaaaatgtctacatgcaagaccatcagtaaaacttcatgattcagcaataaatcagcatccttttcaatgccagtaggttatgtatcaatcattgcatcaataatttgaggaactcatagtaagattctttattcaaggacagaatgtcaccataagaccttcccaaggtcagttactttgaaagactgttggccgagcgtggtggctcacgcctgtaatcccagcactttgcgaggccgaggagggcagatcatgaggtcaggagttcgagaccagcctggccaatatggtgaaaccccatctctactaagaatacaaaaattagctgggcgtggtggcgcgcacctgtagt

SEQ ID NO: 10737 - DNA, 1088 bp, Homo sapiens
ttagtaaatttctctgtggttccatttcttcttctgtaagatggggacaaaaatatagcatgtttctcacagtttggttataaagattaaataattaataggttaaagcacttaaaataatatctggaataatgcattccaaaatgttagtttttattacttaggtagaaatcaaaatttttacatagaggagaaaaacagtatgcttcaattggtattgcctttctactttccttccatctttctttcctccccgtcttccttccttctttccttttgtccctcactaaacatttattgaaattccactacatgccaggaattatgctagccatcgaaatatgtgctttgattttttaaaaatattctaaccctggtagctatctattctttcctgctagagacagagagggctagtataccagcgtgaactgttagcagctcttttgctagtatctgaagacatcaagagagaagcattaactggaatgttagaaatagtttaaaaagtataggtactagcaagccaagcttctggtgtcttcatagatgagaaaactgagctctgaggtgatatataacttcaaaatgtcctatagccagttaaccagagagccaagactcaaacctgtggtttctgggtgtctcacaatctctttccataaatgctcctattttttctacccaacagcctggacagagtgcttagggagtgagtcactgataggccacatattgtctcagcatcttgtgtggtgtgttgcatgccaaatgtttctgctcagcttcccttctcttcccatctgcaaaattgtattcacttatactgtgggcaagggtgggggatgggaggtgcactgaacctagaactgacaaaagtcaaactccaaccagcacatctggcttgcaggcgttccccacagcctcagagatgcggcctcgcatgggaatggagacttttgtcctgcggccttagcagtcctctgagactctggccatctgggactggtgacaaagtcctggtctctgacctcagctgcccatgggctacttctccctgtcccatcactctttctggtctgctgact

SEQ ID NO: 10738 - DNA, 1061 bp, Homo sapiens
ccagactgctgagtgacctacgtgtagtttagcaacataatgcttggaatgagccacgccgacctgatgcgagaaccggatggtagccgaagagagcaggccaggtagtgagacaactatgatctgcagaggtgggcagcggggtggagacaggcttcttctgcaccaagtactgctacctgaactgtacatcacagagacaagccctgccgagagcagtggaagcaggaaaacacaggcctatctctgtgtctgtcatgtaagtaagtctctcttggctgtgtgtacctgccaccatcaccccatcccaccccaaatatacagcatcaccttcagctatagcttttggtttttgattaaaggacagtaatatttccaggagggagaagagtgatgaacagaagcatttatgtatggacactgggcaatttattgtttttcaaagtctaatctagaacatgtttgcaagaaagcgtgaattgagtaaaaagtttactatcgtattaaggactgttaggtacaatgactgaaggaggagttaagagtgatccttcaataattcccctgtgggattatgcacatttaaggaaaaatgttcttcaggctatttctgccttagagctaggcatcattacagcgaaatagagaactaacctttaagcaagaggaaccaagttctagttctatttctgtcaatcactgtacgcacaacctctcaaagccttagtttcctctttgcaaagtgggataataaaccctacctacttaacacaatgtggggtttcaggtgagatgatgcataggatcgtgcttggcaagctgtaaatctgtaaattacaaatatatattatggtttcaactggtacattcctaagcgaatagcacattgctctgttgggaagacggctcttctccaagtcaggctgggataatgttccctgacaagacactgccatacctaggtgttccccaaacattgtctctgggaaccttgaggaagcaccataagacatgggaagaaatgttacagcgctggcttgaaagaataacaatgtatcagt

SEQ ID NO: 10739 - DNA, 1034 bp, Homo sapiens
gcctggatccactccagtaccttaactaatctcttgactcccagatggtccaaaatatgtggatttagaagagcaacagacagctgttcctctgggcctctccaagaacacggtttggtgtctagaccaccttagagaaacatggcagaggaaatcatggtggagcagcatggaaacaggtgaaacccagacttagtaccttgttaaattccatcctggagtggagataccagaggagcagatattacctttattaactgatagaaatgtttggggatttctctgacttcttgtagggttggataagccccaaagtgaagagaattttgctccttgttttagccattaggaaactcaagaccctgctacagtgctattggtttaatttttccctatcacattgcctctgcaacttctgaatggttgcagccatttcttaaaatttccctgcattgtcactcagacaacaagaatagatttggccttcttcatctcaaaataatggtcatgattaatagttattggactgggaacagtgctcagccctctgtacgtgatctcaggaatcctcacagtactcaatgaaatagcaattttattatctcatttttgcagacaaagcaacggaaacttccacacattttctacattgcacctaagatcatctgagaaactatgctgtacttgtttttctaatgtatgatctgatttttctattataatgttaattctatgaggacagggctttctgtggccttgcttcattgctgtatctccagcacctggactactgcatggcacctggtagttacttagtaaaggtttttcaaatgactgagtaactcatccaagattaaatgtctaggaagtggtggcaccaagcttaggacgactcttttctgattccagagtccagacagccctaaccactatcccacactaccttcttgtttatttttaaatcattttccttcccttcaatccctctccagtgccttacaccttcttgctgtaatttgaagcatggccacagt

SEQ ID NO: 10740 - DNA, 1051 bp, Homo sapiens
gcattaaaagagaagtgattccccagatgtggacatctcagtgcctgggaggcagacgtctttagagtgcttggtgttcctccccatatctaacttacctgttcttaggacatattcccttgagtgtcttttattatttcgttgattgattaagggttacaaatttgttacaaaagcagcagaaattttgaaagataaaacaggtagaaactgttatttaattggaggcacaaaagccagttccagcttgagcattaactggctgtgtggcttgggcagctcccctgcacttttgggaccatggtttcttcagctctaaagtgaaagctgagagttcctctgaatgctaaaatcttgcttctctgtgattattgttttttaaatgccgccgtcatttcaaaacacatacatggggcagccctcctcagctgcctgtcctgttctcttccctccttccctttgtgccatcagcgtctcccctggatttatcgtgctgtactccttggacacccttgaaagtggagagagaataattctcattccctttccccaaactctgtcctgaagcaccactccccacctccctaccatgcctgcccctccaccccccacattttccctctgatgagatttcctctctgagggaatattttggtcctgttctctgttcccaaacaaattccccaggtcctttaaatctggtttcaatcaacataatcacagtctcttcgatgctatcaactctgccttgatttggttgtgtgattcatgctgtgtcctccacctcctcaggctgttttatatatacacacttaagtgctcatatatatgtgtatatattacacaggttgtatgtatatgatgtattgaaagagagagatgttttccaccgtgcctgtaattactttttatcttcctccaaatcagtatcttaatgcatatcacctaaactggattcattttgagaacactagggccttttttttacttttcaagaacagctatctaattctgggccaaaaactagttatcaaatgagggcaggtaatgg

SEQ ID NO: 10741 - DNA, 1050 bp, Homo sapiens
ctctggcagcaggccttggccaaggggcctttagccctgacgacccggggaagagtctcccaaagcagaacgcccggtccggcgcccagaccaaacgcgggggaaccggaagggcgaggcctccacgtaagtccgcggtaaaagtggcagggagtggctgcctgcaaagaccccaagacggcttgaagaaggagtgggtggcgggtgggggttagggcgactaggcggggaaacagggagagggtcgggctccgcggggcagctggggccggggctcgccgacctgggcgggggcggggggcggggggggtgcggcccgggcggggccggtggggcgggaggcgtggccggcggggggagtgggggcggcttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctgggtgagtgagcgcgactgccgcgcgctcctctcagggcccacctgttcgcgggccccggacactggccgcggccgcgagtgccggcagctggcactgcccgcaccgggcaggcaccgggcgggaagagagagcgccctgcggctgccagctggctccaaggccgggtccagagccgggcgggacggccgcgacgggcgcattcgggtgggggctcatcaccgcccagccggcgtggggagccgggccctcttgagatgaggcgtgcgggagggtcctgagcactttagctcgcctaggatttgagctggggtgtgtgtctgctcccagctcaagtccctccgagtgccagagaggaaggcagggagaagcggagcacccctctttgggccaaggccaaggaggactgtggtgagcagtatggcttgtgaccg

SEQ ID NO: 10742 - DNA, 1034 bp, Homo sapiens
taagaatgccccattggcagagactcgctttgtggagctcaacttggaaattaatttacaatggaaattgaaggaaaatctacttcatgtccacaccaagaagggtggcctcaatgcctctccttcagttcactccttgtgccttccaaaaggaagttgattcttcgtatgtagaattttctggacacctagaacacctacacccagaaaccaggtcccagagagatgcagagccacggtcaccattgcttgtgtagacaccaggggtaggaagtggaaggaaggtagcgcctgagggtgcagcttcccagggaccaccacctctcccagcctcaatggcgggagagaacaaacccaagggagaagctacgggccagcatcttccctccctccctcttggcccccaccagggctagggtcaacaccccaaattgaaagcatctgttgtcaagctgcagcaggcagggaaaccctgtcaccaggttaaggcttaagtcagagcattttgccaaattcaacacgtccaagcctcccacttgtcccccaagaaaatttctcagggattcacatctttcccagtcaccccctggccagtgaggaagcaccgtgcatcgagaagagcatagctttgagtcgtctatgtggagctggttccatctgagctctgcctcttcctggctgtgtctttttgagtcagttgcttaaaatctctgagcctgattcatccataaaatgagggtgatgagaggattcagtgagagactgtacataaaccacctcctgtaatgtgtcgggggcgtgggtccttgtacatagtaacttctactgttaaattgctactgtggtgttattttccctaagctagacaacctgcaacttgaccattagcctcttttttttttttttttttttttttgagatggggtctctgtcacccaggctggagtgcagtggcgcagtgtcaactcactgcagccttgacctcctggatttaagccatcctccttcctcagccccccaagtagctggaacta

SEQ ID NO: 10743 - DNA, 1050 bp, Homo sapiens
atttaaattctcacaaataatctatgagctgtagggacaaatgtggaaactccatacagagaggcttagtaatttgccaaaactcatacctaagtgaagagaaaaacaagatggaagcctgagaaaatagtcaggtcaggagtagtatttcaattattatcatcctctagatcatagagattcaatttaggagccaagttaggagccaagtagagctgaaggactgaccaaagtgtaagggacagggagaaacagcccgagtgggtttctggaggatgtgggaggagatgggaagtgcccaaaggccctgagagaaggcagtgctagcagctgccatctgcccagtgacgttgtccaagcacaggcatctggtggctgagagcttagagagaacaagatggaacgcataacatttgttcgtggaggaagatgtgaaaatgccgtctctgcccctctctcgtctgcccattgtaggtgattaaggaagtccaggagttttacaaggacacctacaacaagctgaaaaccaaggatgagccccagcgggaaacgctgaaagccatccactatgcggtatgtcgccttggcaaagacaccctcctgcgctttctccggattgtgtctgcacacagggtgctgactgcaccagaccagtgcaaacattctaatcgtcttcttacaatttgtttctctcatccccatccctgccttctcgctgtagttgaactgctgtggtttggctgggggcgtggaacagtttatctcagacatctgccccaagaaggacgtactcgaaaccttcaccgtgaaggtaaactcagaccaggatcctggtgtccctgcccccattgctctggacaaaccctgcaagcatgaaagtgacagcagccaagtgctgcttcagcaagacccgttctgcctgtgaaagggccccagggcacccatctctttctctcccactttgggccctctgtttactcaagggcaataaaacaaaggccggaccaggggaatgacaagtgttctggcaccgcccactgctgccagccc

SEQ ID NO: 10744 - DNA, 1029 bp, Homo sapiens
ctcctgcttcagcaccttctgactcgtttggcctcctggatgccattctccttgtcatttttcttggactgggtgacccatgtctctccctttccctcagccttccttcagatcaaaccaccctgatcctcatgtttcttcctatctcctagatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggactggtttttgttttgtttaattattttgagagctatttggtttgcaaatgtctttcaactcctattaactccacctgcatttttttttttttttaagacggagtttcgctcttgttgcccaggctggagtgcaatggcccgatcttggctcaccacagcctccacctcctgggttcaaacaattctcctgcctcagcttcctgagtagctgggattacaggcatgcaccaccacacccggctaattttgtatttttagtagagacggggtttctccgtgttggtcaggctggtctcgaactcccaacctcagttgatccgcccgcctcagcctcccaaagtgctgggattacaggcgtgagccaccgtgcccg

SEQ ID NO: 10745 - DNA, 1027 bp, Homo sapiens
gctggggtgggagaattgcttgagcccaggaggcaggggctgcagtgagccatgatcatgccactgcactgcaacctggccacagagctagaccctgtttcaaaaaagaaaaaaaaagaagtgtactgggaatggtggcttgtccctgtaatcccaaccacttgggaggcagaagcaggattgttaaggccaggagttcaagaccagcttgggcaacatagtctctaaaattaattatacaaagcttaaaaataaataatataaagaagaagatagtaggacctgtcatttcatgttggatcatcagagaaggcttgctgttacgtcacgtttgagcagagaccttaagaaagtaaggaaataaactatgcagattgttagggaagagcattccaagcaaacagaaaagcctatgcaaaggccttgaggtgggcaaatgccaatagagttggagtgcattaagctaggaaaaagagattaggtaggaagtggtacagattattctagaatcttgctcctcaaaatgtggtcctcagatcagcagtgttaatatcaggatctcatgatctgggagcttattagaaatgcaggatgtcaaggcccaggatgtcaaagctgctgaatcaggaaatctgtattttaagaagattcccccaggcaatttggatgcaattataagcttgagaagcactgatctctagagcctcgtagatcatggcaaaaacttgaacttcagtgtgaatgaacttgaaagccattgggttttgagcatgggagtgacatggtctgacattttaaaagattcactggcgactgtgttgagcagagactataagaggcaaggagagaagcagggatactagttaagtggctaatacagtaataccaagtagattggactggagggatagcaggggaagtggtgataaaacgactcaggatatattttcaaagtagagcttttacaggaatgctgatggattggattggattatagggttagtaaaggaatctgagatgagaatga

SEQ ID NO: 10746 - DNA, 1330 bp, Homo sapiens
caggctgcctttcgagctcaggggcccctggctatgctgcagcactttgatactatctacagcattttgcagtaagtgaaacacccaactggtactttaaaaagaactggtgactgtttgtcctaactgtgcatgttagtcctgaaattccaagttataggttcactgataaatgcctctggatattgatatctctactgatgagcatgtacccagcttgccaccgtatttattcagttgaacaatttcacgtgtatttttaaacattcgattccacgggttagatctgatctgttagaaggggctctgcaggctccttcctgtctcacccccacactttctttccctcatagtcactttcgaagtatagatcctggcctcaaagaagatactctgcaattcctgataaaaggtgtttatgggtcagggggtaggggatggaaggtgtttgttatcgtttgtttgtttgtctgtttgtttgtttttcctacattttgtcagccacatgatgatatcaaggctgttgtgattcagttggtttggctaagcccagggacctttggcctgttaaaggtctgtaatcttggtgggcgatacagagttatgtgtgttcactgtaagggcagaccaacaagaactttttcctacttttgagctacctctttttaataggggtgattcttccagttgctggagagaaattgtggtaactggagtgagagagtaggaacagggcatgttcagggtatcagggccaagggtcctaaaggacttagcttgtgttatggccactgagagatgaaacacagatctttggtaatctgatggctgcaagtgctgggtgttttgaagttggggtatatgaaagaagtgagtgaaactgactccaagattctgcccctcacagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaaggtaatttggagttttgggctcacgttatatggggtctggggagataggggaatagatggaaaagaagggaatccaatgatccacaaatcctttctgtcctcattgagaatttaggagaaagaactcaaaagtgtcacacgttttcttcctggacaagtagcgctgtggaacttgtaatatttcttccgtattaccttctatgttgtcttggtactagattgtttgggcactcagactgaca

SEQ ID NO: 10747 - DNA, 1030 bp, Homo sapiens
cccaccattaatcaccagaagaaccgccccactcgggaagccataacacacctgcttggtgtagccttgacccgttataaccatatgctcagtaagttaccagtcgctttgccccgccttttttgtattgcccataatttctcatgtttaatgcttccacaggtgctacagtgaagatcatccagatgctgcagcactttgaacacctggcacctgtactggttgcagccgtgagtctatgggcaactgactatggaatgaagagcatagtgggagagattgtaaggtgactcttccttctcgaagtttctcatgcttattttccttggggagggaataaagaaagattggaaatacattatctgtgcaacagtagattccttcagatattagatacctgtcttaccttcccttactgggaactgaataattgatctatgttgctatggctgtgttttcttccctgtgtagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaagtaggtggtccactaggggtcactgagctttttctggggattttaagtccagtgttgaaaggctgtttcttaacagaacaagaaagtagctttgacaagttgtctagatttatcattgtgacatttcctttctgtagagaagcaggtcaagtttgttgaataaggagctctttattaatctgttaatctttcaattcacattgcttttatccagttctggtaagggagatgacatttctgcagcttaagtctagtaagagcaactcagctttgattttttttttttcttggaggtaggatctggctctgtcacccatgctggagcatgatcatagctcattgcagcctcgatctcctgggctcaagcaatcctcccacctcagcctcccaagtagctgggacttcaggcac

SEQ ID NO: 10748 - DNA, 1026 bp, Homo sapiens
ggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcgcttcgcgtggggagcgcgctccgggacgccttccgccgtcgggagccctacaactacctgcagagggcctattaccaggtggggagcgggccgggcagctccgagggtcccagccctcaccacgacgctgtcctactttgcgttgcccaggagtaggcggaatgctgttgcccgggccccgcacggggctggggagcgtaccgcgggcctctgcgtaggagctggctaagcgaccgcgaggacctcttgagatcgcagaggagcagccgagggggagtgcgagcagaatgggaatggggcggggaggtcgtgaggtgggacgggagcagatcgaagatggagggacagggccgcctcttcctaggaatgaagcggaggcggtgggggcgaaaccggctctcggacgggaagtgtgcgtgggtgtgtgtgtgtgtcgggggtggtggtgagtgtgaaccttcgcttggggcaggaggtagcttcggaaaggaaggagcagacggaggcaaggttggggtcctccgaggccagacctctgcgggcggggaggggacagcacgccgcagccgccggtaccgcagcagttgcctacgtggctggggaagcggggcgccggttgtactcacctcagctcagggtcctagagacctgcgggttttgctggtcgctgaggtctcccccacttccccacctcacttaagccatcacttccacctggtctcccaaattgaggtcctgaagtcctgagacccatgtcccacccaactccgacgtctttagatcccctttccctcggtgccagccttctgagagtcccaacgttctgg

SEQ ID NO: 10749 - DNA, 1827 bp, Homo sapiens
aaaattggctgggtgtggtagctcctgcctgtagtctcacctactcaggaggctgaggcaggaggattgtttgagcacccgggaggttgaggctgcagtgagctatgattgcaccactggactccagcctgggctacagagaccctgtctcaaaaaaggaaaatactgcagatgagactaaatttttgattactccccactcaaatcctcatccctttcctaccaagcctgtcttaccttatcctatacaggtagaatcagaatcacaagtaattccaaccctcacccggtttcatctgtcttccctgaccgtcagccccagaagggccatgaccgcactcatattactcatattcaagggaaccaagagggtggaccttactggctctccttctgtcccctcaagtcccttctgtgcaagggatgggatggtggcctggctagtcctgagccacttcccctgattctcttcctgcctcctgctctagacgtgtactcatatgatgaggatgacatggtcctggaccccagcctggctgagcacctgtcccacttcggcatcgacatgctgaagatgcagaaggtgagacccccttcaacttcagattcttctacttcctgcccctgtgagggcccttcctctttgcctgaggctgaggtagggttttggagaaatcttctagttaaccccatccccaagatacacaggcttcttttaaatatctaaaatcatttattcagtgaatagtactgagtacctactatgtgctagaggctgtgtgaataagacagatgtggtttttgcttacaagagttctactctagaagaaaaggcagacattagtcacattcccagataaataagtgaatagttgcaaactggtgggcactgtgaaagagaggcggagggtactacagtaattgacagcagggtggcctggcctagtttagggatcagggacatttccctgaggaagcgatgcttaactgacaatgtgaaggaggttaggggtaacttaaggatgggaaaaacatttcaggtagaaggaaattttattcctcattcaagcagaggccctgatgactaacgggcctctgggacaattatgtgtggccttccagaacttgaactggacgatactcaacatacctcccatgtttgagcctgtaattccacaaattctaggccacagttgagtatcatcctagactcagtgagagatcgaggtaaaaactacagggttgagtttctcactcagtctgaagtgccccttctcacacagacagacaagacgatgactgagttggagatagacatgaaccagcggattggtgaatgggagctgatccaggagtcaggtgtgccactcaagcccctgtttgggcctggctacacaggcatccggaacctgggtaacagctgctacctcaactctgtggtccaggtgctcttcagcatccctgacttccagaggaagtgagtagtgccctctccttccccaggccccctcctggtcagcaccctctgggcatactcctccttcagcttccctcagcacctctgtgtttgattctagtcttagagtagttcctatcggctgggtgtgttggcccacacccgtaatcccagtacttcgggaggccaagatgggagaattgcttgagcccaggaggttgagaccagcctgggcaacatagcgagaccctgtcttctcttaaaaaaaaaaaagaataattcctgtcacactctggctgacatgctgtgaggggagcaagttagggagctgcaccaccagcaccccaacacacaaaccccactgatagtgc

SEQ ID NO: 10750 - DNA, 1008 bp, Homo sapiens
ttgtctatcccacagttggagaggggccctctctgccccagtgggcgatctgggctacggccaagttgccaccagctagttccgcttgaaaaccacttctggccccgtgggggactcaagtcgccaagcgagggttcccctgagcgccggagctcacaggtctcgccttgtcccgaaagccccgcaatcgaggcggaggcgaccgagcccccgactctcctagaacgttgccacaagaagggggaacgtcggaacagtgcatcatcgggcggcggccggggcggcggcaggagggcgggcggggggcagggctccgggggactgggcgggccatggcggaggacggcgaggaggcggagttccacttcgcggcgctctatataagtgggcagtggccgcgactgcgcgcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccggtaagccctcgccgaggaggggtctggccgggccggggccggggccggggcaggagtggcagcgccctctcccgaggccccgaggccccgaggccggtatccgcgcggacctgatgcagggctgtgggacgagggccgctggggtccgggcaggggcctcgcagccgcagccccgtcggtgcgtcgagggggcagggcggagcacatgatgccccttggactatggggcaggtaaggacgttttgggtctcctggaggaaggtggccccggggcgcgcactggggctgtgcccgccaggcgacggggttaggagcggagcccgaggctctgcgggagaccgggggaggctgggccgcgtgggcttcccgctccctgcgccctggcctcccgcgccgtgcgccgccgcacgtagccccagactcctccccttcctcgccggcgtccgcgtc

SEQ ID NO: 10751 - DNA, 1252 bp, Homo sapiens
atcagagccctggtactctgactcagtcagaaaccacactaagtgtccactggtgccagtgatttttcctcttagagaggcagaaaaggtcttacttaggccagcttcttgttctaggcccaggaagtacacgagaagctccgaggatggctgaagtccaacgtctctgatgcggtggctcagagcacccgtatcatttatggaggtgagtggctttggttcccggctgaggtggagtgggctgaggactagactgagccctcggacatggaggtggggatggggcagactcatcccattcttgaccaagcccttgttctgctcccttcccaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggtcttgtggtttgtctgccttcactggacttgcccagataatcttcctttttgaggcagctatataaatgatcatttgtgcaagaaaaaaaaaaaaacaagaacaggtttctataacaacatctcttactatttttacttgaaaaaatgttttgcgtagcagactgtcatagccttgaacgccggctccctttcttcctccctccaagtggctctggggctgttgatttccgcagagcttgggttggggtaggggctcagcctcaccagctttcagcagctggtctaggccagcagtgcctccccacctccccaaggggaggggtggtggcaagacctcagcacagtctgtggtat

SEQ ID NO: 10752 - DNA, 1025 bp, Homo sapiens
cgcagggcgcagaccgccggccgcttccgcccccagctcctcccttgggccgagcccgtcccgcggccccgcccctccagggccctctggggcttaaccctctcatcgccgcccacggccgtgcagctccgaggccacgcccctgtggggccccgccccctcctgggcagttaccgctctataccggcagcagccgcggagagcatgccccgcccccgtggagcccaccccgggcggttaacctcgggtctcagtcccgggctgtgaccctccccgaggccccgcccccacggcgaaggcccggggcagttaacccttctcttgctgcggcagagtccgcacccgggcaggcccatctcagaattaacgctttgatggcatcaccgcgtcgggaatccctggggatggtgttctccaccgtcaagacctttgagccgcctgagcgactaactcctgcgcccctgagggtaaggagcatggggtcaaggaggggcttcattgtgccgaatcccatttctacttccctgtgattctgggtcactgtttctgggctggtccctttctgccccgggttgtgagtcagcctgtgccacctctgaggctgtgaaatctgcttcaggctctaggctgtacgcatcatagttctccctgctggtccagtcttcatactggatgccaatccattactgagccgttgatctcatttggtagagtgtcctgattaagacttcgagtttgagtgaagctatgccactagttaactgcgcgatcttggggaagttgcccgatttctcttttttttttttttgagacagggtcttgctgtcaccaaggctagagtgcagtggcgccatcacagcccactgcagccttgacctcctgggctcaagtgatcctcctacctcagcctcccaagtagctgggactacaggcatgtgctaccacacccagctaatttttaaaaaaatatttttatttttatttttatttttttcgagacagagtcttgctcttgttgcccaggc

SEQ ID NO: 10753 - DNA, 1048 bp, Homo sapiens
tatatatgtcatcttttcaatttttctctctccttatgaccccaaacttccatcccattctctctgataatagcccccaaacccgtctggctccatctctgccacagatccctcaccccaagcttctctcacttctcaccaggcacccacaaagcccccaggcagctccatctttccaatccaatcccattatcccaatctctaccccaggatcccccaaactcctcccacttcacctctgccacagacccgctcgcccccaaacttcagcctcccctcatctgccctcaccacccacagcccctcctacctagccctctcccgcgccgggcccgcgggctccccacattccgccacggctagccctccccgcgccccggccccctcggcctcggcctcggccaactcgcgctgcgcctccccctctccggctccccctctctcccccctcgcggcttgcctcgcgctccctccctcgcgtctccctcctggcccctctctcctccgttcctccgcgctccctccttctccctcttcctcccttctcccatccccctctcccaggctccctcccttcgccgtccgctttcctgtgcgagtcgccggacgcaccgcccagcccgtccgcagccccgcgccgggtcggggcctcgggccgggccatttcggagggaccgcggcttcggggaggggctaggaggggggagagggagccgactgccggggaaggggcgggggccgcgggcgaggcggccgaggggcccgggatcgcgcgggtgcgggctgcgctaggcgggcgcgggcggcggcgggtcggaaccgcgccgagggccgggcgggccgcggggccgggcggcgcggcgggggcgggcggcgcggcccggggcattccgggcggccagggggaggcggcgagcccggggaggtggggagcagagcggggatcggggtttgctccgggggccggcgggcgattggggccaggcggggaaaaggggggatgggggccgccctccgggggggtcggggccgccgccgccgtcgtcgc

SEQ ID NO: 10754 - DNA, 1038 bp, Homo sapiens
ggacacctgggatggtctcttgaggggcaccttttgccactgtgttgctatggtagtgatccagtgggatgtcagattggttgggggggcttcgaatgtttattggacctcagcctgtggctgtccttgggactctgggctgggttttggaggttgtttctggatctgttggtggttgggagtttccccacggtgtgcaccctttcatgttgaagtctgttggaacaggtagatacgttccttgcagatcataggtgtttctccaagtctctccacctgggcatgatgggaggatgaaaacgcttctgttcaggttacaccatcttttggcagttggttctgacctctacctcccttattatgttattttttgtagagttgtctttttgcttctttgcactttctttcattttctaaaacttgaattcctctttgagcctcccttcttgagtaacccttttcctctttccctcaactaacctttggccttcttccctgaccttgtagaaatggctgggctcccaggcccatcccaggtgagggtggcccaggacagagggctgtgaaacagcttcatgcaggggaaatactatagaacaggagccaggagacctgtgtctagacctggctgtgcctctgtgaccttgggcaagtcacttctctttgagcctgggcttcattgttaagatgaaggggctatagatgagatgatctctgaggcctctctgaaggtcccggattctcagaaggcttaggccagtgcatcgttatctgctggtctgggctgcattgttatctaggagtcactttggactggtttgttagtctggcaggtccagaatgatgttgggggctgggccaatgatcctgaaatttagcctgcgagcccctcccagagagcttgtgactccactgtattccttctgacatcccatatttctctcttaatttcttttcctgttcttacttaggggctctttttctagttctcactttcctcccaacccagtctggtcttaatcattttctttttaaagt

SEQ ID NO: 10755 - DNA, 1043 bp, Homo sapiens
ggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggtgagcggccaggtggggcggaggtgggcctggaaaggggacgacgacaaggcggcgacgagagagggagtagcagggaggggccttgcgctggtgtagtgttttagaaaagcacgcccctctcctccgtccaggcctagtggccagtgaggcccgcagcagctcacagcctgcaggggtggttttgaggcgggggctacaagcactcgccggggccgcggcgctgcgggctccatcgggcagctcgcaccgcctgagcgcccgctgcttccacgcccggcaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtggtgagtgcgtcactgcctgcgccaccgccttctttccctctttccttccttccctctgcgctgcgctgcgctacgctacgctgcggggctgtggctgggtgggcgggcgagtcacgtcgccacctgtcggaggggaggtaccactgcagcccaggaaatggagcccaaaaggttttcagcgagagccatctgcattcctgggttgggaaaaggcatgctcagatgggactacctgtggatcccaagaagggcaaatattcgggagcgggggccgcagttaagttccaggtgggcagagtttcaatgagttgaggcattttggcattcggctgtcgaaacaaatgggcagctt

SEQ ID NO: 10756 - DNA, 1055 bp, Homo sapiens
gttatgaagcgggggtggggtgggctagttttaataggtccaggcgattagtacctggcatccttaaccacctacagtttgagaagggagtgggtgataaaagcctggaagggaagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaagtaagttccttagaatattatttttcctactgaaagttaccacatgcgtcgttgtttatacagtaataggaacaagaaaaaagtcacctaagctcaccctcatcaattgtggagttcctttatatcccatcttctctccaaacacatacgcagcagtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaagggtgagaatcgtcctagtcaaggcataggctgctggcctggggtagtcaaggcatgggctgctggtctggggaggatgcgggcggaggatgtggggcgacaaacctggctacgtccgccgggaaaatggggtaggggacgccgggtaccgtccttctaagtggggcgcttgcccccaagacttgggatcttattgggttacctaca

SEQ ID NO: 10757 - DNA, 1029 bp, Homo sapiens
tggggagtgcaaataaggctgcacagtaatcccccgaagggcttgctgggctccacccccagtgttcctggtttagtaggtctagggtgggcctgagaatttgcctaacaagtttccaggtgcagctgctgctggtagtttggggaccacacttgaagaaccacggggctaggtaacagaagcttatgctgttctctcgtcatgttccctgttcttcaggtagggaagacatatgagctactcaactgtgacaagcacaagtctatattgttgaagaatggacgggaccctggggaagcgcggccagatatcacccaccaggtaactccagggacagtgctcacaaccctttgagcctctgtatggaagggttggcagctgagtgctgcctctcttcagccttaaccatgtctcggtttctgctttgctcagagtttgctgatgctgatggatagtcccctgaaccgagctggcttgctacaggtttatatccatacacagaagaatgttctgattgaagtgaatccccagacccgaattcccagaacctttgaccgcttttgtggcctcatgggtaagaagccttagaacaaagttagaatgaacttgtcagtagggaagaagggaggaagaggaaaagggagaactaaatgtggatttttaagcgagaaaatgggagaacaacatgattaataccaggacaaggactgttattatttttctatgtttgtggaaactccactcctgttcttgcagtagcttcctggctgagtgaaagagggagtctgaacccatcactgtacagctagccatatgcttggcaactgtttgttcctaacatttcaggagtccagtctagatataaagcacacagggaactcatcttatccatggggttttccttgttcgatgactggacagaaggactgtggtctccatctagctctgaactcttttttcccccttctagttcaacttttacacaagctcagtgttcgagcagctgatggcccccagaagcttttgaag

SEQ ID NO: 10758 - DNA, 1109 bp, Homo sapiens
attaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtaaggtctgggctcaaccctgaaattcttggtagagctgaacttagtatagaattcccagagcagtaggcattttaacaatgcttacaatgagctagaagacacatgacagttccacaccctgccccagggcacatcctttgagggctgctgccataattggaagtcacagttaggaccttcttcatcctttgtagggatttgatattcaacagcacagctgaaatactagctcagccatagttttcctgccctaaagaagggctgaaacagctactgagtgacagagttggctgacaaaactgttcttttcttaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacac

SEQ ID NO: 10759 - DNA, 1032 bp, Homo sapiens
atccttgctcagtgctatctgaaagggagattgcacaggctggggaatgagggagagctccgctctggaatttgggttcagtcttttgttaacaacttttttcttccctttcattaagtcttgaacctctctgccgatgaatgggtacttacctgatctttccctccgtcaaagtagtcaacagccaaacctgagcagagagagaacggatgggtagggtggtgggagaggacactgaggatgtggcctgtagactgagtgcagccagaagtgtatggcggggggcggagggggggtgccgaggaagtttttagtgagatgggggagggacctacatgtaaggaaggcaggcagtgaccatcactcaccaatcagcttcaaagtcagaacacaatgtggcattgtccacttgatatcgtagttgccggtggcagtgtaatagtatccagccagaaggtaggcctaggagaggcagaagtatttattctagcatcactactatttcttctccttgctctgaaattcaatgttctctttcctttttcctttctcctcatcccatcattaaaagccttaataaattcctacaaatggaggtgctgaaaacctgtaatgggaagagcgttgctcaaggcttcttggcaaaatgagggctaaactgagatgagaatttagatgctgggaccacaggtgcatgccaccccacccggctaatttttaattttttttgtttcaccatgttgcccaggctggagggctaatttttgtattttttttgtagagatggggtttcaccatgttgcccgggttagtctcaaactcctgggctcaagcaatctgactgccttggcctcccaaggtgctgggattacaggtgtgagccactttgcctggcctaggcttaggttctttaactcattctaagttgcttttctgtcttgccttgaagtgactctgctcctggatagtgggttaaaccaaagagcctaatggcacagtatgcaaagggttagctggtggcccttccttgag

SEQ ID NO: 10760 - DNA, 1021 bp, Homo sapiens
ctactttatgtctctatagattggcctattctaggtgtttcatataaatggcgtcaggcaatgtgtagacctttgtgtctggcttatttcacttagcatgttttcaaggttcatccatgttgtagcatgtatcagtacttcattcctgtttatggctgaataatatcccgttgtatggatactctgcattcttttttttaacatttaaaaattttttatagacaaggtctcactatgttgctcaggctggtcttgaattcctgagctcaaatgatctgtccacctcagcttcccaaagtgctaggattgcaggcatgagccactacgcccagcctggatactctgcatataatctacccattcatcagctgacaaacaactgggttgtttccactttaggaacattatgaagaatgctgctacaaacattcatgcattttgtagagacagggtctcactatgttgcctaggccggtcttgaactcctggcctcaaatgatcctcctgctttggcctcccagagtgctgcaattacaggtatgagcccatgtacaagtttttgtgtgaacatatgtttttatgttttcaattctcttgggtatatacctaggaatggatctcctggatctttttcttttttttccctttgggacagagtctctctgtgttgtccaggctgaagtgcagtggcatgatcttggctcacggcaacctccgcttcccaggttcaagtgattctcctgtctcagcctcccgagtagctgggattacaggtgtgcaccaccatgcccagctaatttttgtattttcagtagagatggggtttctccatgttggccaggctagtctcgaactcctgacctcaagtgatcgacctgccttggcgtcccaaagtgctgggattacaggcgtgagccaccgggctgttgcccacgctggagtgcagtggcatgctcacagctcactgcagcctcaactttctaggttcaagtgatcctcccacctgagcctccctagcagc

SEQ ID NO: 10761 - DNA, 1103 bp, Homo sapiens
tggctaatttttttgtatttttagtggagacggggtttcaccgtgttagccaggatagtctcgatctcctgacctcgtgatctgcccgcctcagcctcccaaagtgctgggattataggtgtgagccactgcgcccggccgaaaattgagtattcttttaatggattttaagatataaaatctcaggctcagaaatttgagccacctaggggtgagaaattttggcctttgcccgcttcgaactgacttaactaaattaaatctatagaaagtaaaaaataaaggtctgtgaatgtacccagtactctcaggaagaagcatatttgccatgaagctaaaaaagcttcagtttcactccccttccaaggctctggggggtggggtgggggcgggagctagcaacgtgctcacatggtcatatatttttgtaaaacttatagaagatatttttgtattctttttcttaaagaagatatccaagattgtataagcttcagatcccagaaatcctagatttaaaaaaaataatcaaccaccaccccaacaaaattaggcacatgcctgaaaattctgctgctactgccagaattctgcgggtaggggcttcatccaaggtgttcctaataataggcagagtccccagattagttccggtgaggcttttgggaggggttatttggcgcggtgttggtgttggtaggatcctggctgtgaggctgaggcaggcctgaggagggctggggctgacaggtaggcagagttggctgggatgtgaggtgcaaggggtggtacttcggaaacaaactttgaagaggagaaggggcagcaagactgtgagtctggactttgtgatacactgtcacccctagtttagtgtgcctggttagggagaatcaagcagcatggaacccctcttcctttttcactaacatttttctgtatagtggttgaaacccagtgttaagagactgcatgacattggaaaagaaggggaggagaaaaagagtccatatgaggcaagaacagaacgcagccagaattagggcaggcagggaaaggaagggagtgagatgtgggagtcgggggggagttgaggtaacctg

SEQ ID NO: 10762 - DNA, 1037 bp, Homo sapiens
tagggaggggccgcatgtgcgggaggcagcactgcccacacgtactgtgcagacatgtcagatgacttgtgacctttgtacacatgccatttcccttcttatggctggttttaatttggcttttactctgcatcttccttgcttatccccccggatctgactgttgtgaaggaaggccctgctggattttatgccttacccctcctcttggcaccctgacccatagcattttgcacagaagtcatcaaaatcagctcctgagcacccctgggccttgttcctcatcccctacatcagtcctcctttctttgggccctccctctggtgttgtcctctccctggcatgactttgatgcagcttggtgccctgtggggtggggaggagcgtgctgactgcctcagtctcagggatagatgggcaggctccctcctgttctggctctccgtcgggattcctgcttgctcctttctggcatatgggtgtaccgtgtcgaggctgtaccttggtgtacagtataaggctgtatctcgttgtgcccatattgaggctgtttgttggtgtacagtattgaggctgtatcttggtgtacggtatcgaacctgtccctccatgtgccgtatcaaggctgtatcttgatgtaccgtatcgaggctgtacctcggtgtgctgtatcaaggctgtatctcaatgtataatgtcgaggctggctgacgtgtcttcatccctccttctctctggcatatgcagggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacggtgagtccacccctggcttccctggccacccagttccccttgagcacccacctccctcaggacaacccagggttgcattc

SEQ ID NO: 10763 - DNA, 1061 bp, Homo sapiens
ctcttgttttcagttgcccagtcaacttctctgtgtcccaccatgtggtaggctgtccccaccccccatctccacctccattaaagcccctccattgcaatgggaaagcctgggtaatggtgtgccccattctttcatcatcccatcctgggactggttggccccaactccgaggcctgttcttccctcaactgcagggcctacttcactggagagggcttagtcttgacctgctctttcatttctagccaattctccaacctcatttctcttgaccttgacaactcttttgaaaagggttgtcacccatgatgtatgtattaaccaaaggactgatgaagagctggtgatggagtgggccagctgatgttccctcctcagccagccagccagggtgcctaagaagcccaagttatcacttggactggaatgtgtgtgtgtgtgtgtgtgtgtgtgtgtgtgtgtgtgtgagagagagagagagagagagagagaggaaagaaaaatgctagagaacgagggaatgagagaggattaagagaatccaacatcctctccttcctgctgctttgaacttgttctggcctcagcctctgcacttgaccccatccccttcctgtgccctcagaggacggcttctctcactactcgctgactgtccacggctgtaggattgccttcctctactggcccctgcttgagagtgcccgcccagtcaagttcctctggaagctggagcaggtgaggcaagagccaggctcctgggagggctgagtagatgtgactcacttttaggaaaggaccttctctgggcagggtcagcattttctgggttcccccttgccctctctttgcttcttcactttcagcccctgaccattctactcccaggtcctcttgttcccttttcccaaagcttgtcccctgcagaaagcacttctggatttaaaaaaaaaagggaacaaatgactactaacaccaaagtcgaccaaccatctatttcctccttgttttattctctctctctcttatttaggactttaacagtatacatccctgac

SEQ ID NO: 10764 - DNA, 1045 bp, Homo sapiens
atgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctctattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgcctt

SEQ ID NO: 10765 - DNA, 1051 bp, Homo sapiens
tatctctaaaggaaaagtttgagattctgacatcctgaaaaccattgcagatgcagtgcaggctttgtaatgcaaaccactgcaggcttgctgcttccacttctacctctatagtctgtcagtttgctaatttttaatttctagtattctcttttttccccatttaaaaacaacagctacatttatttagcacttactaagtgctctaaaaatattaactcaaggtaatccttacaacaatcaaaatagtggagctgggattgaaactcaggcagcctaactcctcatgtgctacacctagccactgccctctttgttctagcattctgtatggggcaggaagtcatcacaccttattacctgacattggcattagaacaattagtggcctttcagataaaatgggaagaaaactgagcctgttattgtggatcttacatgtttcatccaggatcggtctttcactccgagaatgtctatgtgtctgtttttctctgcctttctcccagttctgtagtcttcattagacgtcgtgtggatgtgatggaccctgccctttggctgcctttcccagcttctatgggtatttcctttcagtcttccagcacacagagaagaatgtggcctgactcaggttctgcccaagccccgtggcacagggccctggagagagaggtctgggtaactaggttggttggactgagaaatggaagtacctcttgtttgcctttctaataatagccctgaacattagcctcgtgccattattttggggagcgtggaatgtgtggcagccaccagctcattaagtttcattcacttccctccagggacgatgctttggcagggtttatgggttcatctcttttatggaagggggaaactgaggcatcaagacttcactgggggccaggcatggtgtttcacacctgtaatcccagcactttgggagaccgagatgggtagatcacctgaggtcaggagttcaagaccagccaggccaacatggtgaaaccccacctctactaaaaatacaaaaaatagccgggtg

SEQ ID NO: 10766 - DNA, 1058 bp, Homo sapiens
gaaataagccagacggataaataatgcatgatctcacttacaagtggaatctagaaaaagttaaactcacagaaacccagtagaatcatggttacccaggctaggaggtcagggaagaaggaagataatggtcaaagggtacaaaccttcagctataagatgaataagcaccgagacctgatgtacaggatggtaactatagttaataataatgcatacctgaaatttgctaagagagtagatctcaagtgttctcaccacacacacaagtaactacgtgaggtaatggatacgtttattagcctaattgtaatcatttcacaatgtatacatatattaaaatatcacattgtatattctaaatatatataatttttatttgtcaaccatacctcaataaagctggaaaaaagatatatatatgtatatgtaaaaagtaacacatactgctttcttcagagattctgatatacctcccgcttttgccttcctgtaggaggacttaagagacttcctgaactgcgtcttttcttatcattactgagattttgaggcactgctattgacagaggtatatcttagaccttaagtttttgtttgggaaaaaaaatgtggacaatcaattttctagctcaactccccttaattatatttgatactacttgtcttgttataatgtgagcctgtattactcctcacttcctccattctgataacctcctaggcagtctgcttgccaatggcttttttagttctaattcagcttacatgttaaccccaaagtaatgtttgtgaaacaaagctctgctcatgttttttactctcctattaattgcctttaataattcttctttgcttataaagtccaaaatataatttcatcttcaactcagttttcccattgactcacaatgtgctttaacaaacttaagaactactagttgtttctttgtttctttctgttgtttttttttttttttttttttttttttttagacggagtctcactctgtcgcccaggctggagggcagtggcatgatctcggctcactgcaagc

SEQ ID NO: 10767 - DNA, 1554 bp, Homo sapiens
tctccactagttgagtgaaaggaaggaggtaatttaccaccatgtttggttcctgtttataagatgttttaagaaagatctgaaacagattttctgaagaaagcagaagctctcttcccattatgacttcggaaatcacttatgctgaagtgaggttcaaaaatgaattcaagtcctcaggcatcaacacagcctcttctgcaggtaaagatcattttctaggggtcagagtgaatgacgaggtgaaggatgaggagagggtttatgaataaggcataggtgttttcagttgctggttgtctgattgagtatgtctgggaaacacaagagtcccagaagattgagtggcctgcagatacgcattacggggtgtacatttgtattgtggagaagaaaagattttgtgccactctcttcagcctccactctgcttactgaaacagaggtgagagaaatccactccagttctgagctaaggcgagtgctctgatgcccctgtgttttctgaggctgagtggggctggggttaagagattgagtacagcttctgaaaccatcaatccagatgcagggggtcctgatgaatttgtgagatttgttttttgatcagttagagggaaagagtttgggtggacagtggtgagggtatatttgttggtaatggatggaaatgtaacaaaaggcctttgcaaatgaaagactagaaagtctacaaagaaagtctcttaaatctccaggaaactttttctgaaatcagagaacctattgcgtgttgcatctctgagacagactctgttacgtttgggagtagatgcaaggtgatttgggtgtcatgtgtgatatctcaagtatagagcaaaagagagaaaagaatgtatatagagtacaagaaactatgggggaaggggtcaggactatagttacgctttctaaaatacctctgtgaaggtgtggagagcacttagggaaattttttctccttaaaaactttatataatttctttattacacaagtattaatgttcattgtagaaaaaattaaccagaggtacacagatatttgaattataattactcttatcatctagagaaaatcataatttgcaatttagtgaatatccttccacatacaaatacatataatgtgcatatgtattttactaaaaatgtaatcatattatataatactgaatttttttcccccatcatttgacaaaatatcataactcgaagaaagtgattcctaaccatgagatggtaactaaaaagactgactttattctaaacatgtgatgaggaatgattataaagatttatttgctatagcattatttaaagttggaaaccattatttaaatatatgatgaaatactatgcaaccataataaggagtgttaaagaagaaaatataatggtatgaaaaatgttcatgatatagtgtaaaggaaaataataggtcagaaatcagtatttatggtatgtcaatcgtgggaaaatttgcatatgtgtatatatacattcaaaaaattgctagaaagatatataccaaaatat

SEQ ID NO: 10768 - DNA, 1052 bp, Homo sapiens
caaagtgctgggattacagatgtgagccaccgtgcccggccccatttttgttgtcttgattgtaggcatctattgattattatattttattaaatttgaaaacttactggttcttagcataatgacttattttctattgaactctggatatttttgcattatattctcagagtctggatcttatttaaacatgttttcgtaatagctgggcttttcagatggcacttcagcaggagaaaaggggccctgcctcattactgcctgattgaggtagacttggcttccttgacacctgaggggcaggggctcctggttgcatctgagtgtggaggggagttccagcttccatgtgctctctcttggctcttaattttaataatacacacacttttaagagtgattatttatattgcacgtatgtgcccctcttcccaatacagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggtactttctaatagataatggggctgtgagccctgcctgatctttgtatatctctcttggctaagaaggaggtttttgttactttgggatatttgcgctgtggcagaaggctttcaataaaataggtagaaagggctcctaagcctttatattccatacctccttcctgcttcagtaaaactaacctccccggaagaaattgtgacattaaaaatatatgagggttgaatggaaggatgaaaatgtttcagtctgaaatatcaatttgttatttcaatatgtaaatgttttatacatgattaactacttaacaaagaagaggtattaagttgaatagagaaaagaaataaagttaactcatgatgaatcacaatcaacactcaggaatgaaaataaagaatccctgaagttatgaaaggaaaatgactgaatctgccaaaattttctcatgtacaacttt

SEQ ID NO: 10769 - DNA, 1031 bp, Homo sapiens
ccctactatactgatatataattgtatatatatactgacatatatatatattatattttatatatatattataatatatatatatacactgacaaataaaattgtatatatttaaggtttacactgtggtgatttgacatacatatatattgtaaaatgattaccgtaatcaagttacttaacccacacccattatcttacatagttaacaatcttgtgtgtagtgagaacgtttaagatctactccattctgtccattggtatcaacaaacacaaagcaagatctactccccaaaaaatttcaagtgtgcaatgcatcattattaactatagtcaccatccagcacattagatctctagaacttcgtcatcttagaactgaaaatttgtaccctttgaccaacattgcctgattttctccactgccctccattccctcacaaccatcattttaccctctgtttctatggattgactttttaagattctacatataagtagaattgtacagtatttgtcattctctgtatgacttattatatttcacttagtataatgccctccagattcatccatgttgtgcaaatgacaggatttcctttttttatggctgaatactactccattttatatacatagtacattttctttatcctttcatccattggccaatacttaagttgtttccgtgtcttcactattgtgaataatgatccaataagcatggaagtgcagatatctgttctagataatgatttcattttcttttggtatatacccagaagtaggattgctggatcatatgatagttttatttatatttatttatttatttatttagagatggagtctcattctgtcggcaggctggagtaaaatggcatgatcttggctcactgcaacctctgcctcctgggttcaagcgattctcctgcctcagcctctcaagtagctgggatacaggtgaacgccaccatgcccagccaatttttgtatttttagtagagacggggtttcagcatgttggccag

SEQ ID NO: 10770 - DNA, 1028 bp, Homo sapiens
aactcagcctgtggggaacatggattttcacaacagcaaccacagagcgtggtttccatttctattccctgttcatgtgggaggcagagaaggaaatcaggtgctcagttccagggacatcacaggactaggacatgtgcagtgagggtggaaggcagaggcattgctttaggagaataaaattactgcatgcacacacatatgtatgtatatggatgtatgtacacaaacatgcatatttataggttctgttctccctctctctatataattttctttatttcacacttgatatgatttctaaatttaaatacctttgagacaaatgtgaattgtgaagggatttaaaaatgtcagtgaaaaatggaattaacaataaaaatataaatataaactttgtttctcaatataagctctactgaggtccagacactccattaagggatgatcccagccattcagtccattgctaaacaactgagggtaacgggaatttaaccttgtcaatgcagtcttctattagtaactaaagaaaaacgggtgccctttacagttattttaagattagggaaaaaaaggtcagaagaaaccaaatcaggactgtaatgttgatgcctaataatttcccatgaaaactcttgcaaaattacccatgtttgatgagaggaaggagcagaagtgttgttgtggtgcagagtgactctctagtgaagctttacagggcgcttttctgcaaaagtacttgctaattttctctaagaactctcctagtaagcagatgttatggtgctttgatcttacagaaagtcaaccagcaaaatgccttgagcatccccaaaacctccatggcttttgcttttgagaagtttgcttttgctttgactggaccacttctacctcttggtagccattgctcgaattgtgctttgtcttcaggatcttattgataaagccagtttcactccctgttataattcttcaaaataatgcttcaggatcttgattccgcttgctcaaaatagccacta

SEQ ID NO: 10771 - DNA, 1064 bp, Homo sapiens
agactttttgaaaaacatttttaaaaatactagttttttctcatttgtttcattaatttatattttgtatttataattttccctttatcttctttagggttattatgctgttttttttccaaaagcccccaaaatgcgtgcttagcccattaaattttagccatttttgtattgaaagtaatgttacccatttctgtgtggttacctgtaatataccgtgagcagcacttcttggtgtctttgctccttattaattcacttgtctgaagttcctttaactctgctttctggtcctcagtttcactttgcaaatcattttttattcataaccatataaaacataatttattttgaaaagtctctcatataattttcacttattctaggattataatttttccgtttgtctcttagaataaaactttcagatttgtcaacactcatttagcagtagctcctattgataggattccatccatctcttttgacctagtaagtgaatataacaatagatgccatagaaattcaatcctgtcagatctaactgcctacatataaatttccatgtcccgcaaaggcatctcattgaggtcatgttctgttgtatccttactttgtatcttgagatgcttggtggggcatggaaatttatatgcaggcagtttcatctgacaggattgaatttcagcagcatccattattatatccactcactaggtcaaaagacatggatggaatcttatcaacaggagctactgctaaatgagtctcttttctatttttccctattataatcctagtgaagctgtaaatattaggttcttgaacccacaggactgattctaggatcttgtctggccagggatatagccttctcatctgcagaaccttatagtaatcagctaccaacttacctggggataagagaattgaaaaaagaaggagaataaggagaagcacatggagtctcacggctgaagggccagcatcaatgtgggttgagcctggattctctgggcattgtgggtctgggcctttttatgatgctctctgagtctgtgatt

SEQ ID NO: 10772 - DNA, 1034 bp, Homo sapiens
tttactaccttttatttcaaaagtgtctatatcaagttgtgacaaaacagattcaaacttgttcctttcttaaatgcttttattctgtattcagcttcttacatttcttttttttccttctgatactagcttttggcttcacgttcctataaatttagaaataaggtctctaaagtggaatatagaattgctgtataagatcagaccatttcttactactgtgctttccaattttgaggagtatttgaatttttcatactttatcagaaaactgcattttgaaaagtcaggcagggttgcccaaatagcaaccttggaattcttccctgaggctttggagttctcagttgttagtttattcctttgacatgtgatttagttagccatatctgtaaagccttgggcttgagagtaaatgaatagctttctaactcctttttcaaagtaatatctgggaagaaaatttagacagaaggccagacatttatcatgttaaatatgaaacttggggactttgtactgtgcattaaacctaggaactgtcttctgtgccatgttccagaaataatttgatgtaagtttcttctattaagtgaaatcattagaaatgtttggaggctgggcatggtggctcacacctgtaatcccaacactttgtggggccaagatgggtggatcacctaaggccaggagtttgagaccagcctggccaacatggcgaaaacccatgtctactaaaaatacaaaaattagctgggtgtagtggcacgtgcctgtaatttcagctactcgggaggctgaggcaggagaattgcttgaacccaggaggcaggttgcagggagccaagatcgcaccactgcactccagcctgggcagcagagtgagactccctctcaaaaaaaagaaaaagaaaagaaaaagagaaatgttgtttggattccagaagaacttttttaaggcagggttttgctttgtcacccaggctgaagtacagtagtatgtgatcatagctcactgtagccttgaacttcta

SEQ ID NO: 10773 - DNA, 1310 bp, Homo sapiens
tctatcgtatgttacaatagaattctatacagattccactgtgtgttacagtagagttctatacagattccactgtgtgttacaatagagttctatacagattccattatgtgttacagtagagttctatacagattctattgtgtgttagagttttatacatattctattttatattagtgtatttttttcctttagctttatttttcttcagtatttgggattttgagctcatatgttaatggattttcttagtaagaggtaccttaatatcttcagatggtagattgtgattttttgctttttctgtactagaataaatacctttgggaagggtcctcacaagaaagatgagagggagagaaatgactttcattttaactttttttcttttattctgtgatgtaatagaaatcttttatgctctcatttgtcctctgtacagaataggttgacacatccttttggaagctttaaatatttgtaatgtattttgagattttgactctaaacattgaacttttcctttgtttattaaggaaatttgatccagtaagaaacaacactaagttttagatcccaggatgttgacttgaaaaacttttaaagtagaaaaattattcctcgggttggtctaataagggaactaaaagttgggagaaacaaagtggtactttctaaactattaccttagaaaaaatttaggaaatcttaagcagtgaaacaaatgtctgcttatttcctatttcagaagatgaatgaagcactttaagattcccatatactcagttttgcctgagtattccaagatgcagtgctgttttttattggtatgctgatccagaagtttgtgtgggaaaactctcaaaaataaactctctttgtagaatttctctttatttcaaaaaaggtacttttgtcagtagtatttattcagcatctgatatttatacattgtttttcttgatgcactggaggaaataaagagaggatgggattggttgacctgagcttacattctaagagaggaaatactatacggtactcatctatactatatgtggacatttgcaattgctgcgtttatgtttcgctactggagaatattttcttacagttatcttattgggtaaccaagtttactcctttaaactactaggaaaaaagtttgccattttattttatagaggactctactgtcttttaaaatagtgaatattgtctgaattttaagattctggatcattagcaggactgtcattttattggtgcacttttgagctcctgtactatttagatttactggaatc

SEQ ID NO: 10774 - DNA, 1049 bp, Homo sapiens
cagttctgtactttaaatggatgaattttacaatatgtgaattatatctcaaagccgtttaaaaaatgttacacgtcatttacacattatctgtgcaatgttttcacagtcaggttaaagagagggtatagttgtaaatgagtagaaggcatagaagttcttttccttttccttttttttttccctcattgcctctccctttgtgtcagtgtatgtaaaactgctctcttgaacttctcttacaaatctgttctagctccaatattagtcttttctattaatggtgtcctattcctagcctaagcttgaagaaatcatggagtcaactttcttcttcattctcccttacttccagatataatgtaaaaggcttgtctgttttgttcatagtatatctgacataatgtctgttcttactactgctaatgaaatcaaagttgcctgaactattacagtaacctctaaatttgtttccactttaaactcatcttctaacgtactgtagtcaaattaatctctcggaattatggctctagttatatttgcctttcccaaatcccctttatgtttttattgcctaatcctccaagttttttttgttgttgttgagtatcttcatcggttaaaaacttttgaaacattcaccccaatatacgcctattttaaaataacgaataatgtactgtgctgttgcctgttgtagcactgtccttgggctagcagaattgtattttccttgttcatctcttttactgacagtgtggccttggattttcagcctctgtgcctcaaattaaaaccatctcccggtagcaagtgtgctgatttttcacaactatcccactgtagtcaaactactgtgccagctattccatttcctctatggaaatggaatcagatctaggtaaaaaagaccatagatttccattgttgatacccagtgttctagcaggtttttgttgttgttgttttaaatgtgtcttaatttgtctgtctttgattaattaccagagctctgaaatagaattgacaaaaatatttccagtttt

SEQ ID NO: 10775 - DNA, 1051 bp, Homo sapiens
cctcccagagtccagtgattacaggtttgagccactgcacctgaccagatttatctaatctgacttcaaattcttctgtcagttatatgaattgtaagtacagtattttcatcccagtctgtggtatttcttcttcttttttttgattatagattttgatggacaaaaattgtcccttttaatgtcaagcatattcatctatttctttatattctctactatttttaaattgaagaaattcttctccaccctttggtcatgttcagttcttgaatagtcttctaaaagcttttccgtgtttaggactttaatctacctgaaattgattttgctgttcagcatcatgaaggagatcctgttttcttttttcgaaatgaataaccggttgtctgaacactacttattgaatagtctgtttattactactttgtaacgtgtttaatttccatatgtgcattggtctattgcaaggtcccttagtctattgtatcgtgctttttatgtatgaataccagtctttattcttttggtactatgggtagatatctgatagagcaagagcctctctaccttgtttgccagaattgaattgcaatttgtattcagtgttttactattgtgagcaataatactataaacatcctgtgaatatgctttgctttatatactggtgcctttgtcttgataagtctcatcaaggttggaattgatggaacaaaatacatatttaaaaaaatgtatggccaggcacagtggctcatgctgtaatcccagcactttgggaggctgaggtgggaggatcacttgaggtcaggagtttgagaccaaagggcaacatggtgaaaccccatctctactaaaaatacaaaaattagctgggcatggtggcagccacctgtagtcccagctactcaggaggctgagacaggagaatcacttgaacctgggaggtagaggttgcagtgagccaaggtcgtgtcactgcacttcagcctgggcaacagagcaagactccgtctctaaataatcaatcagattactttttaaaaag

SEQ ID NO: 10776 - DNA, 1067 bp, Homo sapiens
ttgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactttgaatagttacatatcacaagtatgtagttcatgtttgtgttggtggggtaaggcatcaggaaaaatgtagttagtcttttcttaacttataccaaattaaccaactatattataggaaatatgtgaaattagttcattagctttattcactattatgcattcacatgatattaaaacgtacactcacatgttagaatgaaaagagcagtagttatcttagattttaaaaacatggatatcttcttgaattccttcaagattgaggtagagaataagagcaaatcattctggaagtaccttaaggaaacaaacagcagcagatatttaggttaaacttattttcataattgtttaataacttttgtataatcttca

SEQ ID NO: 10777 - DNA, 1044 bp, Homo sapiens
attccatgctcatgggtaggaagaatcaatatcgtgaaaatggccatactgcccaaggtaatttatagattcaatgccatccccatcaagctagcaatgactttcttcacagaattggaaaaaactactttgaaattcatatggaaccaaaaaagagtccacattgccaagtcaatcctaagccaaaagaacaaagctggaggcatcacgctacctgaattcaaactgtactacaaggctacagtaaccaaaacagcatggtactggtaccaaaacagagatatagaccaatggaacagaacagagccctcagagataatgccgcatatctacaactatctgatctttgacaaacctgagaaaaacaagcaatggggaaaggattccctatttaataaatggtgctgggaaaactggctagccatacatagaaagctgaaactggatcacttccttacaccttatacaaaaattaattcaagatggattaaagacttcaatgttagacctaaaaccataaaaaccctaggagacaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactatcatcagagtgaacaggcaacctacagaatgggagaaaattttcacaacctactcatctgacaaagggctaatatccagaatctacaatgaactcaaacaaatttacaagaaaaaaacaaccccatcaaaaagtgggcaaaggatatgaacagacacttctcaaaagaaggcatttatgcagccaaaaaacacatgaaaaaatgctcatcgtcactggccaccagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttc

SEQ ID NO: 10778 - DNA, 1044 bp, Homo sapiens
tactcacacctctttctggaagttgccattgggtggctctgtgggctcccaggctgttgctcagtgcagtcagccgttcttgggagttctgggggaagagcccagtgtcatggatttgagggcattccagctctgaggttgcaggcttctccttggcagtgggctggctaccgtagcaggtgaaagtgtggaacttctggttgagctcttttattttagttaaaaaaaaaagtctcaaatcaatgatctaagctttcacattgaggaatgagaggaagaggaggaaattacacttaaagtaagcaaaaggaagaatctaataaagaggcacaagacatcaatggaatagaaaatagaaaaacaacagagaaaatgaagccaaaatctagttttttaaagtgatcaataaaattgataaaatgttgacaaaatgactagaggaaaggcacacatttccaatatcaggaatcagggaggtaaaatcactatagattctaagccatgaaaagcatactaagggctgggcatggtggggctcatgcctgtaatctcaacactttgggaggccaagacaggtggattgcttgagcccaggagtttgagaccagactgggcaacatggtgaaaccccatctctacaaaaaataccaaagttagccaggtatggtggtgcatgcctgtggtctcagctactctggaggctgaggtgggaggattgcctaagcctgggaggttgaggctgcagtgagctgtgattgtgccattctccaccagtctgggctacagagggagaccttgtctcaaaaaacaaaacaaaacaaagcaaaacaaccacgataataagtggtcagtaaaatctggcctgtgtgcctaatctggcttgccatttcttttgtgagtaaagttttattggaacacacacacaactatttacattgtatctatggctgcttttgtactatagtggcagaagtgagtagttgtgggagaccacattgccagaaaagcctgaaatatttactgtgtggcttcttacagaaaacg

SEQ ID NO: 10779 - DNA, 1050 bp, Homo sapiens
agtcacaagtctgggcctctggaacatctgaccaataagcttcaagttgggatttccacaacttcccctttgagttcagttaatttgctggagcagctcacagaactcagggaaacccttatgtttatcagtttattataaagtatattacaaaagatacagatgaagagaactgtagggcagggtatggggaaaggggtgtggagcttccatgccctctctgggaaggctgctctccaggaatctccacaggttcagtcatctggaagcattctgacacagttctcttgggtttttatggaagcttcaggacatcagcattcttgctgctgaccccctccccttgtcaccccagtaaagggcaggaccctctctggggaaggttttaagacccacaatcagaaaggcaggggaaaattagagtcctgccttgaggcagatgaaaggagggcagaagaaggccagaggccttccccttggggcctgacacactcaacattataagaaaggactgtaacagggaccataggagttaggagccagaaactgtggatgaaaaccaatatatacatatgtataataccaccctggggttatggattttggggaacaaaccttactggttaggtgcttttatcattgcatcatattagggggtacatgatatcaacaagactcatcactggtggttcacgcagtgaaccctgttcatgtggttgaggtggtatttgccaagattctttaatgaatagttactatttccttttatccatagtgtactctttggaagtgagtctcttatccctgactaccctcaaagggaggagagttaaattccacatcctgaatggggagtatctacatatattatttggtattttctgtaagcaagatttgtcacttctcacctatttatttatttaaatcagtatggatttatatagtttttccccttgtgttataattcaacactgtcatttattttgttgttcatattgttccattgggagcttttccaggttggtttctgtgtcctgatatgctcccatc

SEQ ID NO: 10780 - DNA, 1055 bp, Homo sapiens
ttgttgtagcaactcctattctcattctgatatagtgactctcaggatttgagctgactaaagtcagtagcagaagtgagccatgaacttgaaacattgagggcaaaactgataaacaggagtcgtgagtcatagcacaagacactgccacagaaaattgtggtgtagcagctgctataaatttcacagtgtgatcatgagaggtgaggagggaaaggatgaagggcacagaatatctgggaaaatggcaatatttctgtttctctgaggaacccagaggaagggcaggatcattagagggattttgtccttcctctgcttcctgacatgcccccattccttagactattgttgagtaaaaccagcagagttacattcactgcatttccaaattgagtttattttctcctaaggctccttggggccaagtcagtgctggagagggcggaatgtccctgctagatgtcataagttttacttttaacattcctgtggaatcttacttgattctctggtttaattctttttcttgctccggcttttgtcagattctgtagaaccaaattgattttacgtgccctgctgcgtctgttgttctagtgttattattcttttgttctcagggcaagatttacatactattttgaggtatgtacaatgtttctagtatcatactggggtctgagccactaccaaaaaagcaagaagtaaaaataaaaaagagagctctatggatctattaaaactgaagtttttcaaactgacattccattggtggagagtgctgctagagaattttgttgctatatgtagaatctacaggcctatggaaaatatccctcttatgctgttaaacggtcatctttcagtgagatgcttacgtagagttcacctcctatcttagatcacttacggcaaagtgtacaataataacagaggctaccatggattgagcacttgctttttgccagatgttttatgtatagtattctttttttttttctttttgagatggagttttgctcttgttgcccaggctgaagtgcagtggcaca

SEQ ID NO: 10781 - DNA, 1050 bp, Homo sapiens
atcttctagagttttacagtacatagagttttatagaatcatatagtatgtacttttttttctggcttctttcactcagcataattattctgagattcatccatgttgttgtttgcatcaatattttactcttttttattgctaatattctactgtgtggatttaccgcaattaatttatccatttactctttgatggacgtttaagttgtttccagcttttggctattaaaaataaagctgttatgaacatttggatacgaatctttgaatggacatagtctttcttttttcttggctaaatgcctaggaagtggcatggctggatcatatggtagatgtatagttatgtattagttgaaaacaaggatgccttctgagaaatgcatcgttaggcaaattcatcatcgtggcaacatcatagaatgtacttacacaaacctagatggaagagcctactacatacctgggctatatgggacagcctattgctcttaggctgcaaacctgcacagcaagttactgtactaaatactgtggacaattgtaacacaatggcaagtatttatgtatttaaacacatccaagcatagaaaaaatacagtaaaatacagtataaaagataaaaaatggtacacctgcatatgacacttaccatgaatggagcttgcagattacagtataaaagataaaaaacggtacaccggtatatgacacttaccatgaatggaacttgcagactggaagttgccctgaatgaccaatcggtaagttaatgtaaaggcctagggcattactccacattactatagactttataaatattgtacgtttaagctacagtaaatgaaataatgaaataaccttagcttactgtaacttgtttactttataaacttttacatttacatttttaaaaacttttttactctttttttttttttttgagacacagttttgctttgtcacctagactggagtgcagtggcatgatctcagctcactgtgacctccgcctcctgggttcaagcgattctcacgcctcagcctc

SEQ ID NO: 10782 - DNA, 1035 bp, Homo sapiens
gaatagtgccacaataaacatatgtgtgcatgtgtctttatagcagcatgatttataatcctttgggtatatacccagtaatgggatggctgggtcaaatgtatttctagttctagatccctgaggaatcgccacattgacttccacagtggttgaactagtttatagtcccaccaacagtgtaaaagtgttcctatttctccacatcctctccagcacctgttgtttcctgggacatggatgaagctggaaaccatcattctcagcaaactattgcaaggacagaaaaacaaacaccgcatgttctcactcataggtgggaattgaacaatgagaacacttggacacaggaaggggaacatcacacaccggggcctgttgtggggtgaggggatgggggagggatagcattaggagatatagctaatgtaaatgacgagttaatgggtgcagcacaccaacatggcacatgtatacatatgtaataaacctgcacattgtgcacatgtaccctagaacttaaagtataaaaaaaaaagaaatagaaacaattatctgcaacttagctaatattgtaaaataaaaaataaatagaaacaatcaaaaagaaaccaaatagaaatcctggaaataaagaatacaatgactaaaattaaaaattcaaagtaagctcaacagcagacttgatcaagcagaagaatcagtgagctcaaagatagagtatttggaattatccaggcagaagagcagaaagacaaaagaatgaagaaagcctatggaaattatgggacatcatcatgaaatcaaacctttgcattaaagaaagtccagaagaagaagaaagagactataaagcacatttaaagcaataatgaaaaaaaagagtatagaatcagaaaaaaaaaaaagcagtaagggctgaaaacttccctaattaggggatagatgctagcatccaagtacaggaggcacagaggtctccagtgaaattcaaatgaaagaactgctcactaagacacaataattaaactatca

SEQ ID NO: 10783 - DNA, 1051 bp, Homo sapiens
gagatgtactcagtgatcaaagagcagagtttttctcatttgtgctatcccactaacgtgtgtgtgtgtgtgtgtgtgtgtgtgtgtgtatttttttttttcagagacagggtcttgctctgttgcccaggctggagtacagtggttagatcatagctcagtgcagccttgaactcctaggctcaactgatcctcccatctcagcctcccaaatagctaagactacaggtgcactccaccacgccccgctaatttttttcttaagctttttatggagacagggtcctaccatgttgctcaggctagcctcaaagtcctggcctcacgggatcttcctatctcggccccgcaaagtgttagggttacaggcatgaaccatcatacccggactttctgctttttaatgagaaaaaatatttgaatatacaaagataaaagcacatcctcaggttgttttcattctaatatgcctccatcatttctcaaaattatcaaaaagcactttgggagactgaggcaggtggatcatgaggtcaagagattgagaccatcctggccaacatggtgaaaccccgtctctacttaaactacaaaaattagctgggtgtggtggcgtgcgcctgtagtcccagctgcacgggagactgatgcacgagaatcgcttaaacccgggaggcagaggttgcagtgagccgagatcacgccactgcactccagcctggcaacagagcgagcctctgtctcgaaacaaacaaacaaaaaaacaaaaacaaaaagaaagaaagaaagcgttttatctttttaatcaggatacacttggtcctttaggtttctaaagaggactgatttccacacataatccattttattagatcctatgtttgctacagaggaattagtgtttggactaaaacaatttactacaaacaatagaattcaatggctgtcctaacatatttatactttggggcatgccgaagtatttttgtataatgaatctgtccccattgtgaatttgctatgtatatacatttcaaatttatagatacta

SEQ ID NO: 10784 - DNA, 1060 bp, Homo sapiens
tgaacttgatttagtcctgtggtacgaaggtagggtaggttgatggaggaagaagcatagagcatactcaccaatctctccaatgttattttagttggactgatgaaagagaaaagtggtagagagagttcttttattgttcgtgatattttctgagaattgcagtatagactagaatataaaacttaactattgacctcatgtgacttttgtgatgctctctctggcaaatagagataaaaatagtttgaaaatgttattgcattttctgtttgttgtacctcttttctttctttttttttctctccaactgaatcagtccgtttttgttgttttgtaacctcttccagagttaactacttccattgtaggtgatgaaatgtataaggcaccacttcaaatgttggcactgctataagcatgttctttcctgctaattcaactcagaattaaaacttttgattcttgttttgttttttgttgttgttattgttgttgttgttgttgtttttgtactccatactcagaaatagtttccactgtagaagttatctcatggcagttgtgttctttctagtagtggtctacaaccagactctagtttctccaagaacactacaagatagattgagtttaaatatgtactaaactaaatgacactctttcaaatgagtttgaatgcattttgtttttagacaacctctatgacattttttccttaaaaacaatgcctctgctccaaataaatcatggtcaaaataaatgaagatctcaagatgacatcagttctacttgtctaagtcctggtgttgtatggatgacaagcagaagccagttatgacaggtgatacatccaaagtaactgccaaatttgttaacatttttccatttctaaaccatggaaaatcatctatggagtcacaccatcctcatggtagtccagcagaggcagcatgccatatgggttcatgttttcaccaataaagaactggtagtttttattgcttcttgaccttttggctaagatcaaatgaagaactggtagtttctgagattagaa

SEQ ID NO: 10785 - DNA, 1102 bp, Homo sapiens
gaaccgggctgaggctaagaattgacagaagtagacttcagaaagtggataacaataaactttgctgagctgtaacccaatgaaaagaagctgagaatcatgataaaacaatacaggagctggtagccagaatagccagtttagagaggaacataactgacctgatggagctgaaaaccgcatctcaagaacttcacaatgcaatcacaagtatcagtagcaggatagaccaagaggaggaaagaatctcagagcctgaagattatctatctgaaataagacaggcagactagaatagagaagaaagaatgaaaagaaatgaacaaaacctctgagaaatatgggattatgtaaaaagaccaaacctatgactgattgggatccttgaaagagacagggagaatggaaccaagttggaaaacatacttcaggatatcatccaggagaacttccccaacctagcaagacaggccaacattcaaattcaggaaatgcagagaaggccagtaagatactccacaagaacatcaacccaaagacacaaaatcatcagattctccaatgccaaaatgaaagaaaccatgttaaggacacctagagagaaaggccaagtcacctacaaaaggaaacatatcatactaacagtggacctctctgccaaaaccatggaagccagaagaaattgggggccaatattcaacattctaaaagaaaataatttccaacccagaattttatacctggccaaactaagcttcaaaagcaaaggagaaataagattcttttcaaacaagtgaatggttaggaaatttatcaacacaaggcctgccttgcaagagctcctgaagaaagcactacgtttggaaaagaaagaccattaccagccactacaaaaacacactgaagtacacaggccagaacactatgaagcaatcacataaacaagtctgcaaaaaagcatcatgatgacaggatctaattcacccataaaaatactaaccttaaatgtaaatgggctaaatgctctagttaaaagacacagaatggcaagctgaataaagagccaagacccatcatcagtatgctatcttcaagagactca

SEQ ID NO: 10786 - DNA, 1066 bp, Homo sapiens
gaaaattaaataggcaaataatttaggtaataataatttggacagtatgaagaatagtgtgaaaagagaacaatatgaggaagctcaacttggacaatttgaaaagttttaaaaagttgaatttagacaaattgtgaataaaatttgttcttttatcatagaggtgtaagtgcttttgataattctttggtgaagagtaaatcggtaattaataactattaaaatatgtggttaaaattgttttatgatgaaacaattatgatttaattagctatatagagaaattttttccaattgttgactcagctactttcaataaaattttgtggcatcttcacaaagtaaatgattaaataactagtcctcattttactatatagagattttcatacagactcttcctgttatgaataaaattcaaattggaatattataaaagaaaaaatcaaataaatgttttaaaacctttgattatttctgtgaatgtgatacatagaccagtattagaagaaaattattcaacaaaaattgaagaacaatgtacacagtggggtccattctccatatctaactacctctacactagtattgggaaaaaactgatattcaaaactggcagcagtttttaatgtttaattaaaataattattaattattagagtactgattaataatgcataaattttaactttctcaaaattgtttcaattttcaaaactgaaaaataaaaattaaaaattaatatttaatttttccagcttagcaggaagagaaactacataaatagaaaatattaggcatggagcaaatcctaatggttattaagtttagcttaggggtgtggtggaaattggtaaaatgtttcccttagtttaggttaattacaaaaatgttcacgggttctcttttcagtggtttaacctctagattatttgacttagaatagaaaacgatcttggttccccaggcctcaatttattcttgaagtgaatccaatttcgtatataaagtactcatggcctggcacaagaaaaaaaaatctatcacctttcttccttcccatttc

SEQ ID NO: 10787 - DNA, 1025 bp, Homo sapiens
tctagcagcatgatttataatcctttgggtatatatccagtaatgggatcgctgagtcaaatggtatttctagttctagatccttgaggaatcgccacactgtcttcacaatggttgaactagtttacagtcccaccaacagtgtaaaagcgttcctatttctccacatcctctccagcacctgttgtttcctgactttttaacgatcgccattctaactggtgtgagatggtatctgctgtttggcactatgcttcttggacacaccaatgtatctcaggatttacttgtctgtaaaggattttatttctccttcacttttgaggcttagtttggctggatatgaaattctgggttgaaaattcttttctttaagaatgttgaatattggcccccactgtcttctggcttttagggtttctgctgagagatccactgttagtctgatgggcttccctttgtgggtaactcaacctttttctctggctgaccttagcatttttgccttcatttcaaccttggcgaatctgacaattttgtgtcttggtgttgctcttcttgaggagtatctttgtggtgttctctgtatttcctgtatttgaatgtcggcctgccttgctaggttgggtaagttctcctgtataatatcctgaagagtattttccaacttggttccattctccccatcaccttcaggtataccaatcaaacgtagatttggtctttttacatagtcccatatttcttggaggctttgttcatttctttttactcttttttctctaaacttctcttcttgcttcatttcattcatttgatcttcagtcactgataccctttcttccacttgatcgaatcggctactgaagcttgtgcatgcatcacgtagttctcatgccatggttttcagctccatcaggtcatttaagatcttctctaccctgtttagtctagttagtcatttatctaatcttttttcaaggtttttaactcccttgcgatgggctcaaacatcctcctttagc

SEQ ID NO: 10788 - DNA, 1604 bp, Homo sapiens
ttatgctggatatctcttgcgactggatgagcttcactaaagcacagtcatttggatctggattcgaatccctggttttccactttttagctgtgagtttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcctcccctttccttcatgtgttaaagctttttcagtacatacccctctctcaggattgaattgtaagtcatattttttaattacccttcttgtaataattcctctacctctgtagtcatgtttttcttttttcattttttcttgtccccagaatgtctaacaaaacagccaaatatacctctgtaaagacagagggtaaaataatgctagttctgtgagttctctcttcttgtgcaaatccataaactgccaccaatctgtagtcattttaattgcccctaaaccgaagagcatcatggcaactacctttcccctcgtagagtgacactatcactagtcttactgaggccaaagttataaagatgggctctcgatctactaatattagtaaaatgggtttgggacttactaacatttgtgcttagaagagacagacctggcaaagagcttggagaagtgagttccaaagagagaggtgtgggaaccaggatggaagagtcaggcctccagatagcgtttacttctcctttcttccttgaatcactgtctcagagataattaggttcagaagaggaggaaaaaaaagatgacgtcaacatggagcagagtttttcttagaccttagcctagcaaggaaagagaaatgcctggtctcagtgctgggaagctgtttcagccagagccccgtggctgtgaagagagctctcctgtctggagccaaacagaaagctcataggtcttgaggccagaaaagttagtaggtggcggctctggtcggtgctggaaatggaggccaggatgaactaagaagcaaactaaagatacttgtaatataaggacgtgtaggctgggtgcggtggctcacgcctgtaatcccagcacttcgggaggccaaggcgggcggatcacgaggtcaggagatcgagaccatcctggctaacacggtgaaaccccgtctctaccaaaaaaaaaaaaaaaaaaaaattagccggccgtggtggcgggcgcctgtagtcccagctactcgggaggctgaggcaggagaatggtgtgaacccgggaggcgagcttgcagtgagccgagatcgcgccactgcactccagcctgggtgacagagtgagactctgtctgggaaaaaaaaaaaaaaaaaaaaaagataaggacgtgtatgttaacttgcgctatccaaacaagctgtgcttatggtcctctgcctgtgcgtcatgattttccaggacttcacaacgggataaagtgaagtagcttcggcttgtgaatgtgcattgcagagacgtgggagaagaaagctgcaaaagtcattatgagcaacacccttgatcttaggggtgctggtctt

SEQ ID NO: 10789 - DNA, 1039 bp, Homo sapiens
cctagggtccatgagtgccagtggcagtgaggacagtcaccggcctggcctgtgtcctctcagctgtcctcacagcagctcaggcagggcaggaacatttgtgtctgcaccttatacacaaggaggctgcagccccacaaggagagactccttggctgaggccacaagcctcggcagtggagagctgggctagaactcagccggcctggctctacatctcaggctctgaggcagctgactgcactgggtaacctttgaggtgccaaccgtcaaggcgtccttagcctgagctttccttctcccataaagcctctgttggtccagactcaaggtttccacttgatgagccatgagctgctgggtgacttagccctgagcaggccacccaggccatttcgggcccacaggatccctggtgacagccccgtttccattcacactggaacctcaccaccatccctgagtgtctgctctgagtatggcactgtccagatgctgtggacgtagaagggaagaagacatggaggggacagttaatagacatgaaaacaaatagcacctatgtgaagtcagcatgtttgcctacaaggaaaacaaaatggtgatgtggatggggtggggggctgcacctgatgatgagtcccgtgtgtcctgtgacatcctggccaccacatctgtgggagggtaactgcaagaccagagaccctccgtggatattcctgaaggttcatccccggccttcacggtctgtctgcagggcgccttctgacgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcaggtgtcgtcttggtggcttcgggtgtcagctgctctgttttgctcacgcacctgcttgtgcttctgttgttgcctcctctccctggctgggctcg

SEQ ID NO: 10790 - DNA, 1038 bp, Homo sapiens
gagtagttggattttaggctggccattgctgtatcaggacccaatcaattggcctagacgggatctctcagccttacaagccctctccaggtggtaggtacagagtggagagaggctgagttttgatcacagtcggagagggctgacggaaggggtagaacggagcagctggtgacatgggtgatgacccgggagttcctgacgtccacccactgggctcttgtctcccccccacgtgtgtggtgatggtgggcatgcccttccccaacatcaggtctgcagagctgcaggagaagatggcctacttggatcaaaccctcgtgagtgaccccagtgtcacagagggtgacagagtaggcagtgggtgggagtggcatcacccccagggctgatacagccaggccttccccactgcgctggtgtctcctgccccctccggaagcttggatgcccctccacaccctcttgatcttccctgtgatgtcacctggacccctgctgctggcattggccacaaagcctcctggtctggctccaaagcctggcagggtcttttccccgggggagctgcaggcagggaacagtcctgatgggtcatccccttcactcccagcccagagcccccggccaggcacccccagggaaggctctggtggagaacctgtgcatgaaggccgtcaaccagtccataggtgagcctggctgcctccagctgggtggacagatgggggctggagaaggggagaacaggaaagaggggttgcctgccctgtttcctatataagtctgaggaaggggagggggtcgccatgggaatgtgctgtaggggaggcaggtgttgctcggagccccagcctctgttcctatgcaggcagggccatcaggcaccagaaggattttgccagcatagtgctcctggaccagcgatacgcccggccccctgtcctggccaagctgccggcctggatccgagccagtgtggaggtcaaagctacctttggccccgccattgctgctgtgcagaaggtcagtcctacc

SEQ ID NO: 10791 - DNA, 1616 bp, Homo sapiens
atatttattaagctccattatgtgcctgtcactgtgtgaaatgcttgaattacatcagcaaacaaaatacacacaaaagaattcctgccctttggaacttatattccagcagaaaaacacaagtaaaaataaataagggtggaggtataacaggttgcaataggttgacaaaactaagccttcttaggaaggtgacatttcagcaaccttttgaaagagatggaggaaccatgtgaaggaacctattccaggcagagaacaagtagaccaaagcctgaaggaggactcttcctggcttatttgaggaagagcaaggaggctgctgtaggtgaagcaaagtgaagatggagaagaagagtgataccatggggaatcaggaacggaggaaccttgagggtcagttaaagactttggctttgaccttcagtgcaatagggagactagatgagggaagttgtacgagaggaatgtcttgatgtgactttcattgtagaataatcatttaattgctatattgagactaggtaggggagggtggtcagactctggatattttgaaagctgagccaacagtattttatgtcaaattggataaaacgtctcagaggaatgtcaaaggtaagcctgtcttcttttgagccttggcaagaatgcatttgccgtccattgatatgagaaaggctatgggtataggaattccgcttacggaactatttcctgacaagttcctctcagaattgtcattttttattaaaaataaagtaagatctctacttgaaatgttttcaggcaaatcacctggccttaagagctggtatcttctacttaagcagattgagaatgcacgaaagtacagagaactgtatacataaaaaaatcatctcttgtatagaggtaataggtcctcagcattgctttgtcaagagaaagaagggctaatatgagggaggatatggaaaaatcatccgtatgaccctgtgaaagtacagtactatggaagtcgatgctatagaaattgatttccttgaaactgttagtgtcagtgtaaatttcagaaagtcaagggtgcagatacccagctggaaaccaccggactgacgattgttgtgcttaggataaggcactttgtgatgagttaggaaaacaacaatcagatatgtacacttcaaaattgacctcaggaaggtaagcagaaaaatagataaaatgggtgagaaaatttctttattatgtttcattgtgattgtctcacttttagcaagaaaggaaaagccagtggtagagtcatctaaatacgctgcttgcccaaaaagctgaattagatttaggagtaaatgtttttatttttctgaaggcataagaaattagacattgagtcaaacgttctgtgtctcattagaagccagccttgctcagtttgcaactatggaggaactggtaagagatatttttggatcatgttttctgttaaatacttagccccctgaggcaggtcggctacatagggttaaagctgaaatactaagaaggatcccattccaggggcatgagatgtgttttcatgtctaacatttgttgagggtgtgttctctgcctggaaccctgtgagacatttt

SEQ ID NO: 10792 - DNA, 1045 bp, Homo sapiens
ttcctggtagttgaaaccacaatgtttgttcttaatggtcctcaggcatctagagtatgccaggcccttccagtgctctcagatacatgagataaaatccagttcctcaggtagcagccagaaaagctggggtgctagttatttggtctgtctcctttgcttttcagagagaagctggaagccaggctttatcactgcactgagccaaagtggggagcagggggaagtgcccacatgcttattaaaaaccgctctgaaaatatttgaagtaacagggctataacaattattattttaaaagcaactgctgttttggtttgtgtagccccagaggtttagcagatgctgggccctgtcagctcaccaaaacagggaaattagaaaccagtctatctggtagtatctagagaagttgtgataccagataggtggtccaaacccttcactcctcagggatagactaagagatgggagttccttcccgatcatatggcattgtattagggttgggggttatgatcacagtgtgtgcaagttttttcctatcagttttgatgtggatagtttcacactcacctagggtacaggagtggctcagtcagtttctggatttccaatgatgggaatttgcctctgtgttgctgttgaattgatggtggggaaggagagtttagggccttctattctgccatctgtgactctgacagtttcttttaatgttaaactatcatacagtctagttactacatttgtagacatttctctcgcacaaatgacaacttatatttacacaaaagcctgtatataaaatgtgcataacagctttattcataatagtcaaaacttgtaaacaactgtatgtctcacaatgggtgaaaaattaagtaaattctgttataggcatacagtggattactactcagcaataaaaaggaatgggctattgatacatataacaacttccttgaatctcaaagtacttaggctaagtaagaaaagccaattactgaagatcgcattctgtgtgatttaatttacgtaacat

SEQ ID NO: 10793 - DNA, 1030 bp, Homo sapiens
tttcctaaggtgtaaacttagatcattaattttagatctttatttttttctaatagatgcattcaatactatcaatttctctttaaacaatgcttttactgcatcccacaaattttgttaagctgtattttcattttcatttagttgaagtattttaaaacttctattgtgatttcttccttgacccatatgttgtttagaaacgtattgtttaatctccacatgtttgtggagattagtgggattttaaaattttctttctgttattgactctagtttatttacattgtggtctgagagcagacgctgtatgatttctattttgttaaatttgttaggatatgttttggcccagaaggtggtctattatggtgattattccatgtaatcttgagagtgtgtattctgctgttgtttgacaaagtagtctatagatgtcaattatattcggttaattgatgatgttgctgagttcacctaagttctactgattttctgcctgctggatctgggcatttctttctttctttttttttttttttttttttattttgttgtttttgagacagagtctcgctctgtcacccagactggagtgcagtaatgcaatctcatctcatttcaaccactgcttcccgagttcaagcaatcctcccacctcagtctcctgagtagctgggaataccggcaaataccaccacacttggctcatttttgtctttttgtagagacagattttaccacattgctcaggttggtcttgaactcctgagatcaaataatccagccttttgggcctcccaaagtgctgagattacagtcatgagccaatataccctgctggatctgtgcatttccaatagagtgttgttgaaatctccaactatgataatgaattcatcgatttctccttgcagttctgttaatttttgcctcacgtagttaaatactctcttgttaggtgcgtgcacatttaggtttgttatgcggaaacataacatagtttcttggaaagctaattcttatacca

SEQ ID NO: 10794 - DNA, 1044 bp, Homo sapiens
cacttacattagtttggtgtcttttctttctctttctttctttctttctttctctttctttcgttcgttcgttcgttcgtttctttttgagacagaatctcactctattgcccaggctggagtgcagtggcgtgatcttggctcactacaacttttgtctcccaggttcaaatgattctcatgcctcagcctcccaaatagctgggattacaggtgcatgccatcacgcccagctaatttttgtattttttttaatagagagggggcttcatcatgttggccaagcctagtctcaaactcttggcctcaggtgatccgcctgcctcggcctcccaaagtactgggattacaggtgcttggcctggtggtgtcatttcttaaagttgacaaaaagcatatcctggggcctaaaaattctattctaggacaggtgccaagaatgtcatagtagcatacattccaaacttgataaaaccctggtgtcaaccgatagtataatagataaattggagaagagtcatacaaaggagtacaatacagaaacaaaagtaaccaaattatcaacaatttctctcagttttaaattatcttcttttgatatgtatgataatatagcacacctattctgtatgtattactaaacaatacaaaatcaaaaggaagaaaattatgagtagttaagaatatagcatagcagcaacatttctgggagaggatgggttatgttagattaatgaatatcatctctgtgttttctgaaagaatttcctgttgagatataaaggcccatctgatcactggattgggctgagcagagaacaaggccaaccatggaaatggataaatggtactgaatggacaagacagtaagttctaaaaatctggcagtaatatttgtatttgaatttactttgcattaaatctgaagtgttctctagttacatgctttaaaaaattctcattttaaggttagtcatgaaagaagatggtgccaacttgtatgttgcaaaggtttcacaagttcctcgaatgaatccaagacct

SEQ ID NO: 10795 - DNA, 1050 bp, Homo sapiens
gcttttttttttttttttttttttttttcagcgatggggtctcactatgttgcctgggctgatcttgaactcctgagctcaagcaatcctcccacctcggcctcccaaaatgttggaattacaggtgtgagccaccatgcctggcctctcaaaatattttaaggatcaaatatattattaactaaccagtttttggaaactgctcatcacttaaagaaatgtaaaatattatatgattaaggtctaacaagtttcaacaattagcaaattatatcatagatgatagtgattccaatgagcaaagaggaaaaatttataatccaaatgctgacctaaaatatctgtgccaagccatctaaactcagctaaatagcactgcagtttcagtactaaaaccaccagggaagtaggaggaataaaatcaagcatggtttttagaaatagctgctgagtcttcagttatttaaggaagcaaaatattgggaaactgtgtaaagaaaacgtgtcagacttctcccatcagccagctaaggctttggatgtacttgaaagaatattatgcttacagacatgaaataggtttgattcaggactttgcagtattcctatagttgatttataacatctcctgctaagcaaagcccactgactaattagtcaccactacacaaggaaaaacagcattatttttagaggctgaattaatgttagttttctcattttctcatcttcattctctctgctgttgaagaaatgttcagtggccaactgattctgcttcttctcttgcaggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaat

SEQ ID NO: 10796 - DNA, 1075 bp, Homo sapiens
agtgagaaataaattcagtgttcaatttagaatttgatactgtgttttgtggaaaaataaaacattttcttcagatatatgcaattttacttggtaaggaaatgaaaataaaatttcaaatctaatacatacatacacacattcacaagtgtgtataagtgtgtgtgtgtgtgtgtgtgcatatgtttaggcattccatgtggagatttctatatctatatatgtgttttactctggcatctttaatcttttggagttatatgattaataatgatactttgttttctttcataagagatgggaaatagaaagctcaagaaagagtgaggatgtcacttcaatgtaaaattgacaaaaaaataaaaagattatggtctgatgctatccctatttaaaaagacgatgtaatgatctctgttctgtaactgaacaatcggccactgtagggagaaaactattcttaaagagtttttgttttgttgtttgtttgtttttagacagaatcttgctccgctgccaaggctggagtgcactggttcaatctcggctcactgcaaactctgcctcccaagttcaagtgattctcctgtgtcagtttcgtaagtagctgggattacaggcatgtgccaccacatccggctaatttttttatttttagtagagatggtgtttcactacgttgccaggctggttataaactcctgacctaaagcaatacacccacctcggcctcccaaagtgctgggattacaggtgtgagccactgcacccggccccagctgagattttttaataactgctcttactaggttcagtctacattagagtctcgttctttttttctttctttcctctctctcttttttttttttttgacagtgttttgctcttgtcagccaggctggagtgcagtggcgcaatctcggctcactgcaacctccacctcctgggttcaagcaattctgctgcccctcagcctcaggagtagctggggttacaggcacttgccaccacatctggctaatttttgtatttttagtaaagatgagctttcaccatgttggccaagctggac

SEQ ID NO: 10797 - DNA, 1075 bp, Homo sapiens
tcaccatctccatggctttcaacaccaagcatatggacttagccactgtaaaatagtggcatgcatcaatgaacaataaagagaaatggagatcattcatattattagtgagggaagttgggtacaacttttcatcagccaaaaagagggagaaaaaaatcacaccaccaaataatgaaatactgtaactaagatcattggcagagaattagagattatgttcagcagattaaaaaaaaaaagaaaacagctgtgatcatgccactgcactccagccagggctgcagagcaagaccctgtctcaaaaaaacaaaaagccaaaaatacgagatgcttaaaaaaagaactgttgttcaagagatcattttcactttttaattggtttttgaaaactgtgaaagtatctcaaactgaagtctaaaaggaaaataatagaagcttcaaagttcaggggccaggttatatctatataaaagggaagctaacttatttccagaactgattcatttattaaacatggggctaaggaatagaggtggcaatatacaagtcaggataatgcctttgtcttctgaagctgcatctacattggtgcccctcaaaatagctaaaattgaaaatagtttatctgtcacctgggatttcttctacaaataaccttcccaaaaaaatattgcctaacatttttctgaatttatcaagccaaccatctgatcagttttctaaatgaagatttattcttggcaataatctagctcagggcctaggtcttgtacacagcattaagcaatgtaacagatgagtgcactggaagtatggatttgcagatggcctccttgtttctgtattttaattaaggaagtctctagctcaaaggacatgagattaagggcagcagcaaaccatgtgaactatcagagattcaacagagacaatcacgccctctgaaatatgtattgatccatgcatattttcactaggatgttttctttgagtaaagctaaggacaacatggcttgcgcacccaaaatatcttctcatcttaagttctaggcctaaggcagggctcaggcat

SEQ ID NO: 10798 - DNA, 1005 bp, Homo sapiens
atcaccagctgggatagtggcggcccaagccaccatcatgtctcacctagattattgtagaagcttccctactggcctcctgctgctgagctagcccctacagagtggtcccattcatatgcaggtcatatcatgtcagcaccctgcccaaaaccctccaagtggttccttgtatcactcagagtgaaatccaaagctctcattgctgtttgcaagatccagcatgatctgtccaccaccctctacctcagcccccatctgacctcctcaccaagcactctccccttcacccacccctcccctgccccactgcactccatgctgtttcccaagcattcagggcccctccagcctcagggccttggagggatcttccctctgactgaaatccatatagtcccaatctcagtgactctccaaacccaaggtctggagagctggattcagaaacaagatagcagtatacaaaactaagaaggctgtcatagcagattgtttttggctgagtctgcagagagaccagctggtgtgaagctctgtgaggactgcagagaacaaaaatcaataggtaatcgcttcttgtagcaattcagaataacaagttgtgggtcaggagtgccacctactgacaatatttttaagttgcagaaaaggattttaggaaaattaaactttccaaggatgaatctataaagctaaataagtgacaagataaactacctcaagtattaagaagccataagacaatttctcgtttaaaactataattggagccaggtacggtggctcatgcctgtaatcccagcactttgggaggccgaagcaggaggagcacttgaggccaggagttcaagaccagcctggccaacatggagaaaccccatctctacaaaaaatacaaaaattagctgggtgtgctgacacatgcctgtaatcccagctactcaggaggctgagtcacaaaaatctcttgaatccaggaggcataggttgcattgagctgag

SEQ ID NO: 10799 - DNA, 1036 bp, Homo sapiens
agcaagaccttttgcatattactttcttttttatcttccacagaaaccccaatgcttgactaagaggctgatatttgcagctgagtatattgaattctttcctcctacctggggaacaggcgccctctgtgtcctaaatgccacattcccattgtgctttgtgtcagatctaatagaccaatccctgcacaatcaggcaagccagagtcagtgaactggatttctactctgtgcctccagatcttgatgtctgctggcactttgctttgttcactcctttgggaaaagaataaaagggtagggcaggatgttgaataccatggaaagcagtgggtggtgcctggaagtgagaacagcttctttactacctatttctctgaaccttagcttcttcccttacgataaataaatgcatttagtacttaacagcttactagtggcttttatgggcagttttcttaaaatggagcataaaattcttaggtcacaaaattacatattaagaaacatagattatgtaaaaatgattgtaaacttttaaactatgtacaaatattagttatattaacagtcattaacacccaggtccaagaccaggaattaagtaataattatttctatcttctgtgagatcattggagcagaagtggttacaaattgataccttgcatttaaagattaagaacctatcagataaaacaaaacaccctattggactccttactttcccatcatcaaaagccagaagactagtacagacagactgctaatcactatttgggctcataagtaaaacataaagagtaacatgaaataatcctgtgttttttttttactctattaaaatgacagcaaattcttaggcaaactctacagtttccattcgttgaaattagaagaacctgcttggaagtaatgcaaaacttgggtttctaagtgaagaagcacatatgagccaaaaagctaaggggacatttagaacttggtaagaaatctctgtggctctagtgagagaccttcatggccttactacaag

SEQ ID NO: 10800 - DNA, 1043 bp, Homo sapiens
tccttacacttggaaagagggagggaaagaataactttacaatgaaaaagactttcaaacactgtctcctctgggtgatgaaggacaacatagaaagggacaagttatgttgatagtatatactcctgatgtgacatgatgaaaatggcacattaactttgcctctgaggtctttctaatcaaaaatcccataactccagtctaatcaagagaaaattatcagacacatcttcacaaagagacatgctgcaaaatacctgaccagtattctttaaaccatcaaggtcatcaaaagcaaggaaagtctgagaaactgtcacagccaagaggaacctaaggagacccaacatctaaataaaataaataaatccccatccaggatggggtcctgggacagaaaaatacatgaggcacgactaaaggaacctgaataagatatgaactttaattaataataatgtgacaattggttcattaattgtaacaaatataccatggtattgtaggataggagaaactgagtgcaagacacatgggaactccatgtgctagctccacaatttttctataaatttaaaattgttctaaaaataaagcttgtttaagaaaataaaaacagggggatggcagctagatgctaggctacagattatcaatgcataagattttaatccctaaatcattagtccctgcatcgttaggacttaacctgcatcagtttccagggcgaaggaaactcgatgaaaggaaacttcttacattcatatgccttgtcacactgtgagtcacactcaccaaatggtctctccaatttactgattatattaatactcctaaattactcatctataccttcacccacttaaaataattgggttttttattaaatacagtatgtatgttattttcttgggctgaaacaactcaattaaattaccactaactcaaaaggaaatcagaaatataaaaagtttcattctcggaatactgtctctgggagaaaaaggcgggttttctgtttttgctttattttagtttgtttt

SEQ ID NO: 10801 - DNA, 1126 bp, Homo sapiens
ttgaaattatatcaaatactctgtcagaccagagtggaataaaactggaaatcaactccaaagggaaccttcaaaaccacgcaattatgtggaaattaaataacctgctccagaatgatcattgggtcaacaatgaaatcaagatgtaagttaaaaattcttcaaaatgaatgacagtagtgacacaacctatcgaaacctctgggatacagcaaaggtgttgctaagaggaaagttcatagccctgaatgcctacatcaaaaagtctggaaaactttctaagtctttctaaacaatctaaggtcacaccacaaggaactagagaaacaagaacaaaccaaatccaaacccagcagaagaaaggaaataaccaagatcagagcagaactatatcaaattgaaaccaaaaaaaaaaagataaaagaaacaaaaagctggttctttgaaaagataaataaaattgatagaccattcacaagattaaccaagacaagaagagagaaaatccaaataacctcactaagaaacaaaacaagagatattacaactgacaccacagaaatacaaaagatcatttagggctactataacatctttatgcacataaactaggaaacttagaggagatgaataaattcctggaaacatacaaccctcctagcttaaatcaggaagaattagataccctgaacagaccaataacaagaagcaagattgaaatggtagtttcaaaattaccaacaacaaaaaaagtccaggaccagacagattcacagcagaattctaccagacattcaaagaagaattggtaccaattctattgatattattctacaagataaagaaagaggtaattttccctaaattattctctgaagccagtatcatcctaatactaggaaaggacataaccaaaaatgaaaacataggtgctaaaatccttaacaaaatactagctaactaaatccaacaacatatcaaaaagataacccaccatgatcaagtggtttcataccagggatgcagggatggtttaacttacacaagtcaatatgtaatacaccacacaaacagaattaaaaacaaaatcgaaagatcatcttgatagatacagaaaaggcatttg

SEQ ID NO: 10802 - DNA, 1416 bp, Homo sapiens
ttctagtgctctttatagttcctgtagtgatagagtttctgatatttattctgttatggtacattgacaacttctattccttcccattattttaacatgttgggaaaagtgcctgagttaaatgatacttttacaatggacgtaaaaacatcagtattaaaaaagaaacctgcacattgaggttgctgacttcaggtagaaaaagaaaattcggatttcatctagctctttgtctaacttgaaatgttataaaatgatgagaatctgcctaggcgaatctctacaatggcacagagcctgttcatgagcatctctggaaaagattgacaaccctcatgttcctcaagggactgaggaacatttcttcagagtctgattatgttcagttccaatggtctagtcactgtactttggttagttaatgctaaggttgattttatttccaacattaatcaataatgttgattttattttctaacgtactggctcacacttctactgtaactcatattgaactagcaatgaactgaaacagattttgcttaaactattactagtgtaatttttaaatctaatacaaaatttcaaacatggttgattatagttttgaactgagaggtttcaaatcctgattttgatatctaccaaatttaatagaactttcagctttatgtcctcaaattgataaattcattctctattttcaaaatcagttatgtgtctaatttaattttggcaagtcttaatgaaattatcataaaccttagtgattattttttttgctaaggtaccaaatcatttatttaataaataactctaaaatattatatgaatcacagcaacttatttatttaaacatttatgctttatgctttcacttatcacctagtatatatcaagaattgtacatgctgctaacagacaaaattgatgtgtcttctgtgttcaatgactcagtctattggtggaaaaaatgacccacattcacagtgtgatgtattctatagtagatacttgtatgtagtgtcattaaatagttatcaaaaatttatctatgttaattttaggctttttataaatctgaagtgtcaactgtgtgtatttcttcctcttacaaaagatttcatattacagaaaatgtaacatatttgtatttgatctcctgaatttgataattatgttagacttatataacagaatattcttgttcttaggaaatactgagatgttaaaagctaaagacatgatatatgcagctcacactcaaattgattagaaagatagtgtatgtatgagagagataggaaaagagagaaagagaaatttaaaaagcaaatgtgccaaattattaaaaatttgagtgaagtataaaaattgagagttctttgactattattgcaacttttctgcaagttt

SEQ ID NO: 10803 - DNA, 1020 bp, Homo sapiens
gcagatgactaacaaccaggcccaccccagccccactaatgcttgatagaattgtatgctacctcaggaagaaggcaggatggacgtaggagtgggagggctctgaaattactgggtttaccttgagttgactagactttaacataatacagcaagaaaaattgactaagatcagataaagaaaagtaaagaaagtgatatttttccacacacttggactcatggtctttggatttcatatccactgaataatcaaacaaataatggcaacaggtaaggtagaggtggacagggggctgaggaaccacagaacagtgagatctaggaggtattgcagggcaggcagaagagtggacacagactggaaggacagattttaaacaataaaattaatggaaagattttcatattggatgaacggaatatacaaagtattgaagttgagacaaagcacagaacccttgaagaatagaaagatttttttaatgtgggtggaacatggagtgagatgacggagtggtgagagatagattcaagtattaaaccagagttttgaattctaaagcctttacaaccaacttccagtttccaggaaatacaggggatggagtgtgaagttaactgacacacacacaaataaacaccaagcaaatctagaatgtgtgatagttctgaggacatgtcatccacttaatcagtaagttcattgcatgggaagaaaggagggtgaatgtcctttgccgaatataaaacataacaactaagtgtagggaaggttccaggtttgggggagactaaagttgatgtaatttcaattgttctgtttaagaaaaataatacaaaattaggaacagaaatttgctaaggcccttgcagggtcatggaaagggcctttgcaaatgaaagaatccaaaagttaagcttcaattgctgtgtagaaaattcaaaactgatcaaatgcaacatgtcaaccttgtgtggatcctaatttaaataatttgcattcattctacaaaagtg

SEQ ID NO: 10804 - DNA, 1047 bp, Homo sapiens
cacaattaaaagagctagagaagcaagagcaaataaattcaaaagctagcagaagacaagaaataactaagatcagagcagaactgaaggagatagagacacgaaaaactcttcaaaaaatcaatgaatccaggagctggttttttgaaaagattaacaaaataaatagagcactagccagactaataaagaagaaaagagagaagaatcaaatagacacaaaaaaagataaaggggatattaccactgtcccactgaaatacaaactatcatcagagaataccataaacacctctacacaaataaactagaaaatctagaagaaatggataaattcctggacacattcaccctcccaggactaagccaggaagaagtcaaatccctgaatagaccaatagcaagttctgaaattgaaggagtaattaataacatacaaacaaacaaaaaaaaaagcccaggaccagatggattcacagccgaattataccagaggtacaaagagctgctggtaccattccttctgaaactattccaaacaatagaaaaagaagtactccttcctaactcattttatgaggccagcatcatcctaataccaaaacctagaagagacacaacaaaaaaagaaaattttaggccaatatccctgatgaacatcagtgcaaaaatcctcaataaaatactggcaaactgaatccagcagcacatcaaaaagcttatccaccatgatcaagtcaacttcatccctgggatgcaaggctggtgcaacaaacagaaatcaataaacaacccatcacataaacagaacaaatgacaaaaaccaaatgattatctcaatagatgcagaaaaggcctttgatgaaattcaacacctcttcattctaaaaatactcaataaactaagtattgatggaacacatctcaaaatattaagaattacttatgaaaaacgcatagcaaatatcatacagaatgggcaaaactggtagcattctctttgaaaactggcacaagacaagaataccctttctctccactcctctt

SEQ ID NO: 10805 - DNA, 1048 bp, Homo sapiens
aggaaacaaattagggttgtaatgtgcaagcctaatgattttccatcagaactctcatataattgccctgtttgataagataaatgagcaggagcaaggttgtggtgaaggactctgctgaagctttcccagggattcctatactaaagctttggctttctcaaagtattctcagaataagcagttattgtcattctccagaaagtcaaccagcaaaatgacttgagctttccaataaactcttgccatgacctttgtgctctcctcatccacttttgttttgactggacttttccacttcttggtagccattgcattgattgtatttgttttcaggattttactggtaaagccatgcgttatctcctcttataattccttgaagaaatgcttacagtcttcattgctcctatttaaattttttagggaaacttctgctcttgtctgtacttcatcttggtgacacagtttgggcatccatcaagtgaaaagtttactaaactttaatcattcagttagaatcatgtaaactgaaccaactgagaagtctgcaatgttggctattgtgtgaactgctaatcatcacacatcttctcctgggtataaagaagatgaatttattccttgcaatatgatgtgaatcatctgtcactgtagactttaggttcaacattgcctcattccttcctgaaatgaggaactcctcattgaatttgtgaactgctgacttcttcaaccaatgtcaacttaccatgtgccaagtaggacaactttttggacaccatcaatgatttcatcttcttccacccaagcttcaccataaatttgatgtttttactcactttacttttagaagaattcatgttgctcttctaggagctcttttgaaactgctctcttatttttcttgatgcctcaaactagctcgtgttcagacatgttatagcaaaacattatgatttcattttggtgccaaaaaacttggaatccattcatggtatttcttaatagaatatacattttccattaacattttaacaacccactg

SEQ ID NO: 10806 - DNA, 1047 bp, Homo sapiens
aaacagaggttaccaaagaactgaaggagacagtgtcacttaggatgaggtcaaagcaaggagcaggactgcaacaggagcttaggcacttgtccatgagtcaaggacctcagtaatccacttgccatttaaaacaaatgtaaatttaccatgtgccaagcaggactcttgatttctactcctaaaacctgctctcccctgaatttcttcatcatagccgtcaaaacaaaatatcacagactaggtattcttaagcaatagaaattactttccaacacttctggatgctcaagttccatgaggaaggtgtcagcaggtttagttcttctgggctgtgtctgcttggcatctaggtatctgccttcttgctgtgtccttccatggatgtgtatgtacttcctgtgtctctctctacaaatttccagttcttataaggaatttccacttcttataaggacagcaatcttattggatttagttccactgaaactccatcatttcagcttgataacctcttcctagggctgttttctaaacacaatcatattctaagggacaagaagttggttgtggatttttgtatacctatgcctatcatattttgctaaatatttgattatatagagattatttctttggaactttgagctgtgtgaagacaacacaaacctggccattcatggctgacagaaggttggccctcagcctggtcagacccacacagattgtctaatattctttgatctggctctagtcagaaaagtcttggtgttgtagaatacaggtgtcttcacgcattgtattattaatattcatggggaggttaaaacaaagttggccccgaaaactaccaaggggttctagaatgaacagaatgaatacacagttcttaaaggggacatcctattttgtctttaaatttttttccttgctctacccctttgttagaatgtttgatcagattcagtttgggatttacatcttttaggaaattttgttttttaatatagattctcgctctgtcacccaggctggagtgtggtgtca

SEQ ID NO: 10807 - DNA, 1073 bp, Homo sapiens
gtccttattgtggaatgagggcacaacaggtctcctgatcctaggcatgaaaactctgcagccccatctgtgttttcattctcctctcttccccataattaccactgtcacctcctaagtcccaagcagtcaccgcatcttttcccccttctgttttaccttcacttgaactctcagctgagctcagggccagcagggccactgacagcagaatcagcagcatctcgctggaggctctggagtcactcccaactctgtgctgggaggaacgtggcaactccctttataaagaggagcaaaacaatggcacctttgagccctgggtgggcctcaccacctcagagactgggttctgctttccttactgcaggtcaggtgtatcccttatttctctttgggactctagcccagagggatggggtgggttggatgttgtttgtgccttatttctaaaaggtacgactatgacttgaataaaggttctaaaggaactgtgtccaagctatcagcactgtgtcataattgaacttcagacatcattagagtttcaatccttttggtaagactatgtctgctttccactctactatttatttctgtgtaatatttgtgggggcagtgaagctacagccagcagtgaagatggtcaatttctctggctctttatagagcctatttccatctcttgtgatgtgtgtgtacagatagtatcacaattggctaaagttttgatgcgatagagatggtttctgttacctgtgtgatggtgtgaagacaacacactcctgggcacacatagatgacagaaagctgccccacagcctgctcgggctacaactattgttcaagcttctgtggatctgactcagctcaggcaaggcttgttgttgtgccacacaggaaggccaaaattgtgtattttaaagtacctttaggggttattaatgcaaaatgtacacagaaaccataaggaaatttctagatctgagaaaactgaatacataattccttgcgggagccatgcgatatcatgttgccaaaacttccttcatgctcttccctttgtccagaat

SEQ ID NO: 10808 - DNA, 1050 bp, Homo sapiens
agctattcaggaggctgaggtgggaggatggcttgagcacaggagtttgaggctacggtgagccatgattgggccactgcactccagtttgggtaacagagcaagactatgtctttttattaaaaaaaaaaagaaaagaaaaaaacaacaaacagttaagggcagcagacagtcaagtgaggtatccaagtaagctaaagaagaatgtattcacgagcccattttctctttatctctctttgatttaagagtctttgattgtaggtgtgtggtcttatttctgggctctctattctgttctagtggtttatttgtctgtttttgtatcagtaccgtgctgttttggttactgtagccctgtagcatagtttgaagttgggtagtgtgatgcctccagctttgttctttttgcttaggattgccttggctattcaggcccttctttggttccacatgaattgtaaaagtttttttctagttctgtgaagaatgtcaatggtagtttaaaaggaagagcatcaaatctataaattgctctggacagtataactactttaacaatatttattcttcctatccacgagcatggaatgtttttccatttgtgtcctctctgatttcctttagcagtgttttgtagttctccttgtagagatctttcacttccctggttagctgtattcctaagtgttttattatttttgtggcaattgtgaatgggattgcattcctgatttggctcttggtttgactgttgttgatgtataagaatgctagtgatttttgcgcattgattttgtatcctgagactttgctgaagttgttcacagcttaagaagcttttgggctgagactatggaattttctagatataggatcatgttatctgcagacaggaatagtttgatttcctcccttcctatttggatatgctttatttctttctcttgcctgattgccctggccaggacttccaatattacattgaataggtgtaatgacagagggcatccttgtcttgtgctggttttcaagaggaacacttctagt

SEQ ID NO: 10809 - DNA, 1050 bp, Homo sapiens
tgactcccaaagcactgggattacaggcgtgagccaccttgcccagccatgttcattatcttgattgtgtcagttgcctctttggtgtaaaataggtcgaaatttactatgttgtacactttaaaaatctattaataggttaaataacatgaaataattgttttttaattcctaatatttgcctagggaatacaaccaacctcttcatcacatgaagacatttttttcatgcttttccatgttcctgaaatgccctcccctaggagcttcctccaatttatctactctttcacattcaagaaggtaatggagttccatcttcctccattaactcccccatactgaaatctgctatatctttcattcatttgaatcttattgttacagtacatacgatggaaatctataatatttttattgctatagttatcatttcagttgttatgttttctgcttatttttgtatcagagttgaatcaagatgtttaagtctctggagagttaagtattttgtaggaggaagaatatcaaggttgtggaaaaaaaaaaaaaaaaaccttgttgtggctgagaaactgggctggagtcaggaggctggtgatggccccagttctaccactaactagccatgtgcctacgatgcttcatttcacctcttgagatctaaatttccccgtacgtcaaagcaaaggtgaggtcaatgtcatctatgaaatgttcttgactttcaaattatttgagtagtggccgctagatggaacccgtgaacccatatccatacatgagcatttcaaggagaggtggtgctgaagcaggaagccaaaaagccagggtgacagattatcctgtgcttcgtgcaacaaggatagtctgtaggaacaacaacaagagaagttgtctctctcagacaatggtgtcctagcctagacatgtgggctaggaaattagtgatcagaggaaatcagaccaaagccaaagtcagagacattttctgttctcctcttcactaaaccccaaggctctttagcatgaagtatgcagaccctgtgt

SEQ ID NO: 10810 - DNA, 1074 bp, Homo sapiens
tggcagatccctgatctgtgattcagaaagagtcattcagacaggcattgcccagagtctgggttctctctctcctgaagttgttgaggctgtgcagaatgtatgtgtttagtgtttcatccagtctgttagggtaatcagtgtgatttctctggcatctccaggactggaagcagaccagatttaatcaaagctgttgaagctgcccagggactggctaagctgccaccctgttagtgaggccgctggggagagggaaactgaagcctgcaccacggggagccgtatactggagtctggaatccatttgctccacgcaggaggcctgcatctcaagtcaggaggcactgcctggaaatctagcatcatgttgatactctttggtgaaggaaatgtggtccttgccccaagttatctcacagtccctttgggcaatctcatgcatattaaaaataccgacaaacatagacccacgaaagatcctgatcttttaggtctgtcatgtgatagagacagtaagtgctctgtatagacatcaggagattttcttccctgaaggacaagctcttgtagcattttcctgcactgagatgcagtcatgctagcctgtctttcactcaccagggatggcaaggaaggaccagctgacaagtaataaagcaaaccagtttgtaattttacagggctctgaataaagatgcatttatctctggccaacaccaagaggcctcgatgtctctcacagggaggaacttgatgggctgtggcgtcttttgggggtgctagggcagagtcaggcttgaatctgagaaaggcaagtctgtgcattaaaatccagcacgggggtgggtctggggcaagggacaagagagaagcgggaatggaaggcagggatgaggactggtaacagaccctctgcctccttccttcctcttccctcacactggctctttcagccacttccctcactgagataggaagcggtcctgtggtgacgccaagggcacaggcttctgctgtctgggctccggcacagtcattggctctgagtcatccgggaaggaaaggcatctt

SEQ ID NO: 10811 - DNA, 1042 bp, Homo sapiens
ctctagggtggcctgcccacacatttccttgggatgccattgggtaaatatctccaggtcttttgtctttggctgcttagattcccaagagatggttgactcttctagtagccatcctggagggtagattctagctgccaacctcctaggagcacagtgggagaagaaggggtagggggcacagtgagcacagtggtcaacatatgcatgttcttttaatctttcatataatttccgttaattccacctagtcattttggtaccagaggataaacttttttttttttttttttttgagacagagtatctgttgcccatgctggagggcagtaacataatcttggctcactgcaaccttcacctcctggattcaagcgattctcctgcctcagcctccctagtagctgggatcacaggcgcgcgccaccacacccggctaatttttgtatttttagtagagacgggctttcaccatgttggccagcatgtgggtctggaacccctgacctcaagtgatctgcccaccttggcctcccaaagtgctgggattgcagctgtgagccattgcgcccggccagagcttaagcttctaatctgccatggtaggggaggagccgtgactcgactgtccagattttcacatgtaactagtgacaccagtccccaatcctttcacggattctgccatgtgaatttggttatatcacatctttccttactatgagtttagaattccgctttcttgggtttgctaagtaaattaccaccggttcttctgctttcaagtttctggtttgtttttctttctttttctcccctccctccacccccttatctcttctggtgtctttgtccttgtagatttgtgccttcttaaaaatctcttcactgttactttagaggatttgggggaacgagaacagagctaaaattaacttcctcctctgatgaatgttgacagtcttcctgccatagggatgttgtccaaaatacgtgttcatgtgtatgtcaaactagagcttctcaggaggaaagctctttg

SEQ ID NO: 10812 - DNA, 1072 bp, Homo sapiens
cctgcggagaggacttgattaaacaaggtataatgtacttctctttcccatccacagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgctgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagtttttttttttttttaattgagagtatatagtccagtccaggtaccggaataaaaatatggagacaaggggaaaatattttacgaagctctgtgttctcaacgccctcatgaacttttcagtaggctgtctggtttatgtgtggtcaacttgaaaaactaattgaatctaggtctctgtattgttcctgtttctaccctgactgtttccgtcacaccaagcccttatctggggcgcgtcttcctgcccaggtggaacactggcattttgttgactgtcaggttaggtgtcccttagtcgtcatcagaagctgaagccttcctttccacaccctcatcagattcatctccactgataaccggtttccttgatgcagacatagtttagctttctttgactgcagagatgtctcattccacagacatttcttgaacccatttgatgtgtccaatattgtgccagggatacaaatatggccgtatagcctcaggcct

SEQ ID NO: 10813 - DNA, 1047 bp, Homo sapiens
tgtgagggctgccagtgcgctgtcacctctcactaatttccccttagtttattttttgtttaaaatggagtttcgctcttgttgcccaggctggagtgcaatggcgaaatcttggctcactgtaacctccacctcctaggttcaagcaattctcgtgcctcagcctcccaagtagctgggatgacaggcacccacacctggctaatttttgtatttttagtagagaagggatttcaccaggtaggcccggttggtctcaaactcctgacctcaggtaatccacctgccttggcctcccaaagtgctgggattacaagcgtgagccaccgcccccagcctcccctcttagtttaattcctggtctaattgtagttgtcacatccaaaccagtcctccaacaatagcctgctgaggctggtcatgaaggggctccgagcactgtcagcaactggcctgaacttcaggctctcccaagatctgcatcttctcattggaagcctctcactgaaacaactgttcctcctgttaccctctatctctggaggctgatttattctaattccctttattcctctatctcacttccacctctttttctgcagggtcctggccaagatagctcttctagtctagctcacccggcccaatctttcttataaattttcttaaatgtaacttcaactcaaccaacttcaaggtcacctgtgattctttctgtagtcaatattccatctgtttgcactgaagctttattccttcaatgcctaatttttatgaaactgatgagactaagtttctagtctcataagtcatcaaatctagtgtcatgagcagagaggttgttgagatgtatgtggcaaggacaaaggacagctcttcaacaattgcccttcctgtttttcctgtaggaatcgtaacatcatttacatgttatatcgaaatgggccatgtgtgtgtagctggccttttttttcctaccatgtacttgtgtgttctggaatcagtcagctagaaaatatttaccaagtgtcttaggctttttcactg

SEQ ID NO: 10814 - DNA, 1027 bp, Homo sapiens
gagcctcactgcgactcttcaggagataggaagaaagtggggagacagagcagtatgctcattctaagattgggtctctagcagaagcctgcacaatgaaaaagtataccatattcttggatgggaacacccaacatgacaaagatggcagtcctccctaattcatctgcacctctttacactaaattctgataataggttctgatcatcctgtttcgttcctttgttgtagcagtctgtccactcaggaccataatataattactgtaaatttggaatatgtttgaattgctggtgggccgagtcctccacatctcgatgggtccctttactcctttttttcccccagaatgttcctgttttcttttgcttgccattttccccatgtggatttaaaatgaatttgtctagttttaaatataattctgtcggcattaaaaaaaaaaataaagtgggattcttatctcacacatcaggataaattcctgaagaattaaagaggatgaagtagaaagaaatgaaaccatagacatgcaaggagaaacctcaaaggatttttaaaaaaatctcagagttggggaaagactttctgagtacgacaataaacatagaattcataagatgtaatttttttttctttttggtagagacaggatctctctacgttgcctaggctggtcttgaacgcctggcctcaagtgatactcctgccttggtctccaaaagtgttgagattacagttgtgagccactgtgctcagctgggaggagctcttgcggccaggattttaagaccagcttggacaacgtagcaagacctgtttctaaaaaataaaaataaatagttaagctattctggaggctgaggcaaggggattgctctatcccaggagttcagggccgcagctcaggctacagtgagctatgattttactactgcactccagcctggcagctctaaaaaaataaaataataataataataatataaaaataatttaaaaagcaatggtttaaatggtaatttg

SEQ ID NO: 10815 - DNA, 1034 bp, Homo sapiens
actttgagaggctgaggagggaacatcgcttgaggccagcagtttgagaccagcctgggaaacatagtgagacctttgtctctcaaaaaaaaaaaaaaaaaaaaattagccaagcatggtggcacacacctgtggtcctagctactcgggaggctgaggtgggaggatcgtttgagcccaggagttcaaggctgcagtgagccatgatcagccactgcactccagtctgggcgacagagtgaggccctctctcaaaaaaacaaaaaatgaagttattgttattaaaacagtgtgatataagtgcaagaatagataattagacatttggaacagaatagggagctcagaaacagactcactcatatatgaaaactttatttgtataaaatcaacactccatacctgtaggaaaaagatacattagtctatcagtagtgctgggacaattcgttatatataatgagatccctagctcacttcatataacaaaaacaaatttcacagaaggattcaaaatgaacagcaatttttagcaaaaaaaaaggataatatttttatggtcttgcgtagggcaaaaggaagccctatacccaaaccgtaaaggaaaagattgataatttcagttatattaagatgaaaaaatgtctgcttattaaaaggcatcataaaaagtgagaagttacaatctgaaagaagatattggtaacaaatataacccacaataattagtatccagattatatgaagaactccaaactgcaacatcagctgggcgtggtggctcacccttgtaatcccagcactttccaaggccaaggcaggtggattgcttaagctcaggagttcaggaccagcctggacaacatggagaaacttcatctctaccaaaaatacaaaaaattagctggacgtggtggcacatgcctgtgtctcagctactccagaggctgagatgggaggatcacttgaggccaagaggtggaggttgcagtgagccgaaattgcgccactgcgctctaaccagggcaaaagag

SEQ ID NO: 10816 - DNA, 1090 bp, Homo sapiens
gcatatatgaattgccagagtcactattcttgtactttggggccattaggaagtaaaatagggtgacttgaatacaagcactgtgatatcgtcacagccaatctgataaccaagaaggttactaagtgactaatgggcagggagcgcctacagtgtggttcagctggacaaaaggaggactcacatcctgtgcgggagggagcaggatggcacgagatttcatcacgctactcaaatggcatgcaatttaaaacttatgaattgtttatttctggaattgtccatttaatattttcagactgtggttgaccgaatgtaactgaaacaacgaaaagggaaaccatagagaaaggggagctgctatagttgttttttttaaaccattatgaacacatggatttaaatatctttgaagggtttcattctatcgtaattattatccttaatgaagctcaagttgtcccatcttggccaaaattgcctcttgtgtccccttggcagaactgtagttgtctttgttagcttccttgctatcttgtatgacaagatgctataaagtatatcactgacttttggtaggatgtgatattgacttaggaatagacaaatatgttgatggaaataaggaatgggataattcataaggttatgcaatagatatctgtttttgttgttgttgttgttgctgctgccggcatttatcgcacttcctacaaggacagtttcacaaaatttatttgagatattactcttcattcatttagccttattgaagtgtgttgaagggactgaccccgtctgcagctcgggctgccttgacgtcagtatatccagttaccctgttgggagtgactagtttataaatgggcatggccagagccaacgggagatgagaagacattcactgggacttctaggaaagacattaggataattggccttccatttggaggaagatgctaaatttctacttcttaccattggcaaatattaatagaagtgaaattaaaaccctagaagagtctatgattattagaagaggcagaaaggcaaaaagccatattgatagattgataatttgattacatga

SEQ ID NO: 10817 - DNA, 1032 bp, Homo sapiens
ttgcatcactgtactccagcctaggtgacagaccgtgtctgttaaataaataaatgaaaagtaggagaaaagattataaaaatcagaggagaaatcaatgaaattaaaaataggaaatcaaaatctggttctttgaaatgattaataaaatcaatgaacctcttcccgacttaatacttcctataaagctacaataatcaagacagtgtggtattggtgaaagactagaaaaacagaccgatagaatagaatggagagccccaaagtgaacccacataaatatagacaattgacctttgacaaaggagcaaaagcaagacaatggcgcaaagatagtctttcaacaaatggtgctggaaacctgacatccacatgcagaaaaaaatgagtctagacacagatcttacactcttcacaaaaatcaacctaaaatgggtcacagacctaagagtaaaacataaaactataaaattcctagaagataacaggaaaaaaatctagatgaccctggacttggtgattacttttcagatacaacatcaaaggcacaatccatgaaagaaagaattggtaaactggactttattaaaattaaaaaatgttactctgcaaaagacactgtgaattgaatgaaaaggcaagccacagactggaagaaaatatttgcaaaagacatatttgataaaggactgttatccaaaatatacaaagaactcttaaaactcaacaataagaagaaaaagaacctggacgggtgtggtggctcatacctgtaatcctagcactttgggaggccgaagagggtgaatcactttgggtcaggagtttgagaccagcctggccaacatggtgaaaccccgtctctaccaaaaactacaaaaattatctgggtatggtggtgtgtgcttgtaatcccagctactcgggaggctgaggcaggagaatggcttgaacccagaaggcagaggttgcagtgagctaagatcacactgctgcactctggcctgggtgacacagcgagactctaactcc

SEQ ID NO: 10818 - DNA, 1024 bp, Homo sapiens
agtgctgggattacaggagccagccagtgtgcctagctcctacccctttaatgttgggttggccacaacttgattggccaatagaatgccagtggatgtgatggctaccctgtctgagcagccttaggaatgattagtcaattttgcttccaaaacatattctgtactttatccactccattgcatcctaccaacattagccaaatctgagataatctctgtcaactacttcaataaccttctaactgtctcctggctttagttgtgtacctctgagaaccatccttcacacaactgtcacacaacaatgtcaaattaaccttgtaaggccacagatgaaagccttcaatggctccctctttcccacatggcactggaaagctgtcatgacttgtcttctacctaccccttaagcctcatcctttggccttccctgcttcccactttatgttcagcaacactaaacaccctggacactcctccattcctttgtccattctgttcctttgtccagactgccctcctctctctcctaatttttgtccaaataacttctgtttgactctcaagattcagctcaatatcagtgctcccagaaagtcttccctagtacttcctgggcatgtatttgccctgtgctttcttggtaccagcacacaccccggcacttccccaccttaaatttaaatgatatattctgtctttttctcttccaatagatttgccgtctcctggagggcagggactatatcttatttagcttttggtccccagactctagcctgatgtctggcacacagtaggtgttcaatacacattagtggagctgaaatcgaacaaattaaacattaatataagcaaattctgaaagccttctgcctctattcttacaaaagctggtggcattataaatgggttcttctggaaagcaatatagcactatataacaaaaacgatgaagatggtcattctccttgacttggtattttcccgtttgtgaatactcctcaaagaaataatccaa

SEQ ID NO: 10819 - DNA, 1090 bp, Homo sapiens
acctttatttctcagataggtagatgctgttgcaattcattgttacctaccctgccactgggaacattaaaataagtagatgagtgagacattttatccctggattgtcatttgtctgtaatctttaaaaaaatcagtccattggctgggcgtggtggctcacgcctgtaatcctagcattttgggaggccgaggcgggtggatcacgaggtcaggagatcgagaccatcccagctaacacggtgaaaccccgtctctactaaaaatacaaaaaattagcagggcgtggtgacgggcacctgtagtcccagctactcgggaggctgaggcaggggaatggcatgaacccaggaggcggagcttgcagtgagccgagatctcgccactgcaccccagcctgggtgacagagcaagactctgtctaaaaaaaaaaaaaatcagtcccattgtctggtttgacttgtatttcacatctgtgcatatgcttttgaatggaaaacactgatgttaatgaaaagaaggctaaagaatagaattcactaggatacactgtatgttagtcctttttcacactgctgatacagacacacccgagactgggaagaaaaagaggtttaattggacttacagttctgtgtgtggctgtggaggccccagaatcatggcaggaggcgaaaggcacttattacgtggtggcggcaagagaaaatgagagacatgcaaaagcagaaacccctgataaaaccatcagatctcatgagatttattcactaccatgagaacagtattggggaaaccacctccatgattcaaattatctcccactgggtccttcccacaacatgtggaaattatgggagtacgactcaagatgagattgggtggggacacagccaaaccatatcacactgttgtctgatctggcatggcagatcctggtttaactgattaatgtttaagaggtggatcttacaggtctgttctacttgatcagtgacattgaacgccactgatcactcttctttcttgaagctgccttcctccttaatttcaagacagcattttcttctgtctttctagctgttctttc

SEQ ID NO: 10820 - DNA, 1084 bp, Homo sapiens
cgagcagctctgaagaatcctgtgaaatgtgccgtttcctctaaataccagacagttgaaaaattacagcaatattatatttttattccctctaaattcaaggtaaaatgtttactttgatcattcctgcctctccctcttcttttcaccaaagcatctgaaaatgtgtcaactcttgattaggtaagagctgtaatgcagattggcatcctgtctgtttgctttagagtgcatatcgtgcttatattatcaccgataagccagacatgccaggaattcacaacacattaaatcacaatactgaggtcatgatgtaatcatataattccttcccatccccatccttgaggtaatttttcctttgtctgcttattatgtggcttttatttaggatgaagcccctggttttgtgctttgatataaggacttctcctgtttgctgagtacagatctcctgcctgccttaaggctaagtggggaatatgtggttcacagagatgataatgctggttaaggaatgcaaagctggcagctggaggtctggataattgaaaagcgactataggcttagtctttaccttatgtatatgccaggtctccaatcctgtctcccaggttcaatgacatatattgttttgggtttgtaacttaggatacctacctggtttatattctaaatgaattggctggaaactcctttatgatattctgcagcacctgtaataatacccagagaacagctttgctactgcgaaatcttggcttcactgccatccccctccatggacaaatgagtcaggtaaggattcatcatcatcatcagccatgcactggtggcgtgagcgagataaacctcctaacagtaggtttgtacaataaggccatagggcaccgatgcctgtttccataattgttgtaattttatgggctttgaagtgttgctctagatacttactttctcctttcagggtagcgagaggctcccattagaatatttcatatgtacctgtctggtttgcaagctgttgagttgatttattcagccctagtggtaataatgactctggcctctaaaaacattaat

SEQ ID NO: 10821 - DNA, 1034 bp, Homo sapiens
gcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattatttttaaaagattctaactccttaaagaccttggtgttaaagggccttatagatttaagtaagatcttgttaataggtaagaacctgacagtgttgattacatggcaaattcattggttgtcctaattaagataaatatttattacttaaaaaaatcaacaaggaaacgagatgatggatggctttgaaagggaagccccagccgggtgtggtggctcacgcctgtaatcccagcactttgggaggccaagatgggcagatcaggaggtcaggagattgagaccatccttggtaacaccgtgaaaccctgtctctactaaaaatacacacacaaaaaaaacattagcctggcgtggtggcgggcgcctgtagtcccagctactcgggaggctgaggcaggggaatggtgtgaacccgggaggcagagcttgcagtgaacctagatcgcgccattgcacactccagcctgggcaacagcgagactctgtctcaaaaaa

SEQ ID NO: 10822 - DNA, 1047 bp, Homo sapiens
gcccgatctcgtctgatctcggaagctaagcagggtcgggcctggttagtacttggatgggagaaaatgttcacttgcgtttttccttgtctccttcttgccctttcttcttccctccacccaaaatactatttttagtttttgcattaggtacaagttgtttttatatagctctttttggctcccctgtaattggggtcctgagactgctgtcctgtttgggctactgtgttatgttcctgtagttaacatccccactgttttctttgtttgtttttttgtttgtttgtttgtttttttgagacggagttttgctcttcttgcccaggctggagtgcaattgtgtgatctcggctcaccgcaacctccgcctcctgggttcaagcaattctcctgcctcaacctcccgagtagctgggattacaggcatgcaccacaatgcccagctaattttgtatttttagtagagacagggtttctccatgttggtcaggctggtctggaactcccgacctcaggtgatcgcctgccttggcctcccaaagtgctgggattacaggcatgagccactgcgtctggccccaacatccccactgttttcatgtgtgaggaagtcaggttggagtggtggctgagagcatgagacaggctcgggttcaaatccagtctttacctaattagttacttaatctctttaagctttagtttcctcatctgtaacaataacattattatggaacattcactctatgccacacattctactacatatttacctcctagggttatctgaaatagtaaaggagatggatgtacttaggaggtctagtaacctctgacatatgttaattagtcagtaagtgttagctgttgtcatcagcagtgtgctcatttatgaatgtgatacctgaaggaaggcttgatgtaatagtgagctattgacagatctcagcagtcttgttatgaaagagcagtttcgctaagctcaagaaggaaagatgtttggctcacatgcataaaatgaggttaattagtagcagaaggcca

SEQ ID NO: 10823 - DNA, 1052 bp, Homo sapiens
tgttaagtcgtgaagaatgtggagcccaaagagggctaggtgatttctttctgggtttcacattcttctgtgtctcttctcttggcaactttgtgaacttcagttttaatcggaccttatttccgcccacagataagctgcatagccatagttatagctaaatagaatgtctttattaaaatctgatcccgatgcaagctgatttgttattttatttttaaatcagagggccagctttcaattaacattttctttccttctggtttcaggtctggttggtttccaatacggtagatgcatcagtaggtctttggaaaaactgtaccaacattagctgcagtgacagcctgtcatatgccagtgaaggtatatataaagatattgacccagtgctgacaataggtgtggtcagggaatgttcagcccctggagtgacctcatgcccttgttctcctcgtcctgtgtctacagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctgtgagtatctcatgggtagactccagtttacacttttaagtccatcttaccatgggtgtttctggcaacttgaacagattagcacatggttcagtgaaacttccttgtgcaattttctcctctggttatttgttctcttgtggagaaccttggattgctgcttaggttaagaaccctcatctgcttcattgttcaaaaccagtgctcctgggtagctaccaagtggcagtgcatatctgttagtagcacgtgtgtacaagacacttcaagaaggcagaaaggtaggagttctcagaaagatgaaaccactgccacaatgcacatcattattgtgattctcacttaattgttgttctttcccaatatactcggtttggtggaaggacatgctcttttgcatccctgagtagctttcctagacccacaagggccagacagga

SEQ ID NO: 10824 - DNA, 1014 bp, Homo sapiens
gactctagtgtttaaaaatatgtgtatttcaaaacattttatataatgtcgaaaaactgtccatgttgaaattattgagcagtttatgctggtcttgagtgggatcttagggaaattttaataacccagtctttttgccttctattgctaactgtaatatttgccgctaccctctacaagattattacctgtacatgaggaaatactaatgccctatggttactcaggatattattgctaattctttccctgctgtgttgcatttttgcaactgtaagcataaattaccccttaatgagatgattgcttttgggattggtgatagttctcaaattttctgttccaagttccagttagctattatgctgggtaattgagggcataataaatctgggagctgaataattgaagttttatgatgttattttgtcacttttaaaaattctccccttttgtttaccctttttcatgaacaatttcatctgcataagcctctaagagaaatgttagggtggtggcactggccaagggtccaaacctgaatttgaatactgtttttgctacctttttctgacattgacgagcttattccattttctttctttcctttcattctttcttttttttttttttttgagacggagtttcactcttatggcacaggctggagtgcgatgatgcttcctcggctcactgcaccctctgcctcctgggttcaagccattctcctgtctcagcctgcctcctgggttcaagccattctcctgtctcagcctcccgagtagctgggattacaggcatgtgccaccatgcctggctaatttttatatttttagtagaggtgaagtttcttcctgttggttaggctggtctcgaactcctgacctcaggtgatctgcccgccttggcctcccaaattgctgggattacaggcgtgagccactgtgccctgctaattttttttttttcaagacggagtctcactctgtcgctgaggctggagtgtagtggtga

SEQ ID NO: 10825 - DNA, 1025 bp, Homo sapiens
ctgtagaattccacagtgaaaataacttttcccatgaattttgaggatattgttttttttttagctttcagtattgctgatgacaagtctgatgccagtttaattctttctcttctgtagttaaatgatattctaagttattaatatttccctataatgattttctgaaatcttattgcagtatgcctaggtgtcaaaaaattttattttgcttattttaatttagtttgttttgggattcaatagacctttattattggaaaacttgtatattttttcagctttgctgattttttttaattttcttattttttccctcctttttttcttgtttctttttttttagaaacttgacttaattgaaagttgttgcttctgggtatatttcttatgtgtttgtttgttcttgtgagtgtaatatcttctcatacacttagaggattttttaatatactattttaaaatgtcttctgtttattctcctactaattagctagtgttttttgtgggatttggcacctgaccttttgtttgaattcttgaatgtattcatttttgtatttgagatttcctgttttactttggctggatgctgatggttcaggtgattgtgagtggtggggaagtggtacttgctacacatgggatatgctgataatttgtctttgggatggtagcctccatgtctctccggggacatagtgtctatataagttactaccctagctgcattcacaaatgtgactgctgccctggtttagcactagcatggaagagagaatgtctgatgaacttaactgttcaaataccaattacatgagtgaattttcatgtgatgattcacactggcgtatcaggtctaaattgaaagtctgtatttgtatcgccttgtctctgtgtaagtgaggtacttttaactagtttgacatttatccttttagtctttaaaatatcacttgcatgcctgtatacatgtttagatttttgtgtgttttaaaatataatggcataaaacaggaaacatt

SEQ ID NO: 10826 - DNA, 1079 bp, Homo sapiens
aggcctcctccacgtgcttttttttcttaaacataagatttttgaagagaaaaatctgttttagagtgaactagattttttttgcattaaacactgacatagtttccttgcagattttatttcagattaaaataaaaatctgtggttgatattttcctccccttgttcattggatctttaaggtaaataaaataaacataaactgatgctaatgaggataattacattagactagaatttgagacttccttctatttttgctgtaggttagtattgatagaattggcatgatttagtcaatttactgttaatttgttgtcactgtttattgtgttcagttaaaattctttatcatctcaatccatttatatttagctgttacttatgtacttggcttctctttgtggagcttcttagttctattcactagtgtgcaagttgcagatttttcttttcagagttgaggaagaccaaagatgaagtagattttggaaggaggtgtataggaggaagatcatttttcaaatgagtactgttgtccaagttagatgtgtaagtctggatttcagatcagagacttgacttgtattagaaaaatatagtaggtagcatgtagctattaggtgacaagatgaaatcacctcagagtaagtatacatggagaaaagatccaagaattgtgcttttggcatttcagtgtttagggttggggagataaggaagaaccaacaaaggagctgagaaagagcagcccctgaggtaggaagaaaatggagagattttggtgtttcagagattttggtgtttcagaagccaagtaaaaacactgttttgaggagggaataaggtaaccgtttactatatcaaatgctgctgtgtgtgctcataagatggaagagaagtatttaacaatctggagatcattggtgacttttaccaaggggcagttttggtgaatggtggagtggaaaacctgatttgggtttcagagagaatgggaggggaagaattggagataatacaatgggactttccccgctaggttttgcttttaaagagagcacaaaaattcacatagg

SEQ ID NO: 10827 - DNA, 1028 bp, Homo sapiens
tgtccttaggtttatggaaagatcattggactagaagtcaggaaagctgggttcagtaactttcctgtcatgctgctatccatatatgaccatgggtaagttaagattgtaagagaaattgtagaatagagtggatttacaagtaggcatatagatacagacacatacagagggataggcatggtcacataagagcatttgcgtttaaaaagtgtgaagatattagtgttttaatttttttagatattgaagaagccagatacaaatttgcttatgatctcatgaatattaacagcacgtgaaacagattttctaagtgaagtcttctagtctatattctttataaatgtacttttaatgacattaattttatttttatttgaaattcattaggatatgttaagaataactattactgtgctagttttgtaaggctgatgattaagaattttttcctatacttacggaggaaaaagaataaataattaaagctgtgcatagttaaaaatctgacatgagaatgaatactatattttgtcagaggattcatgtgcactgtgacatttagttacaggaatgaatatgagatgatttcatctaccttcttcatgacacaattgtgaggcagttcttagtatgaagatttcaaggaaattctgtgttcacagtgtgcattgcttgaccattagggagttcttatttagtatattgaaagtcatttgaagtttaaagctaaaagctatataccttctaagatctccaaaacagtttacaaaatagttggttgagaaggctattatgatagaaataatattttgctaaggatggataatatgcattaagagctataagaaaaacacctgagtgtgatcattgtggttttccttctcagatgaattttctagacgaaaacgttctaaatcagaagacatggacaatgtacagtctaaacgtcgtcgatatatggaagaagaatatgaggcagaatttcaagtaaagattacagccaaaggagacattaaccagaa

SEQ ID NO: 10828 - DNA, 1026 bp, Homo sapiens
aaagaataattttattcattgtttctcatcacacccacgggtgcaactatgaaattgtgtttttaaaacctaagtttttggctgggcatagtggctcacgcctgtgagctcagcactttaggaggctgaggaaggtgaatctcttgagtctagcagttagagaccagcctggccaatatggtgaaaccctgtctctactaaaaatacaaaaaaattagccgagtgtggtagtgcatgcctgtagtcccagctactttggaggttgaggcatgagaattgcttgaacctgggaggtggaggttgcagtgagctgagatcgggctactgcattccagcctgggcaacagagtgagactctgtctccaaaataaatccatccatccatccatccatccatccatccatccatccatccatcctaaaacagttttcgacacctatcatctcacacataaggtgcaatccagatttcttaacatttaaatttgtacttaaatgttgcttgtagtctcagaatttgaatctttctaacaccaagccaatcatcttctctgcaaatgttcctgttactgacaatttctgaattcttggaaaactcttgaaggaaaatcttcccgttgttcctcttattggcagctcttgaattcttggaaaccgatccctctcaatcatttcatatacacagtgagttgccaagttacaacttgattatttcctagaaaaaataaatctcaattcttttcacttttcattaggccatcattacccaattccttgattatagtaacaccttttatatgagcactctggtactagtttttaagttctttctggtccttccaaagcattgtactaatttttctaaaatactgattacttcagtctctttatagtccaagttcctcaattgtgtaccggtaaaaccagtattcatttttaaaatttttaaattttaatctcttaattttcaatccactttttctaatatccaccagttgcttcactgtcctacagggtactattaat

SEQ ID NO: 10829 - DNA, 1047 bp, Homo sapiens
tccgcctcctgggttcaagcgattctccagcctcagcctcctgagtggctggggttacaggtgcccaccatcacgctcggctaatttttgtatgtttagtagatacaagctttcaccattttggctaggctgctcttgaactcctgacctcaggtgatctgcccgcctcggcctcccaaagtgctgggattacaggcacgagccaccaggcctggccagagtgtcttaatgatagttattttgaattcattggcagataattcatagctctctgttactttagggttggtttttggagatttattttatttatttgattggaccatgtttctctgtttatttgtatgcttgttgaaattttagcatttgaaaaaacagccacatctcccagtctttgtggactcttgtacacaggaagggcttcaccagtcagccttgttagagagtctgtgggcctctaacacctttttttggctatgtgtcttctctgggcttttgcttgtactcttccatctgaagaggtttgcctctctactctgaagctccctctggtacctgtctttgctatagcagcctctggtactttggcaagctgttgtattagtgcttcccctgctgtctgtctgtgttactgcaatttctctggtgctctatcaagttgagggtcctgcctttggtctctgaggctcacaggcatccgaagtgccatagtcacagttcttgctccagattagtcctccatgttgggtaagacaaaatctaatgcgttgggcatctttcttaaacagttggattcaagctccaactttctctttcctttctgatgtagaagctgtgttgggaggttgatggggtatagtgagtaaatgcaatgtattttcctaactgttccagtgtgcctctttttggccttgtgctcacctgggatggcataccctctcaactaatttgtggaaatctcatgcaggcaatatgatgcttatcttgttaagtcatctccatatgggaagcagaggggacttcctgttctgacatgttgctgatcat

SEQ ID NO: 10830 - DNA, 1058 bp, Homo sapiens
tatttgtgtaggtattgccttattggaaattctggaaacctgatactgcaacctgcaatgtaggatgtttgtatggcatttaaaggtaatggtgatgtttattattctatactttgcattctgtgagagtaattttcactctgtcttaagtgtgagtaagcctcttctaaaaatcttgttcttgccaagaaatttataaatcacatacgaagacgtctgttgctaacagttaactttatgaggtaactatatccttctatttctctggactcatttttaaaaaatatgccgaatactgcatactgtttaaggtagtatataagtttatgagagaagtggagagctttcttccttgaaaagtcggtatttgttgagataccatttgcctcacagagaggtgttccccactcccatccccattgccagataataaatattttgagaaaagtgacctaaaacagctgaaatcttaggtgcatctgtctgcagacctccttaagcaggctgtatcttacaattcccttactgcactgggtaagtgttaacttagtttttgttgtttgctcttttgctttaaatattctccaaattaccatttatgcaacatggttagggttaatactgcatggtattcatttatcttgtttcatgaactttccagtactgtacaaggtcaacaaagtaatgcctgtggtatcctcatctctcacttttttactctgtgattttagcacagtaaggtactgcaaagaccttccttccaaatgttctccttgactttatttcttgggccaattcagtatcctcaacatcctaagattttgttgttttatcactgacctgtggttggcctgttttattctaatttccagaaaagtcaagtcccagtatttgcaatatcaaataactctaaaaccgatgtgtgattctaccttccttactatttttactgggcaaatgccctatttttttaattattattatttttaacttttgggacacacaaaaatcagcaattctcatgaagcgtttgttagtgtggcagacttgtctaattc

SEQ ID NO: 10831 - DNA, 1098 bp, Homo sapiens
gtctatatcttcccaccttcctctccaacagtcaagtttctagacccaaggctcttgtttctccaaaactgcttgcagaaatagctatgccttctttgccatttattttaggtcaccacttattagtgacatctgatattagattcttgtgagatgaagattggagactggcttaagtatctgtcaggaagcttctctattttcagattatattgcatacaaaaaccttgcaagccaaatctgtttcagaattaaaataacatgagcaacctcaagaaaaattattccatgtgtgcacacgtatcaagaaaaacactgcttccatcatgccaccccacttcattgcttgcagggatcattgaaattcatttactcagtgatcagaatctcctgaaccctgcctccagacctcatttccaaacatacaccctaacctccaaaacaaatttggtctttagccttgtccaataaaaatagttattgttaaaagtccaaactctttaacatgctattttttaaaagcccggggttggggaggggggtgggtaagggatctccttactccacagaacttctaatttcccagacaatcagttgttcaagaacacaatgccattcctcatgctttctttgcctataagctgttctcacccacttggtgaaatctacttcccccttcataggtcaacccctcagtgaagtcctccttgatgtcttcagcagcatttaatggtttttcctctatgtccccttagtactttcttcatatctctacttgtctctcccactagactgtaaattcacttttgtcaggaccatgccatctgagtaccccagtgtctaaaacataacctggtactatatatttctgctgaataaatgaattaaaaaacaaatgagtgcaagttatttaaatcagaggaatcatgatagaaacattaatattttaatatgtaacagaccacaagaatgttaaaagagtggtcttcaaactcaaaagtgtatcttcccaatgacaccagccttagaagaacagtttctgtgttactattgtcatgctggaattcaaagggtttttcttggttcttatagagacta

SEQ ID NO: 10832 - DNA, 1034 bp, Homo sapiens
gttgcacccaggtcacatttatctggagctatctatttactaatacaggttgagtatccctaacctgaaaatctgaaatttgaaacgctctgaaatctgagactttgagtgccgacttgatgcttaaaggaaatgctcattggagcattttgaatttcctattttcaggttaggaattctcagttggtaagtgtctaatgcaaatattccaaaatccgaaaaagtttgaaatccaacttttttctggtcccaagtattttcaattaagggatgctcaccttgtgtatacagacagcaaaattcagaagaaaattaaattgctgataccttataagcaggtgtttttaacctgggtctgtgggcagaatggttaaagggagggaccatgaagcctctgaaattctatacaaaatcttgtgtgctgacacctgatgtatatttctttggaaagatgtgtagctattactagattcacaaaaacagagtgtaagaaccactatttatagcaatgctgaaattgactagattagaacttgtcttaataatgtagttttgccaaattgggaagtgtatgtaggtattaaagttgattttacttacaagctatcatgcataatttgacattgtatatagaaacccagaattttttttaatcatctgtaatttgtgacttggaatgaatgttgtttttctgtaattgtgattgttctttcgttggctaatctgcagatgtaattagaatttataaacttttttcttacatgagtaaacatcatatttttatctttattttgcagactttgggatcatgctactatgacagaagtgaaatctctaaattttaatatgtctgttagtagtatggaatatattcctgagggagagattttggttataacttatggacgatctattgcttttcatagtgcagtaaggtatgtccaagaaatactttcattttcttttttaggtaacaaaagacattttggctacttaaaaatgggaaggtatttactttttttaaaagtaaagag

SEQ ID NO: 10833 - DNA, 1023 bp, Homo sapiens
ccatttgatttttttttttttttttttgctaacagctttttttacatcagtgtttatgtttgagtaaatgagtatttaattgttccttgggtttcagaatttaagaacagttcaaatgtaactcgttatttataccatattcaagatttgtaaatactacttaaattttttttcagtttggacccaattaaatcctttgaagctcctgcaaccatcaattctgcatctcttcatcctgagaaagaatttcttgttgcaggcggtgaagattttaaactttataagtatgattataatagtggagaagaattaggtgagttgtccccttacagtgatgtggttacctttatcatatgttaagtcccagtaattaacacctcatttatatatatatatatgttacatatatatgttgaaagtaaatttttcagctaacttaagcttggtgcttacaagtgaaaaagtaaaggagttttaaccatttgggtcagatgcttttatagatctgtaaacaaagtatgcagaaatttatccttttaactaaagttcatcattatgctgatgttatgtattatggtacagtgagttttaggctttattggctgggagggaggggggaatcttatgtcaaagtcatatgctaaacacatgcaaggagatccgttctttctgaactatgttgtgggtgtataaccccatctacttggcccgtcttcctttttgccaacttaggaattcctaagactccgtaaagaacagtgtgtgggggaaaaatcagtatagcatattacagggatacctttaggaatctgaattggatagttatttttatcagctttttatttattctgttttggagtttgagttttgctttcattttcatgataacagtccttagtaagggaaagggaaaggcatggggattaatttgaagttaatgtatatttatctgatggaccaggtatttcacatagttacatgtggttctcagtatctacttttagcctttccaaatagtttttg

SEQ ID NO: 10834 - DNA, 1033 bp, Homo sapiens
aaaccagttaaaagacttttactgatatttcctgtgagaattgataagggtctaaactgaaacaagtgagagtgcagtggaaagagtgcatgtgagggggtaaggaaggtaaggaggtagaattgtcaggacttaaatattgattgggtgtggtgtggccagggaatggtggagtttggattaaactataaggtttcctgcttgggttgataatagaatatattcatttaatgtctcccttctctagcattctgttagcagtcatctgctggtgcaaccagtcatagccctgagtgataaaacgtgagagatttagtactcaggctctgaggtgttgttttgaccactaccatctacagattcccaactctactggatagtcaggttcctgaaacatgtaaatccagataatcagagttttattgtatatggaacatatctttcatttcctaatggatccagggacatcatttacgaatatcagatattggctgaattcagctgtgttatgatcaaccttaaagactactggactatgaggagcccctcacggtgtttttctactgcccttatgtaactggtctgccagctttttagaactgtgtgtgcctgcaacttagaaaaaaaatcccacagttaaattggttaaaacaactgtcaactttccttgcttttttgctgccagtttggttagggtaaccttgcagccttgctgattctgtcctttgattttaaatgcacgtgtcttttgaacctcaagatgaaggctgagaagtgactctacaggcttacttgtggaaatgtagaatgagtgggctttgcttttgtgatctgttttcctatttattgacaccttccttgtttattccaggttcacagctatagtctagatggtggaggtttatgactttccaataagtgaaatgttaatgagggttattaaccctcactagtgtctgtttggaagtagtgacattcttccaaaaatcttggaaaagttgttttgtagtgtgaatgagcatgagtcactgat

SEQ ID NO: 10835 - DNA, 1050 bp, Homo sapiens
tgttcctctctgtgtttatgtgttctcattgttcagctcccactcataagtgagaatatgtggtgtttggttttctgtttctgcattggtttgctgagaataatggcttccagttccacccatgtccctgcaaaggacatgatctcattcctttttatggctgcatagtattccatggtgtatatgtaccacatttgctttatccagtctatcattgatgggcatttgggttgattccgtgtctttgctattgcgaatagtgctgcaatgagcatatgtatgcatgtatctttatagtaaaatgatttatactcctttgggtatatactcagtaatgggattgctgggtcaaatgctatttctggttctaggtctttgaggaatcaccacactgttttccacaatgtttgaactaattgacattaccaccaacagtgtaaaaacgtccctgtttctccacagccttgccagaaatcataattttaatgtttatgaaagttaattgtttttctctgtagcttcaatttgtgtttttctgatttgcaataagtattcttccatatacacagggccatttttttgcctttgctataaaatgttcattcacacttttacttatttttctattgggttgtcttattttattgattctacatataaatcctatgtcaaaaaaatatgtatagcaaaattttttcattctgtggcttgtctttttaactcctcatgtcttgtgatgaacataaatttttagtcttaatgtagtgatataccatttactttaccatgtgcaagttttactattgtttaggaaatttttctgcatttgcagttgtaaagatatcctatattttattctataatttctagagttttaccttttatatttgccttaaatatacaactagtggccacgtgcagtgactcacgcctataatcccaacactttggaagatgaggtgggaggatcacttgagcctgggaagtcaaggctgcaatgaactatgatcacatcactgtactccagcctgggcgacagagcaagacact

SEQ ID NO: 10836 - DNA, 1066 bp, Homo sapiens
ctaggctcacgcaatcctcctgccttggtccccgaaaatgggggattataggcatgagccatggtgcctggccaaaaatctttatctttaaagatatttaatactttttttctgaataatttttctatgtgccctaagctagccagcctcttaattatgttactatgtgtttgtgtgtgtaaatacattacacagagtttgagtttgattattgaattttcatattgtttttataacttaatttatgctgttatctttatgaagaatgctgaaaataagtgaattttataacttgtaaagtgtggctttaaatattccgtattcttatgagaacgcaaataacttagcccataaagcacagaagaaaatcttatacgtttgagttataaagctttctgcttgctccttgaaaatattgcttaatgattctgtaatgacaggccatggtaacttaaaatggatgtgtcatttactattcctttgtgcttcaaagctttaagatggttaacttagagtgccaagtaaatcttaaggctctctgaatagtgagaaactttattctgattatttaaaggtcattgcaggactgggtatcaaaacaatatttgcgggggtaaaatagtatgcaaattttttaaggttatgttttcatactgctttttttaacttaaaattctaagttctgaaaattgaactttttcttacataggcaaatagagtatgaggttttgtttcaatatctgcaatagctggatctaatgtatgctaattccaaacttaccaaaactagcgttgcaagtaaggagaaaaatctgtttcttcagattttcacaattcaaaatatgaatgaagatggggaatctaacaagtgccataaaaaacattagaatatattaactatgtatttgatatttaaagttgttttatactttactttttttttttctttgagacggagtttcactcttgttgcccaggctggcatgatctcagctcacgcaacgtccacctcccgggttcaagcagttctcctgcctcagtctcccaagtagttgagattacaggt

SEQ ID NO: 10837 - DNA, 1081 bp, Homo sapiens
agttctatctatgttgtcacaaaaggcaaggtctcattttttataagaatatgatgaataatattccatcatattttctttatccattcatctcttgatggacatgtgggttatttccttattttggctattgtcagtaatgctgcagtgaacatgggagcacagatgttcctatgaggtggcaattcatttcttttgggtatacacccagaggtgggattgtagatcatatatggtagttctatttttaatttcttgaggaacctccatactgttttccataatggctgcactaatttattttcctaccaacaatgtgcaaggatttccttttttctgcaccttgcaggcacttgcttgatggcatttttttaaagttagtaaagaaataccacagaatgattccaaatcaaataataaaagtgtacgtttagtgtatatgcttctttttaacctgttttataatgttaagtgtttttttcttatagaagcaattcatttttattgtagaacatttggaaaatactaaggagtataaagatggagaaaataaaaatcattcacagtcctgttgtgcagagagaatttctactaatataattattgtgtacaattatatgcatatattatgcatatataacacataattatatatgcagcatagatgcatgtattatatgtaattatatgtgcaattatgcacaattatgtatgcggcacatatgcatatattatgcatttataatgtttcacattgacagttaatatgtatatatatttttaaagatttgagtcttattgctattgataatactgtgtcaaatcctattttcattagctgtattagtatccttatatcgttatatatttattcagtagaaggtttttaataactatgatgttctgtcttatgaatatatggtatttattcctctacttccaggtaactttgttgtttgtgagtttttgctgtgagaaaaatgtttatatgaatactcttgtatgcatgtctgttttttgtagaattggaattgagaaaatacatgagctttttagatggttcatcacttaacatttgcca

SEQ ID NO: 10838 - DNA, 1047 bp, Homo sapiens
gtctttcaagtagatgacctcccctgttctgcccacacccaaaacccactgaccaagcacttgctgtcatgttaccctgttttgttttccctgtggcacttatcactggttaaaattcttattcacttacgtgttttctttttctgccttgtgatatgagcctcacaagagtggggacctcctctgaccctctttgctgctaaattctcacagttaagaatagtgcctttctgttcttaggaaatgctcaataaatatctgttgaacatttgtaataaatattttgtaataaacaagtcagcagtttgttaaaatacagtgtgtttaaatgctatgtcactggtgcattgcagacacttgttgggtatttatggaatcttgagggagggccgtggtcagtaggagctcaaggagaatgaaagcttgaagccacaaagggtttttctagattaatccagtgaaagacagatgagcaggagagttagggtatgatagatttgttgaaatgttgaactgttagacttcaggctgggaaggagggaagtagagcaaaaagtgatctgatagattgggatagagattcttccaagaccagagaactcccacagggaagtagttaaacatgtatactgcaaggttggagatttggtgttgcagtgtgatcattgaagtcatgattttagatgtgccaggttatgggtatgacaaggttctgggattaagagaatggatggctcaggtagttgaaggaccttgggggaatggggaataaatatctgttctttgagagaatgcagtaggacagctgatgggagaaagtccttaacagccaaggtactgaggtaatgctttgaaaagaggttgagggtatagaggagtttgctaattatggagcaccatttccataggtagttaaatttgtaagatagaaggtggactgtagactaggtcagggatggaaaaaacaaagccttgtagggttaatgccaggtcagtagatggattgagagaggaattggagataaagttaatttgggcattgagagg

SEQ ID NO: 10839 - DNA, 1077 bp, Homo sapiens
caaaatttctctaatatctaccattttgtaggtctggtgctagatggtagagataacatactgcatgctaataagtgggtttttttttttagattttaagaaaagttatttaaatccgaaactatttttactggttttaaatttttgtccacttgttttgtgtattatcttctgtttatggaacacttaactatatgttccaagcactctgctgggtcttttatatgcatatgtcatttattgcatacaccataccaatctacccgtcagttattgagcatttatgtacctgtcactgtgcaaccatttaatcttgcaaatgaggaccctaaaccttacagggctggcagagctgggattcaagtttgaatcaggtgggtcagcattctacccaaaaagattttttatcaattgtgctttatgataaaactgccatgtacaatataaacaataggtcatcagattattaaaaattcaccagattgaaaaagaggcaatggaagatttaagtgatgccgaactctggaataattagtcatcattttgtgtaacatatatggtatctattatgacagctttttaaaaaacctctactcatgtcaactaatacagctattgccataaacttggatcaagtttataatcaagttttaaaaatttaagtttggcgggtgctgggattacaggattactcatgcctgtaatgctagcactttgggaggccgaggtggatggatcacgaggtcaggagatcgagaccattctagctaacacagtgaaacccccatctctactgaaaatacaaaaaattagccgggcgtggtggcgggtgcctgtggtcccagctactcaggaggctgaggtaggagaatgacgtgaacccaggaggtggagcttgcagtgagccgagatcgcaccactgcactccagcctgggcgacagagtgagactccgactcaaaaaaaaaaatttaagtttataaacttagatttaaacttagactatgtcctacaatcaagcgtcctgtgtaaaggtggctgtggtatgctggtggcattgaaaactggtagcttgaag

SEQ ID NO: 10840 - DNA, 1051 bp, Homo sapiens
gctaattaaagtttaaaaaccactagtgaaaataaacaccaaaacatggttaacttaaaggagattaaaaggagagtgggggaaacagcaaggatgaattcaatgtgcaagtttgtttaaaattatatacaacttaaggagtcatgaaaaggaaatattattgtattttacatagatagatagatgagtataaatagtatctcccttgtatagattaaagaaagctgttatcattatcagctgactctggaaagaggtgtcagcttagtgaagccagcaaaccttagtttcctctgagtgccagagagccactgttatcatattctctttcatgagcaccaaatgtgctttaggtacttttcctacatgttcacttattatcaacaaccctgtgggataattattagtattatcattttacaggtgagaaaatgtagaatattaagtagtatgtttagtgtcacagaaaccgataataatgaatttctcaaaccaaaattcagattgtaacgacactttaatgttaagaggcatgtcactgagaagcaagtggtttgggtttcaatgattgagttagttgttctcagtctgctctgccccaaaaggccatctcttggtgtttcaaggaacagcagctggattgcttgatacttacaagggaaaatttttttattttctttctttttttattttttgagatggagtcttgctctattgcccaggctggagcacagtggcgtgatcttggctcaccgcaccctctgcctgccaggttcaaacgattctcctgcctcagcctcccgagtaggtgggactacaggtgtgcaccaccacgcccagctaatttttgtgtttttttgtagagacagggtttcaccatgttggccaggctggtctcgaactcctgacctcagattatccacctgccttagcctcccaaagtgctgggattacaggcatgagccactgtgcctggtcttataaggaaaaatttgttaaggcctctacagaaaccacgtctggtgcctatggatggactgttgtttttagt

SEQ ID NO: 10841 - DNA, 1033 bp, Homo sapiens
aagaatatcctttgtgaaatatttggattgcatttcatttgttatctgtctctctaggcttataaatatacttgccaaccacatacatgtcttaggactcagaccataaacccatagatacaacgtaatttgccagaggtcccataaaatactaataataaggctagttgtccctggctctagcttagttaggtaacttgaagaaaaaaggaaaatggctgtgctaattttgttaggagtaagctttcagttcagtagaaaatgacgatatatagaaatataattcaataaactgtttgatgggtggtaccattaaaaataacagagcagttgggaagtacttgatatataataaaatatcaaaggacattgtcacatctgcagtcagataatagttctaagttaggttggccacagtgagggtgattgtttctttctggtcactgcacttggcagtagatgtagctcctggcaggttcacaatgatgttcgttttgatgaaatagaacaagaaagttggatggtaataacgtgaataactgaaaataagctcgaatttagtataccaaatttactttcttctatagaataatgccaactactttctaattagtagctagaagaaatggagtaagagtaaaaagtttagattgaaattgagtccagtctacattccctctggtcatgtttttttgaaactgacccaaagctctcaacctcttgttttttgctttcttccttttttagaataccatttatggttcgtatccaccccttgaagtcctatattctaactgagctttcatctataagcttttttgggcattgtatgcagaatttaatagcttcctatttattaagaaacattcctttctctttgggcagaatttatattttattccttctaaatgctttgttaaatcagaaggtcgaggaataacaatatgctgtttctgccctctggtggttgaaagagatgttgtaaataagtaattacaaagatgtgtgtcctatgactctaaccacctatggc

SEQ ID NO: 10842 - DNA, 1047 bp, Homo sapiens
aaagtataagttcaaaatctactttgtaaaggtaacaaagactgtaaatccagaacagaggacctgtgacttattaatacaaatggaacttttcccattagttgtcatttaacatgaatgatttccggtggaagagttctggattttaggaattggaatcttctcccattcttcttgatgtctggtgtacagcttgtctgctgtctagcacacatctttgggttattttccattccagatgagctatgattttttatgcataattttttggagctatacattttccttgagaataaatatctgaaattatagtttaagtcaataagaaagtatgatttttaagtatatatcagaaacatattttccctttgaggtcacattgtcagaggcaggaaaggaagaagtgcagcagttaatatctagccagcaaaatttatctgggagatggattactaaggttaataagaagtagaaattatagagcaaaggatgtgaatgttgggagacttaatcagtgtatatgtttcctgattggtcagagacattgtcattttcactgccttttctccactttctaaagagttgataaggaaacaatttttttttttatatttgaagagttgatctatttataaattttaacaatgacattcaatagagttactgctgtaaatctagacattaacatgaaacttagccgtgtattttaaggcttaaggaggtattgtctagggtttatggaggactattacattatattctttttcttgtttttaatacttaaaaattatgaaataattaatgtaaaaaattacagatataccaaagatatgaataagatagagagttgcccctacactttgttctttggttttataacacataccctgcccccaccaagttgaataatactcccccacttcagagtgtgtactgataatattctgatcccagaacctgtgaaggctactttctgtggcaaatacttagcagatgtgattaaattaaggactttgagatgaggttttccttgatcttggtggggag

SEQ ID NO: 10843 - DNA, 1049 bp, Homo sapiens
gccaggcgtggtagcaggcacttgtagtcccatctactttggaggctgaggcaagagaattgcttgaacctgggaggtggaggttgcagtgagcccagatcacaccactgcactccagcctgggtgacagagcgagaatccatctcaaaaaaaaaaaaaaaagttctgttaagggcagagcctagactacctaagggattcactgcctggatggctgtgggctaagaaccgttattaggacagggagaaaatgaaggtgagacataggtttttcctatcatgttttcttgtaaatgtgattactatcttccagatctactactgattgtctgcctgctactgttacctcttaatatgttaaatataacctgggatgcttctaatccttctttccttgactctctctccagaaaaagtcctccatgacttcttttctcaatactgtaattactgatgtagttattttgattgtgttttatagtcatagcagtgagactgccttacaacaatattgtctaaattaagtaaatgcaatagccaatattagactggttttgaccttcagaatggcaacgccaaggattcatccccatgttgtaattatgatttttaaacgtattataatcaaaaacacagtattaaaagggatacatggggtttttcagtcatgcaacaaatattttactctgtgctccataaacacctactatgtgttaagcattattctctatgccagggagatgattgatatgatagtaaacaagagaattacacgtgtggaatgcagtttactcccagaaagggaaagattgaataaagcagtaggttacccagaattgcagaaatatttaggcaccaaggagtaatggaaaggctaaatatgtacaggatgatatatgtgataggagcttggcatacggcctgagcacataaatgcttaataaattttaattgtgccagttgcttttgttgctgtcactatgccaattgtgggataaggtagggatgcaaatcagaataaaaatgttcaacaggtatgaataaaaata

SEQ ID NO: 10844 - DNA, 1064 bp, Homo sapiens
tttgtgattcatgttgtagcatgtatcagtacatcattcctttttatggctgaataatattccatcatttgtaaatgctacgttttgtttttccattcatttgttgattggacatgtgggttctttccaccttttggctattatgaatagtattgctgtgaacatgtatgtacaagtatttgtttgaatacctgtttttaattatttgggtatatatacctgggagttgaattgctaggtcatatggcaattttgtgtccaactttttgagctaaactgttttccatagcacctgcaccatttacattcctgtcaacactaaatatttatgctgagatcctgaactgactcttggacttccaaattaaattgtgaacaatctggaattttttgttatagttaggtaacactagcatatattgttatgaaatttttcaaagaaaagctgtgaaactggtccatttttaaagtttgtgtttggatagtcgtaattttttatgtctgatcttcagtcatctgaacatactttttaagaacagtgtttaagaactgaatgtgctctgttatttaaattattatgccttattcctttcttgttttgtcttttatatctaatatgtaggtaacatttttgaaatatttagccaatttaggaatcaaagagttatacagattatttagaattggagaatctttctggatagcaatttttaagtttttttttacttgattgacagtaattttactgtataaggaagtcggttatatccttccagttcccagttccatacctcttttgtgatgttttctattatgcagaacttaaagttttggcagcttaatcttttgttgctcattgttaatgttttcagtttcttaatacacagaactggctttttcattttaaattacatttccattgattaaatgtacttttttgggggtcacagaatgtgatagaccattcttggtgcctaccaaattgctatccactcttccttccaactttcttcctattggaaagaatcccaattttgttctagtgatttctttttttttttttt

SEQ ID NO: 10845 - DNA, 1029 bp, Homo sapiens
cgtcggggaggcttgggccgtgcaggaacccatggcggaggggaggctcgggcatggcgggctgcaggtccagagccctgccctgtggggaagcagctgaggcccggcgagaatttgagcacggtgcgggtaggctggcagtgctggggcacccggcgccccctccacagctgctggcctgggtgctaagcccctcactgcctggggccagcaatgccggccggccactctgagtgcggcccgcggagcctgtgcccacctgaaacttgcgctggcccacaagcgctacgtgcaccccggttcccaccggcacctctccctccacccctccctgcaagcagagggagccggctccagccttggccagcccagagaggggctcccacagtgcagtggcaagctgatgggctcctcaggcacggccagagtgggcgccgaggccaaggaggcgctgagagcacgcgagggctgccaccacactgtcacctctcaatatcatggtgagtaaaggacaacttatgaagtcagttactttttcaggacctttcattgagtttgttgcagagatagaattgtcttttaggtcctaaggctgtgtcttaatcatgagtctccataacacagtctgtcctgtactgtggttttttttaaaacatgggtattttcttccttccctacaaaagggtaaacaggagtttcttaataagtaaatcaagctaacacacaaagcaaccattgtaagagtttctttgaggcctgtttttttgatgataatgaaactggtaacactatcatatgtttaattctattcctacatcaaaaacataccatgtatcttccaagcagatggtacaagtgtagaattgactgttagtacttgaataatagatattgttagtaaatcagactctgtagaaaacgagttagattttatttcctttagaatgaaaatcattttatatacagttagagtgtaagtcacaaactaccattcacaagtgtacattcacataaatatgtgcaattttt

SEQ ID NO: 10846 - DNA, 1047 bp, Homo sapiens
ggtagtggatgaaaaatatctgaactattatgtcagtatcaaatgaggatgactagactgacattgtgtttagaagttgttggccccatacccatgtcgattgtcttccttggtggcatagagtttattcttatactctacttcagtttatatagttgttacctgtgccataagttcatgggatatttgaaacctacctcaggtaatcattaggtgtgagagtttaatttctgtaagctgatttaccccttacctgattaccaacttttagcagaagataatgaggatatgagagagagaaagacactatattttcaaattattttaaaatttacttttgtaattagtgttactttggtttttctttttttaagtcatgaacaaatggtatgtgctataccaaaataaatgaatttggaaatttgggaaaaagtgagaaaggaggttttcattatccttaatttttgcctctgtttaaacttgggatttaatgtgcagttgtgcttttctcgtactagtatttttctgatctgaacaatttgtattaaatgacctaggcaataaaaatcagtagtcaactgatgaaacatttgcatgcatcatgtcgtacagcactgttaggtactgtatggaaaagagattggtaggagatctgtttcttaaccgttaaaagaactactttaaatatgtgtgatgagtaaattggtaccaatttacggtattcagaacacctcaatgctggatttagttgtttgaacataagcctgtttactagagtgaatgctgggaaactaggttaagtcaaggtcaaggctggcactttgaagaagagagtggtcaaagttttaaatggcactgagaagtaaagtaacataagggctgaaaaattacaaatatcacaattagatctttagtcattatcacaaatattgctgaggaatgtgctgaaacgttatttggtggagagtactttggaggccctcactggattttttctgtggctttttaatgaagcattgttcttcacctatagtatagagataacgt

SEQ ID NO: 10847 - DNA, 1055 bp, Homo sapiens
ttaaataattgaccaaatactaatataatgatgacatatactgaatgtcctgcagttcataataattgtaaataacatttatcaagtgcttattattttctacagcttctattataaagtaagttccatgagggcaaggattttttatgtttttctcactgctttatgatacattttaatttataaattaggcacagtgggacaggcatgctgattcatgcctgtaatcccagcagtttgggaaaccaaagtaggaagatcacttgagcccaggagtttgaggccagactgggcaacccagcaagaccccatctctgttttttaaaaaattaggcacagtaaaagattaactacaataactaataaaagtgtaacagcatgccagcatcactagtcttgtactttagggggtggggtggggtcattattaagtaaagtaaaggttgtttgaacacaaaaactgcaatacctcaacagttaatctgagaaccaagccaactactaagtaactaacggggcaggttgcatcgacagtttagagacactggacaaagggatgattcacatcatagatgggatggagcaggatggagagagatttcatcacactactcagaacagctcacaatttaaaacttaagaattgtttatttctgggattttctatttaatatttttgggcggcaattgactgagggtaactgaaaccatagaaagcaaaaccacagataagggaggactactgtatataaatatatgtctatatagatgttatatttttgaaaatatttgtgtgtatatacatgtatatgctgactaaatgaaggaataacctgtgacatagctgcctttattcagttgagacacagagaggtaaagtaagttgccaaagatcacctagctattaagtggaggagctgggattcaaacctatgtagtctgatttcagaaactgtgctctcaactgccattgttttctgctacctctgttgtgtttacagaaatacaggaacacgaatagtaaatattgcttttcttattcagtcgagtcagtt

SEQ ID NO: 10848 - DNA, 1080 bp, Homo sapiens
tgtactccactgcactccagcctgggtgacagagtgagaatccatctcaaaaaaaaaaaaaaaagtatgtttgtatttagaatttgaattatacctacacctctgtatctaaaggaaatggaggccaggcgctcactcctgtaatcctggcactttaggaggctgaggcaggcagattgcctgagctcaggagtttgagatcgccctgggcaacatggcaaaaccccatctctacaaaagtacaaaaaattagctgggcatggtggctggtgcctgtagtcccagctactcaggggcctgaggcaggagaatcactcgaacctgagaggcggaggttgcagtgagctgagattgtgccaatgcacttcagcctgggcaacagagcaaaacactatctccaaaaaaaaaaaaagataatagggaaacacaaatgctaactttacgtagagtttttaattgattcttttttttctggctcacttctcccctaacttttaaaaatcttttttatatcatgaatttcacctagtatgaagttggcactgtgatagttttataaactcaaaagagtatgtttatcaaagtggtttttgttgttgttgttgttgttgttgttgttttgagatggagtctcactctgtcgcccaggctggagtgcactggcgcgatcttgtctcgctgcaagctcggcttcctggggtcacgccattctcctgcctcagcctcccaagtagctgggactacaggcacctgccaccacgcccggctaatttttttgtatttttcgaagagacggggtttcactgtgttagccaggatggtctcgatctcctgacctcttgatccgcctgcctccgcctcccaaagtgctgggattacaggcgtgagccactgcgcccggcccaaagtggtttttttaaaaatagtaaactgaaattgtattctttcatttttggaaatggtagtattctgtgcttagtaatatgcaattacatatccaattcccaaaattaacattttaaaagaattatactttgcatgcataatgtacatgaagcatttttagattgctttaagaag

SEQ ID NO: 10849 - DNA, 1030 bp, Homo sapiens
ttctaagctgggcacggtggctcatgcttgtaatcccagcactttgggaggccgaagtgggtggattacctgaggtcaggaattcaagatcagccgggcatggtggtggatgcctgtaatcccagctacccaggaggctgaggcaggagaatcgcttgagcccaggaggcggaggttgcagtgagccgagatcacgccattgcactccagcttgggcaacagagcgagactcttgtctcccaaaaaaaaaaaaaaaaaaaaaaaattctaatgtatattttacttactggaacaaaagaaatgtactctaatttagaatttggaaaataaccctccttcatgtttacattttaattatttttttattttagagtaatttcttaccaaacattaccaagaaatatgccaagtcacagagcccagattatggcccgctaccctgaaggttatagaacactcccaagaaacagcaagacaaggcctgaaagtatctgcagtgtaaccccttccactcatgacaagacattaggacccggagcggaggagaaacggaggtccatgagagatgacacaatgtggcagctctacgaatggcagcagcgtcagttttataacaaacagagcaccctccctcgacacagtactttgagtagtcccaaaaccatggtaaatatttctgaccagacaatgcactctattcccacatcaccttcccacgggtcaatagctgcttatcagggatactcccctcaacgaacttacagatcggaagtgtcttcaccaattcagagaggagatgtgacaatagaccgcagacacagggcccatcaccctaaggtaaaatagctgctgattttgtgttaactcactaccttataaatgctgtgttttctttctagtatactattttaaatgtgagagacaaaagaatggggataaagtaagcaaggcagctcttttttgttttaaaaaataaataaaaatattttacaacattaagatctcatgtataaaaaatacctaattgcaa

SEQ ID NO: 10850 - DNA, 1033 bp, Homo sapiens
cttgttactgccagtagcgtaacattttagagtaccaggtccgttgcttttgtagggattattggttccctggatttatgaattgattcatcagttttatgtaaccacaaatttgagagtaaattataaaatctgaaagaggaaaaggctctggtcacattttatactatatatcataacaaatgaacatgtactaatctattctcactctaacacttactctgcctcccctaataaatcatcagaataacccaagaccagcaacaaaatgtagttttcctcctgccccttgtgaggtattacaataatcaaaagcaaaactgtaatttctttaaattctgttaatcactgtcagtattcacaaaacacatagacccaaagagtattctcatagttacttcagaggtcaactcatttctgatgctactggaatgtttaataacaaataaaaaataaaatagccttatctgaaagtctgcagatttacatattaagcaggcaatccaaaaatcttgacttctggtgcctgtaacttcagcaatataatttgattctcactgtcaccgtttatgaggatgaatcatgtattaaagtggtttaaaaataacaatagatatactaattacatggtagaattttcttcagttttttgtttcatcattaagtacactattacagtttgtttatgcttccatagcccagttagtgtattattcaaagtccacatttatataagactagccctggtttatttgtcatttttgtgaattttaagatagcataggcccaaagtagaacctgtatacatacagtaatcccaactatatattttatgtacctcatccatgctctatgtagagaatgaataaatgcataatatatcagtaactcattttcttctcatccagcttagttgttgctgaatattggagacacttttggttacagtttaagtgaaacttgccagcttcatcctaaaatgcatgtactgaatggatttaacatttattagctttttccatgtttatttttc

SEQ ID NO: 10851 - DNA, 1050 bp, Homo sapiens
attaacctttatccccattaaatcagattccatgacttgcccaaaatcataagctagagtgaaaaccttgtattaatggattttctttcatcttttaaaaattctattttaacttctttcaaagttaatggatcattctgttcttagagtttggctgcagtctttgttacctgaggaatatcagcttctagctatggctctaacaagacagcaaagtgaaaacaaaatgtccctacctattctaaaatgcataatagttatacaattctatttttatttacaaaatattataaatactattttacagttacaaaattataaaagtagctcattataccaggctttgcttctgtcttaattttacagtaggttttgcctctgtcttaattttatgtacatttttcagcaagtttattcattctgcaaagatttatggaactcaggatgcaaagataagccatgatgctaatgcccacaatgtagaattcttgttcaaaacttggaaggaaatgaggttgagtataaatgccaaaaacatttctaaaattgacctaaaggtgtcattatgttgttgaaacataagctgataaatctttgaattaatggtaggaattcagctactcagtgccatttgtaactttgtaagaacacagttaaccattgataaaatccagatccttctatctagaagttattttaattttgatttaaaatttggacgggtgcggtggctcacacctgtaatcctagcactttgggaggccgaggtgggcggatcacctgaggttgggagttcaagaccagcctgaccaacatggagaaaccccatctctactaaaaaaaaaaaaaaaaaaaaatacaaaattagcctggtgtggtggcacatacctgtaatcccagctactcaggatcctgaggcaggagaatctcttttacccaggaggcggaggtcatggtgagccgagatcgcgccattgcattccagcctgggcaacaagagcgaaactccgtctcaaaaataaaataaaattcaagtatattttagaatag

SEQ ID NO: 10852 - DNA, 1029 bp, Homo sapiens
tgtttaactgatgtgttgttccaaatacctttacatgtaattattaagtttgacaaaattaatttattaattaatcaggttggtggtaaagtaacatgagggaactacctgggtagatggaaacattctgtatgttttgattgttacatatgtgaatacttttgtcaaaagtcgttgatgtataactaaaatttgtcaatttattcttcagtgaagttttttttttaatatcctcacttccaaaaagcagttgtaggcacagagatttaaaaataaatggtctagtctgaatgaaatttttaattgggatattgttaaaagacaaacatgtgtttcattatcacttaactgactaaaaagtagattaaaccagtcacaggaggtttctaatttgataactaaacaaattttattggcaattagactgaaaatataattgtctagaaaaagagttttaagatttagttttttcttacattatattaataaatttattaattttgagattaatgaacttttgttgtagacttagctgaaccagtaaagtagcatttgtcaaccacgatagaaatgcttattttctgtatatgaaagatgaaaattaagcgttacaaattaccattataaacagacctgtcgacttacaaatggtaaagctttcttggccttttactatatacatcatgatggtcttttgagtgctttaactcaagtacagagcctgctaaaacaaatatttttctagaggcagtaattaagtacaacatagctggaaatgttaagcttggtttcagactacctttttagaagctaaggagacataccaagtctttgctgaataagtcttagtttgcatatccttgagtaattctacatgtggtattatactgtgagaaaatccaaaatagagtctctataaatgtcaagattacctttaataaaatatgtgattaagtgacacattcagtatattatattttaatacttgtagagaactaattttttataaccttacacagaactgaatat

SEQ ID NO: 10853 - DNA, 1041 bp, Homo sapiens
tagtaatgtttcaacatgagagtcatgattttaaatgataatatttaaagtcatgcattggagaggtctcggaaggaatgagtattatttttcttactaaagcttgttagaagtaactggagagtgacaaaaatgcgcattttttcagaacatttaaaaagtgtgatagtgtatgtttcaattgtcttatcattacttttgatctgtttgggttagttggtttttaatgtacttttaaaaaaacgagaatcacatgcatattatgccacttctaaagtgtattagcgtttattttgaccatctatgttttgacaatcacattttttttaaacatgctctccagaaaagtatagcaatggaaattttagtggtcgatagtgattttcatttaagagtttaatattctaaagttctaggaattctgattaattgattaaaaacgaacaccttagtatttaatgctacaagtaatacagagtcctggatattttgaaaatctggcattagattctgtttgacattaacgtctagttaagaaaatatcttcgggtaaagtagactgtataaaccttagaaaaattgtgttgaactgtgtaggcatgggtaggaaggagaatgtcttcaagaaaattaaaaattgatgtaaactgcacaatgaagcatgtgctatttttaccattttatgctcctctgataccattacatatctgaaagttgacattagtttataaaatcagcgtttttcatttactcagtatacacgtattatgcttgcctaccactgtacaaattagatgtcttccatttcattcccacaactatggtgcaagataggtattattttgacttctgtttaacagatgaagaagcaagttgagtatcttactcaggacagtaaatacagcatggaaatggtgggctggatatgagcaaaggttctcaagtcccctattatttccactgaagagttaaaataattcgccttaaataagttgaggccgggcgcggtggctcaggcctgttaaccccaggactttggga

SEQ ID NO: 10854 - DNA, 1031 bp, Homo sapiens
atttgtgtttatttcctctaggctataacattttaaaagtaaagatcaggccggacatggtggctcacatccgtagtaaaaatacaaaaattaggcgcatgcctgtaatcccagctacttgggaggctgaggcaggagaatagcttgaacccgggaggtggaggttgcagtgatctgagatcgtgccattgtgctccagcctgggcaacagagcaagactccatctcaaaaaaaaaaaaaagtaaagatcaggtctcatatatacttgcagaacttgccttctgcactcactcagtatgtcgtagcctgtattcattctcagtaattggttgaattcaacttaatgtggaaatacctgattgcatatttctttctcagtttcattagtgtggctgattaaagaaaaagagaacagtttttttttgttttgtttgtacttcgagacagggtcttgctctgtcactcaggctggagtgcagtggtaccgtcacagctcactgcagcctcaaactcctggacccaagtgactgtcctgcctcagccttccaaatagctggagctacaggcatgcactaccatgcccagctgcttttttcattttttgtagagatggggtctccgtgtgttgcccaggctggtctcgaacccctgagctcaagcagtcctcccaccttggcctcccaaagtgcagggattacaggtgtgagccaccacacctggccatcattacttttcataaatattttttaaagtacaaagagtagatgaattggcaatagattttttagtgttttaaattaatcttggaaattgttatatcaacatgtgttttgaggtgttcagtcaagaatgacagtagtcattcttgtcagaaatgcatactgaaatcatctgatatttttcctcaaaatttccttaggaaagatctttttatgatttaatactaattaaaccttcagatgcaattgcttctttattaaatggggggtgttcttcatagtggatttctttttttaaacataccatctttg

SEQ ID NO: 10855 - DNA, 1032 bp, Homo sapiens
atttattcttggtttggatacattactggggttatagaaccctgttttgtcatattaccagaattacttttctggttccttctcatttgtttagactatttcggtggaaaagactggatctcagggcctgctgtctcccacttcctctagggatggggcttcctgagagctggactgcagtgattgttattgctcttctgagtgtagccatccagcagcagggctactaggctctgggatggtgctggggaatgcctacaaggagtcctgtgatgtgattcatcttcaggtctccgagctgtggataccagcacctgctctgctggaggtggcaggggagtgaagtggactctttggtggtgttcggttgtagatatgttgagtgtacttgctttcttgaatactggttatgctagcaatgaacttgtaatgtggacacactcaggacctctggttggccaggatgtcgcaggcagtggaattagctgttgttttccgcttcctgggatctgggttattctgtcatgagttgctctaatggcctgaattggttggcctccaaccaggaggtgacactttgaagagtgcaccagttgcagtagtagttaagtagggagattgcttgccctaagttggcctgggcaagtattttggcttctggcgagatgggtggggctatgtttcctgttctgctaaaggggcaggtagagaaataccatcaggtgggagcagggttaggcggaactgggctcagactcactttcattaggcggggcttgccacagccactgtgggagatagggcgttggttttcaggccagtggggttatgttccataggggattttggctgcctctgctgtgtcatatagttcaccagggaagtggggggttgtgagagtcctggttgcgagagacctcattcagctcccatgcagtgggtgaagccactctcactcccttggtgtactgctcagaccttgccccaggcttccctgctgagaaagcaaggccttcagacctcgcccctccc

SEQ ID NO: 10856 - DNA, 1021 bp, Homo sapiens
gtaatactggacatagataagtatttgaactaaagtcttgaatcatttctacctcttttttaacttagtgtgcaccatagagtaagtaaacatttttcatagagacgctgagggccataaggagcccccaaaatatattttgtatgtcaaaatagagtaattattaatggataccatataagaagaatgtgtgatttttttttttatcagcatcagtaaacatataactgttctgctaatatacttagtaatatctatgatttgcaagatgcttctgggaatataaatattcataaatatacatctctgtgttcaaaatggaaagtgtgagttgacatagatatgcagtgaagtgtgaggacagcctcaagggagaattagctcttgtccatttgtggcagatttagagagactttatgaggaaagttatgatttttacaaataaagggctgtgttgtgattttagcagcttacaattggtagaggtacctcgattgaaggaaagagcctgaggcatgtgatttttttaaatgctattatctagatgaacttttacaagatgaaccgcctggggataacaagatgaatatatttggtttttaacatgacacatttatatgcttagagtttggtaagtcaaaaactaagtaaattggttaaatgactaatggaaaagtcattatccatccaactgtggatattttctgttttgttttgttttaattaccacgattcatttgttagaagacctgcaaatttttttcccccaagatataattagaaatcacacacttataccgcagttaatttgtatatattaattctggtgctacctgaacattctgcattctttgttaaaatagcacatctgtcaggtgactcgggtagttaaccttttgatttcttaacattgcaagtacagaaggctaaagaggcagtatttaatggatattgtagagggcggcatatgaccaacactgagcatgtcttttctaagagagaggctagatctaattgttta

SEQ ID NO: 10857 - DNA, 1077 bp, Homo sapiens
acttcagtcagcagaactcctcaaaagtttctagccagccaaaggccaaagaagaatctccttctaaagctggaatgaacaaaaggaggaaattaaagaacaaaagacgacgctcattacgtaagtgttacactgagaaaatctggtgtatttcatggttttaaaagatatcttagacttttatgcaaatccactttgaacttcaactcctcttctattaaaagtaacaaacaggtaggatgcctgtctgtcagtgagagtgagaattcagtggcacatgtttgtagtagctaagggagtatatgtggccttcaaatataaactgtataaaattagatttgggggctactctgattctcttccaaaataacatttaaaatatagtaacattggtatttctagaaatattttagaaaatttgaacatgttaaaagtaaatatcaagtgaaagttaagtaatctatctactccaaagtagtgtgtgtacctgagctgggaggtagaggctgcagtgagccgtgatcgcgccaccacacttgaacctgggagacagagtgagaccctgtctcaaaaaaccaacaacaaaaaaaaccaccacaaagcaatgtgtgtggataacaaagcagtgttgctttttttttttttttttttttgagatggagtctcgctctgtcagccaggccggagtgcaatggcgtgagacagggtttcactgtgttggacgggctggtctcaaactcccgacctcaggtgattgcctgtctcggcctcccaaaatgctgggattacaggtgtgagccaccacacccagccgatagcaaaacaatttgaatgtaatgggtgtcatagtacctagtctattgtaacatatgtataatgtttatgtgtttacttaccaaaatgtatccttgatgtttaggatagaaaataagtagatgataaggcttgtaaatgctgggagtaggaacagactttgcaacctcagagtgtagctggtcactgcttctttgtgtcagctggttagtttgtggctttattttattattattattatttttttgatggggtctcacactg

SEQ ID NO: 10858 - DNA, 1030 bp, Homo sapiens
aaagcaatggcagtacggtgtaatacatgctaatgtagagtaagcactcagcattttgaagacatggactagagacttttcacccattattggagttgtgggggaggggcaacgcagaaaaggtgataatgcatgtgtcctatgtataattgtgtatgcgcatgggcagacacggcatatgccaggcaggaaagtgttgggatggtgggagtaaaaatttgatgtgaattttatttgacttaactgagacctatagttgcctaggttaattgcctgagttaaaatgagtaatcaaaaaatgaagcgtacgtaacttaaacatttttgctgaatatgtaaatgaatgtttagtaatttgttttatatagagccaaagtcatactttggagtctagatatgttaattggggtttctggtcacatttcttgaataaaacacatttaaatgtgtacataatctaatggtttgcagcttttatttattaaagcggagccagaacttgtagacaattgaaaagctattagagataccctaatgagacatgttacagtttttgttctcaatttttactgtaattctgcagtacatcgctttttaaggtagtgactttttttttttttttttgaggtggggcctctgttgctcagcctggagtgcagtggcgcagtcacagctcctgggcaggtgatcctgtcacctcagcctcccaagtagctgggactacaggcaagcaccaccataacctggctaattttttgtattgagacaggatctccctatgttgcctaggctggtctagaactcctgggctcaggtgatcctcccaccttggcctcccaaggtactggtattgcaggcgtgagctactgaggaaatgacctttagtaagccttccaaaagctatgaactccagttttcatataaataagtctttagttttagtagagtgggatttgttttgttttactgttgtgtgcccagcactctaaaatggtatctgaatatgataactgttcttctgtaaaacatt

SEQ ID NO: 10859 - DNA, 1016 bp, Homo sapiens
aaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagc

SEQ ID NO: 10860 - DNA, 1067 bp, Homo sapiens
tggaaacctgcccttgatcattcatccttctgatcttgacttgagcgtcacttcaaaacggcctttcttggtgcccttttgtctaggttagtccctcctgttttaggttaatgtcctgtggcacccaagtacctatcatgtttgtttctatctatgtcaacagtctgagcggaagagaaagcccccctgggcagaaatgtacaaccatggctctttccgggcaatgtggaggacgatgggctttgggccaacatcctggcatggcacagtgagcacagcctcttccctagactgtaggttccatgaagccaagggcctgtttctcttgccctccccattcccctttccattgtttgtgttgtctggcactcagttggcataaaacaaactgaagtgaagttgcaaataaatgttattttcactggtattcttgccttttattatggagaccttcaaaactcagttttcagttaccacaatagcagatattttttgactcataagacaaagctggagataggtgtgacctggcccttgttcataagcctgggatgtgatttgattcttaactcattgcatgtggaaagttcattgatgaggtaattggagctcaactcctgatcacttgagcaaagataataacactgttgagaatctgttattagttgctgtggtgagaaaaaccaattgtatctaactggtgtttaggttttactagggtagaatatattttggtgtatcttgagtatctaaagaactggtctatttctggttaatgggataatctaggaatttagtcaaagtatgctcagcatggtctgggagcttattagaaatgcagaatctcagaccccacctcagacttattgaccccagaatatgcattttgtttgtttgtttttggttttagacagggcctcactctgttgcctaggctggagtgcagtggcacgatcatagcttacttcagcctcaatctcccaggctcaagcgatactcccacctcagcctcctgaatagcggggactacaggtgtgctctactgtggccagtgagttttttaaaaa

SEQ ID NO: 10861 - DNA, 1026 bp, Homo sapiens
tatttttaatgactgaagattaaggtcctactgaacatggagacacgtaaaaagtgttgggtaaatggaatgaatgagagaacaaacctgccatcctcatacagtttgattattgcctctcttgtggaggtagtcatgtctaataacccatgggacatttagacaaacattagcagactccatgaccaatataggaaaaaactcatactaaagctgctcctgcaatgcacagattgcctcaggaagtgctagtgagttttccatcatttaaggccattcaagcagaatatggatggcctattgttccttcagcggggatttctgcacagggaaggaagtttagattgtctggaagagtctatgatgcaaaaggcagatggggaatctatatcatcagagaggagagaggacaatttcggtgggaatgcttaagtaaggcctgagagcatttagctatgattttcggcacatcgactttggaagagagtatgacctttgctgggcttatagacaaaaatgaatgagtgctgtgatatatcttcaaaaaagtaacactggttaatcttacatggaaaggataccataggaaggccgtgtgtgtgagtgagatacagtatgagtggtctctttcccaccctatacccaggacagttcacatagtcaaattccactgggactctaattgagagagcagagctgtttttcttaatgaaattcaagttttccccctagagatgagctcagaacaaaaatgggactatgttttcttatagaacagctcaatacaggtcacagtgggataaatttcacatacttaattgaatctttttgtgaatggcattctttaatgaatttttaatagaagatacagtgttttcatttagtagcaataaaaagaattgcttcctaaacattttaatagagaatttatatattgaaagctgtaatgcttactcaagaggttataccatgtttattccccaaaagcagatagtgtatcagtacgtggcctccaggtattgtcct

SEQ ID NO: 10862 - DNA, 1048 bp, Homo sapiens
tgtataaatatatatttgttatatagtagcaatatatatgcttagtttactccctgttttccaaatattcaacattattaatttgcaaatataataggcaatagtagtatcttgtcattgtttatattgaatttcttttacttccaataaagttaaatgtctttccatagatctatttattttgtaagttgttctcactcttccctcagttttttactagggttgggattctttcaaatttgtaagaacccttgatatcttgaagatattattctttacctaagtttactacagatattttaccaatgtgacatttgtgcaaatactctaaagttttatatagccagatcaatttgtcctcttttgtaataaaaaaaaaaagtctttaaaaaaagatttacggacaggattgacagattgatagctctttctcgattccgtgggtggtggtgcatggccgttcttagttggtggagcgatttgtctggttaattccgataacgaacgagactctggcatgctaactagttacgcgacccccgagcgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactgggacaagggcatggcctgtgtgggccgcaccaaggaatgtaccatcatcccgtccaaccactacggacccatcccggggatccccgtgggcaccatgtggcggttccgagtccaggtcagcgagtcgggtgtccatcggccccacgtggctggcatccatggccggagcaacgacggagcgtactccctagtcctggcggggggctacgaggatgacgtggaccatgggaattttttcacatacacgggtagt

SEQ ID NO: 10863 - DNA, 1115 bp, Homo sapiens
gtgaaaagaaagaataattgatttggtcaaataattgggaatgtggtaagttaatagtgcctcctgccgaaattctgaagtactgtaaatgtaatgacctaaaaggaaaggaaaatcaggagaggcattgctataaaggcagcttgggataaagcataaagggggacttttgttatattaattgagaggatgtaccctgatacagtgggaaagtgagattcatttttttcctttacaaattcaataaaatatttacatttttagaatattatcgaagcctcatatttcagattattgcccactattacaaaatactacctcattattttctttttaacataggaatttcagaaacagcttactaaagctaaaagaataatgatcatagggaacggtggtattgcacttgagttagtgtaagtatatatttttaaatatgataacatttaaattgtttaaaaataatttgtttttaaattaaacaattgctttgtgattcttgtgatttgttggcagactggaaaatgttttttattctgaaaatcaaagataaatataattttcatatgttttcaaggggaaaaatccaccatatttttttagctcttgtggaatccgtaattgtagaaattttattataaaatatatatgttttgggaatgctttaggtctcaaggtgattggccaaatttggcccataaatgtgttttataagtatattttatgtttaaaaataattcaaatatttacaccttttgagatttctagtgatagccctcaccactttttattgcttatatgataaatcctgctacactcatttatgttacctgtctggccagtgtcacccaaaatgtttgtgactcctgttttaggatatgtggttcttgcagctctttttttggtagcttgggaaatgtgaacacattaattaattttcatcttaagacgatattacaagttcaaaaaccattgagaaatatcctgctgtgtcctgcagaagattgattcacttcatgattttatcctctagcagatgattgacatgaaatagtctggatctttttcaggccataaagttgagtcaaaccacaaagaggacaaatttgaatcaa

SEQ ID NO: 10864 - DNA, 1032 bp, Homo sapiens
gaggtaacttagtgaattgtgctttataacattaatagaagagtacatctgtcaccttagaagttaagacttttcatactaaaaaaataagacctagagaatgcacagtcaataaaagtattaattttatatacaagataaacatagactttaaagcttacacctcgtctaccactgtatattcagtacctggaacagttccttgcatctggcagttgatcaacaattctttgttttttaatgaaactaatgaaacatgaaaaacctagaatattaatattaggtaaaacagtattctttgaaacttcggagaggtgattttaggactctagaccaaatatttaagtagatttatagtttaggtaaatttgtagataagtccataataagtaatcaagaaattaaaagtgatgcctgaccttctgaaaatttggttttgagaatactggtaccatgattttcgaaatatttcttgttgccattgtgacaagcagtatataattggataaaggatattgattgtgcggacctaccataacatttctaatgcagtaaagaaggaatcaattttaagaggaagaaagaactacagatattgtgcatttaaataataattatagaatgtgaaaggagataagtaattaaggaaacctatacatttatgtctgatgcgagagagcttttcaggaggaaaaaaacaaattacatattaaaaccaaaggtttagaatcccgatttatcttttttattatagctatgtctgagaaatgctatctcccatataaggcttagaaattttcattcatgttttaaattttgaaataatttgctgataattaatttgttataagagctaaataaatgtcattatgaagttaacctgcaatgttgggtacctgttttcttatacctatgaaaggaaaactggaaaattttcttagtttacagggatgttaatgtgactttaatttttctctacccttaaccatataccttatattgcagaaattggaatgggattaacaggatttg

SEQ ID NO: 10865 - DNA, 1035 bp, Homo sapiens
gctttcccagttatgtgggggttttagtaatgaaggttaaaagccaaagctgatctttgagatgaataaaaaatgggaagtcttagtatcatcgacaagcttggagtaatacacaggtttcgtggtttagagagctttgtggtataaatactagtttttgttgttgggttttgttgtgttctgagatattctgagctggagatttagtgccaagggtctttgatgttgtttttctagatatttataaccctaaataatggcatttgaaatcacacatttttatgttttaaaacaatacttaaaacaaaataaatgatcttttgaattcattactactagaaaatgattgtgattttctttgaaacacgcacatacaccatcaacataaatacttgtctaatttaaaaattctgctttctgtttaattctttattttgacttctgcagatccataacagaatcttattgcttaacttctgaattgtattcattgtagtattttcatccctatctaactctgtgaagaaaacagctttttttctgtactcgtcttaccacaatcaacacagaagactgctgtgaccaaatgggtggggggttttcccgatatcgcaatcagttagttgtctgcaacagacaacagctgggtgtcctcccaatatagttctgatactgtctacatggagatagctccagatcacacaggttgagggctcagtcccacaactgtcctccactcccaatgatgccagccacaagccccaggttgttttacccatgcttctgactgatcagctctaagttggggttcccacgatcccctgtttggatcagactaatttactagagaggctcacagagctcaaggaaacactgatgtttactagtttattataaaggatattacaaaggatacaaataaagagatgcatagggcaaggaaaggggggagggtcgcagatccccccccaccctccccaacccaccatcctccaagaacatccttgtgttcagctatccggaagctccctgaac

SEQ ID NO: 10866 - DNA, 1021 bp, Homo sapiens
catctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctattaattggtggtcaagtatatctgtgttatgaagttctaaaagctaatttagcattgcaaaataacctcatttttaaaaaattagccttatatgcagtgttctatttatcaaatgatcttcacatctttcatttccaaattgttgaaatgtactaatgaatacaaatagacttcaagtaagcaaaaatgttcttaattttgaaaactgtaaaataaagtcacttaccttgggcaatatgctattttttaaaaatcagactcccagtttgtatattatgttattcaatagacattttctgagtaccccttgaatactaaaagtcctgtgttgaatgtgggagacccaggagaacaagatatgtgccatctgctcattaagtgcttagaatgttaacattgcttttaaattcttagccgtatttccacataactt

SEQ ID NO: 10867 - DNA, 1750 bp, Homo sapiens
aatgcaattcacattggactcttttccctgttgcagtagtaacagaatacaatctgtccttaacactttagtcaccgattttgtgtgtctttgatagcagtcctcatattcttacaggtttaaatgtaagtcagaaggagtgctctcctcgaagctcgaagtttcattgtgcctcattgggtaccctgctcattcttcaaccagtcactatggcaagaggaacatagtgcttgtattgctacagtatagcttcatcttccactcttgaaaccagcgatggagcccccgctgaaaaacatgacaggttcatcaagaggaaaattggagtacaattaccaaaagtgagggggaatagattctgttggtcagaacccaacaaccaaccattacagcaggcattggggattttgctatgaaatgattggaaaatatgtatatatattgaccaatgattttcccatttccacattttagcatttgtacaaaacttcttttaaaaaaagactctagtatcaaccttttctgtaccaagtagttttatttaatacttctagactagagtgtaaactcattgaccacagggataatgttttatacttcttcaagccacctgtggtatctgtcactatatcaatggtggcgattagaagaaataaaattggctgggctcacacttgtaatcccagcactttaggaggccgaaggcaggcggaggccaggagttgaagaccagcctggccaacatggcgaaaccccatctctaccaaaaatacaaaaattagccagttgtggtggtgcatgcctgtaatcccagctactcaggaggctgaggcaggggaatcacctgaacccgggaggtggaggttgcagtgagccgagactggaccactgcactctagcctgggcaacagagcaagactctgtctcaaaaaaaaaaaaaaaattttttttctaaactagcaaaatgaatgtatttctaacttaacagtatcatgtaacaatgtgaatttactctgttcaagttttgtggctatgtgctatttgtcatcctttccaggcatctggagagattaggtcaaaaggtaatagaagggaccagcacttcttcctccatgaagcctttactgatcccctcagtgaaaagtaattgtgcctttgttttcccatacatagctacgtcgtttgtaccttcatttagtgcatgccctatgcagggagataagatcacagactctgaaatcaaactgtggatttgaattccagcatcaccatgtgttaactgtgcaaacttgggtaaatcgcttaacctctctgtgcctcagtctcttcatctacaaaatgtactgaagtgtgtgcctcacaggcttgtggagggaattaagtgagataatgtacgtgcagcccttagaatagtgcctggcacatagtatgtaatctgttattgacattttcctcttgtttagaaggtttttactatcttccatgcttgtaaaatgggaaactctcccattgcttgtaaaacgggaaagttgtaatgatctttaaaattatttctggtgctaacattctttgactttgaagagttagtggaaagatgtctttattctctttttcagtttcagtggccagcagactttttctgtaaagggccagatagtaaatattttaggttttgtaagccagatcgtctttgttgcaatcactcagctctactgttgtgtatgttgtgaaggtggccatgacaatacat

SEQ ID NO: 10868 - DNA, 1081 bp, Homo sapiens
gatgagtagaattaggaatttgttaatcagcaaataatatttcttgtttattcagtaaatataaacataactacttttaaatgggagctatctaatgtttcccaaaggatcttgcagcaagaaagattccctagataataggtgtaccattttagaaaaggacgatatcctgtggatttttaaaatctagcttattcttatgaatgacatttttgattcaaaataacttaacgtttaagtgtatttttttaaatgaaagctagctaagataattataatttaccagaaatcctaaatatgtattgctaagcagcacaagagagaggttatagactttcctctggataaattgaattataggagaatcttagagtagtatcagacaatatatgttgtaatttttacctgtagatagaatcctttctattgtagaaaataaaatactgtgtctcacctttattgggctatgagaaataaaatgagctttgttttaaagcatcatgattttaattcgacagtcagttttcttacttggaccttcagaaagtcaaaagatgactcgtttgtgatttggactgtctacaaggtcaattattatgaaagatttctgttttcttcactttttaatttttcccttcttcctccaatcctttttttttttttttttaaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggttggtatctttttattcacccatagtaaaatggaccaggaattaattatttacttatttttaaagaaatgacaaagcacatcctccaaatgggtatgattgtagggaaataggaactcttttaacaaacactgctgatcaaactgttaaactgggacagtctttctggaggttagtttgataataggtatcaaatgtagaatgattattagcacaagctgtgaagtcagactgtaccactgattagccagttgtga

SEQ ID NO: 10869 - DNA, 1064 bp, Homo sapiens
ccctgtagaacagacataagttggagaaaaaaaaaaaaccaccaatttattttaaaaactttaaattaatggtttattttaaattaaaccattaaacaaaaattaatggtttatttattttaaagctattaaaataaattaatggcttattaattttctttacatcttgtcctagttttactctcatccttccggttttcctgctattaagtttattttttcccactcctttgcatttacacatccacaaaggttctaaccccacttcttgttctttcccaggtatcacatctctattcaaggtttcagcgacaatctccatgcagacgaaactcaaatataatcttcaaccccaatactctgttgtgagttctagtcacatctcaaattcttcatattataggccaggctcctggacttcatccctcaagttgctgattttatcattattaaaatcttacagcttttcagtttctcctttttatctctattcagataccaaagcttgagtttgatactactaacccagtgtcctttcaatttattcagtactgtcaccagattacttgttcagatttttgctagttgttaacctttttgaaatcttttagtgactccatgctgatgaccacagaataaaacatacttcaaacgaaacactgtagcctggtcacaacctaatatttccagccgtcgttcctacaagttattgtgggcctcttcaccccagtcatagcttattctcaagtcctacctttatcagcatgaacaattcattcctcaaaaaacttctgctaaaatacctccaaaatcaatttctctgtatgagtataaaccatattggagtccttgtttcgtttcaatgactccaagccaagtacaaggagataattcagttctcactgttacaactacttcctgtgttcctagcagtaggaaatcttactcaagaaaatatcacatgttcagctccaatatgtaaggaacttagaagttgccattcccatccttacatccagaaaaactggacaaactggattttgtcccatccttacatccagaaa

SEQ ID NO: 10870 - DNA, 1029 bp, Homo sapiens
atgcatcgctaggtcggttcttaggcagcaccacacacattgttttgtttgagtcgatatttctgaattattaaagtcgtcttactgaaattaatacctgatactagaaggagcagtggcttgtgactgtttccttttcatgagacaccgtgttgatagagaaaaaattgggaggaaaaaaatccctgagactctaggagttttctaataagttggaagttatgatttccactacgtgattttttttgaatactaatctgtttttagctttagtttcaggaactagatacaaaaatagatctctttttctccttttcccttgcaaacaaaaaaaaacagtaattttcaagattgggatatttgggatttgttctaaatctgagcaataatgtaagaacattcatttgaattagccaaatcatctgcctcgttttgatgactaatttattcaccaatatttgttgatttatttgctaaattcttcgctaaactagccagccacccacacaaagatgaataaaacatgagcagtgcctagggcccagaacagttcctgacacttgggttttcatgtgttagtttcagttcttattacctagaagagtttttaagcagattattttaaaggacccgtatgttttggagaagaaacttgttagacaacaaattttgaaatttaagggagtatttgttagccgagaatataggaaatagtgaatccaaagtgatttttatgtcatttaaaaaatatatttcctttaaaggaaatgtgtcttccaaattgaaattcagtacttgtttagtttatcaatttgtttgtattttattatataagactctaaaatttattaagatgatttgttttctggcagtcacttatacataaaacattattaattaaaaagtgctacttcctggtaaactctagtgttggcagatcagttacttttaagcagtgactttaaagtttaaagctttgaagactggaatttcctttgatgtatttgtctgtagaatagtaataatagc

SEQ ID NO: 10871 - DNA, 1024 bp, Homo sapiens
tacacaaactgcgtcacatctttttggggactgagcataatgtggaaagaggatggtttttgaatattatttccagccatttataacctttggcaagttttaaagtctctataaaatggtattaccttggaaagtagtcatgagaattcaatgaaatacctacaattacgcatcgcatgttttggtactacgttcttccacctctcatttccaattctcccatcccaactgagagaattgtgagctcctaaaattcagtaattctgacatgtgttttttgtactagctgtaatgctagttttcagtaagagtccttgtacaactaactgtagcacaaggtaggcatagaagaacgtaggacagaaggcttcatagaggtgggggtacctgagctaagctttgaagggtagatgagatcagattgaaaagggaaacatttctgagcaaggaaaactatctcacaaaggcaatgaagctagactttgagtagcttactcatcatttaggacatcatgggaagccactggatatttttctttttgtattttattttattttattttattttttttgagacagagtctcgctgtagcccaggctggagtgcagtggtgtgatctcagctcactgcaacctccgtttcccaggttcaagtgattctcgtgcctcagccacccaagtagcttggattacagatgtgcgccaccatgctcagctaatttttgtatttttagtagagtcggggtttcaccatgttggccaggctggtctcgaatgcctgacctcaagtgatccacccacctcggcctcccaaaatactgggattacaggcatgagccaccgcacctggcctggatatttttaagcaggtaaattatatcatgtattagagaagtgacaggcaacaatgtagagaagggttgtttgagggaaatgttttaaattgggaaataatgatcactcaggacattggttttgaaactagtggttaccatacattaataggatgccaaatcaatatagt

SEQ ID NO: 10872 - DNA, 1054 bp, Homo sapiens
aatgagttgatgcatatttaattttttaaaaaaattgttataaaaacataaaaatttattatcttaaccggttttatttggtgtgtgtgttattgctatctagctcatatccactgtagtttgagatgatactctaagtgattttcatcctttgatatttgttgaggcttgctttataatgaagcccatagtcaattttggtaatgttttgtgtagtcttgaaaagaatgtatgttcttggccaggcacagcccagcactttgggagcctgaggtgggcagactgtttgattccaggaattcaagattagtctggccaaccctgtctctacaaaaaaaatgcaaaaagttagtggtgatgcatgccttagtcccagctactcgggtggctgaggtgggaggattgcttcagcctgggaggttgaggctgcagtgagctgtgattgtgtcactgcactgcagcctgggtgaacagagtgggaccctctctcaaaaaaaggtaagaaaaagaatattctgttgttgagtgtagtgttctgtgtatgtcagttaagttgaatttttaattttgttgtttagagctcttactacataatgatttttctctgctaaaaaaaaatgaggtcttggaaaaaaatagtgtcatctataagcattaaaaaaattaaaaatgaggtcctgaatggtgtgctcaaatttccaacatttattatgggatttgtttaattctgtaagtttttgctctatatcttttgaagctgtattgttggatacatgcacatttagaatttttatatcttcttggtggatcaatcccttagtcattataaaatgtccctccttatctttagtaatatttcattaaggtctattttatttgatatgagatagctacctcagcttccttctctatgtcttttgtaagcagcatatagagttgtcctttcatatccatgacttctgcatccatggattcaagcaactgcagattgaaaatattaagagaaaaaaaagatggttgtttctgtactgaacatgtgcagatattttttctt

SEQ ID NO: 10873 - DNA, 1028 bp, Homo sapiens
tctttgtgtatttcagtataaatttgtaaacataaaaagttattttttttgcgtgatcacagcaccattagaacactgagcaaaattagcagtaatgtctaagtactgtttaatagtcagttcataataaaattttacctcaaaaagtatttttatacgtatttgtttgagttaggaaacaaactagatccatgcgtttgtatgtttcataagcctctttaaactagactgtatgctattgactatttattggtggggcgtttgtgtagaaagacctacattctggatttgtatattttttgttgttcttctttgtggtgttttttaatttttaattaattaatttatttttttagagaagtggggttttaccacgttggccagggttgtcttgaactcctgaccccaagtgatcctcctggctcccaaagggttgggattataggcatgagccaccatggccagccatgtggtgtttctttaacccctatattttcttaagaataggaagatctggccgggcgctgtggctcacacatgtaatcctagcactttgggaggccgaggcgggtggatcacctgagatcaggagctctagaccagcctggccaacatggcgaaaccccatctctactaaaaatacaaaaattagccagacatagtggcaggcacctgtaatcccagctacttgggaggctgaggcaggagagtcacttgaacctggggggcggaggttgcagtgagccgagatcgtgccacttcactccaacctgggcaaaagactgagactctcaaaaaaaaaaagaggaagatctagaaccttgattagatttcaaatcataggtagtgcagtgtatttcatattgcatcacatcagaaggtataacatgtcaggttgtttcgtgaaatcaggaggtgacagatgactcctaccattataaaattacctatcaatctttcatctaatggttttattcattgaagattgtttcctgaatactttttctgttgtatcctccacatttgtc

SEQ ID NO: 10874 - DNA, 1027 bp, Homo sapiens
ggcagactgtgagaaatggcaggtatcaagaaagttatatagaaatattgaagacagaatgtataattaacactttggatcaaggaaggcatgttatatgaattaagggcaacatgttaacattagtggttctctttgtttaaatatagaattaaaattatagatgttagataaaattgtattcaaagatggttcttttatgtgaagaagttggtgttttctttaattagtatttaactcatgattttcaatttatctcctgttctctaaagatagataattgctttttttcccatttttaaaaaaaatttttggcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggtacattttcttttctgaatttttccttttgaaaaatagggcatttaagtgcattaaggaaatattttttaaaattgtctttgtttgagcaactatttggttaacttagaaactttctttagctagggtttttgtttttgttcttgttttccctaaaaagatagaagtaaatttctttatatttgcagtttatcatcgttgactctttgcaaaggaaaaactacaagatgttttggattaaccggctgcagagggtcaaggcttctgcttagttttttctagttagtgtttgagttgaagtgttatacatttcttactgccgattgcttattacttaattgttcatgttttcagagttcttgcctattaaaattttattaatttggttaacaattctttgttctttacgttgttcattatttaatttaatatattatgttttctataaa

SEQ ID NO: 10875 - DNA, 1053 bp, Homo sapiens
tccttgtaactaaagcagagagtaaaacatgattgatctatttcagtaacctcaaatagaaacagtaaaataattatagtttttgatcaagaacagtgaaggtttgtcaaggctgactttggtatttgatacaatgttataaacatgttttcagtaaaaatatccttttctatactttttggttagatctacttacttattatttctttcccaaatgccaaagcctttgtttattttttctctacttagatctttttaaaaatatattttttattgatatatcatagttgtacatatttttgtggtacatgtgatattttgatacatgtatacactgtataatgatcaagttagagtaattggtgtatctatcatctcagacatttttttttgggttgggacattacagttcttcttttctagctattttgaaatatacaataaattattgttaactataatttccttgctgtattattgaatgctagaacttattcctctgatttaactgtacgttcatacccattaaccaacttcttttcatcaccccccttcctagatttactcagaatatgtataagtgatactaatgtaggcatatacacatttcataaaaagaatatactgtgttagaaaccaaacatcaatactctgaattctttgacagctggcttgtaataagtgatacattgaattgccccacagttttgcagaggagaagcagagtggaggccgagaaagtaagcaaaagaagatgacactgaagaaccctgtatgataggatattgttagttggcattatgaatagtaacatttgctatttaatttgtttcgctgttaaatttatttcagactgtattctaattcctatggcatttcttattgttaagcaggtcttagtcactataaaacagaaaatatgaaaagaaaagctaagggagggaaaggcaagttttgattaacaaaacgtctgagttacacatgattttaaataggagtgtggttttatttttttcaaatatgtacggtgaaatacttctaaaataccaagta

SEQ ID NO: 10876 - DNA, 1025 bp, Homo sapiens
catagctgtatgcttatattatgattatgacgaaggtatctcatttgaatgtaaaaggcttatgtttatgtttggactagtctgggggaggaagaagaatctaaactgtccttgctgtcttagtaatttacagtttgtgacacagtaaccttgagggaaaaataacctaaatattgtacaaagaagaacagaaaaggctttcagagaaagtacaggtagttgattttgggcatacataggaaattagtatgtttcactgtgatcacatttgaactgaactttgaaggacaaggtagcctgtaggaggtgaggaatggtataggtaaagacaatgagctatagtgcctgacgggtaattccacttatggaaatttatcattctctgttttatttgagcttttttgtagcaatcagttattacggacaccttcagaaaattttttaaaattcaaaagtgtttagaaattttttcaaatttcttatcagatatttcttagaaatttgcctcttgtcaagaacctggctgaagtttaatgacaaaccatccagtaacagacataatggaagaaatgcagtttcaaatcaattgttgcaagtttatcaaagagcatactgagggtaccgtagtggaactggcaccttgtgggttgtgtgcatgtacagttggtagtgttttcttttggaaatcaaaaggacaatatataataactcaaaagaaagttatatgctgtatttctggcagcaacaattaaaagtctcttatattcagatataactaaggtacctcaacacaaaggagaattatgctactgttgaaatgtaactttttgactattgtctaatacatgcaaaatggctgatgcagggcaacaggaaaaaatcagcttaaaaaatagcttaactgtggctacaattaggcagtaatttgctcatgcaaaaactcaaaggggatatataaaaatgaaatactatgggatggtaagattaaagattatttttcgtttcaaaatatttttgttattgtt

SEQ ID NO: 10877 - DNA, 2053 bp, Homo sapiens
cacagtttacattagcgtacactcttggtgatgtacattctgtgggtttgggcaaatatataatgcatgtatccactgttagtagtatcatacagaggagtttcactgctctaaaaaaatcctctgtgctctgcctattcatccctcttttccccttaaccagtggcaaccactgatctttttactgcttccacagttttgcctttttcagaatgtcatatatttggagtcatttaattaagtagcctcattagattggcttctttgacttagtaatatgcatttgtttcttccatgtctttttatggcttattggcagatttctttttagggttctgaataatgtttcattggatatgcaccaaatctattttgttcattcaactactgaaggacattttggttgcttccaagttttagcaattatgaattaagctgctataagaatccctgtgcaaattttaatgtagacatacaaatttttaactcctttgggtaaatgctgacgagcatgattgctggattgtatggtaagagtatatttagttttgtaataaaccgccgaactgtttcccagaatggctgtgctattttacatttccactagcaatgaatgagagttgctgttgctccacatcctcaccagcattgggtgttataagtgttttggattttggccattctaatagatatatagtggtatcttactgtttttgtttgcatttccctgatatgtgatatggaatatcttttcatatgcttatttactcatctgtgtatctttgatgaaatgtctgataaggtatttggtccatttttaaattgggttgtttgtgttcttattgctgaattttaagagctatttgtgtattttggataataatccattattggatatgggttttgcaaatattttcttccaatctgtgctttatctttttattctcttgacagtgtcttttgcagagtagaaagttttaattttaatgaagtccagcttatctgttcttcctttcatggatcatgcctttggtgtcatttttaaaaagtcattgccaaatccagggtcatctacattttctcctatgttatcttctcatggaattttagttttggattttacatttaggtctgtaatccattttgacagaattttaatgaagagtgtaaggtctatgtctagattcatgtttttgcacgtgaaggtccagttgttcagcacaatttattgaaaagtctatcttttctccattatatttcctatgctccttttcaaaaatcagttgactgtatttatatgggtctgtttctgggttctctattctgtttcttcatctgtttgtctaatcttttgcagatatcacactaccttaattgctatagctttatggtaagtcttgaaatcaggtagtgttagtcctccaacttgttcttgtctttcaatattgtgttggctattctgggccttttgcttctccttataaactttagtttttacattttaaaatggactttttaagaatttatttttaattgacaaataataattgtgtatatttgggatacagtatacatgtaaactttagaatcagtttttcaatatcacaaaataacttgctgggattttgataggaattgcactgaatctgtatatcaaattgggaagaactgacatcttggcagtattgagtctttttatccgtgaacatggaatatctcttatttagttatttggtttcttttatcagagttttatagtcttcctcatataaatcttgtacatagtttgttagatttatacctaagtattgtatttttgggggtgttactgtaaaaggagtgcattttattttcaattttcacatattcattactggtatgtaggaaagcaattgactttcatatttttttaatcctgcaagcttgctataattgctcattccgcgaggtttttttggtccattcttttggattttctccatagaaaatcatgttatctatgaacaaagacagttttttttttttcttacctcttattttttttcttgtctta

SEQ ID NO: 10878 - DNA, 1032 bp, Homo sapiens
aggattggtgaaaagtgatgttctttctttattcctgatcttagtgggaaatcttcaaattacgtgtcattaagtaggatgttagctgtagttttttttgtagatattctttatcagattgaagatactctctctttattcctagtttgctgagtttttatgataatgagtgctagattttgcaaaatgctttttctgcacatgtcgataggttcatgtgatttttcttttttagtctgttaatgtattggattacattaatgaattttcaaatattgaaccagccttgtatacctgagataatcccacttggtcacagtgtataatttctttttatatattgttggatttgatttgcttgtgttttgtgtcagcaaatatattatataaaaaataaacatttaaaaataatcttttaaataaataggaaatataaaaatgtagcattttctgttgtatataatatttgctagcagaaaacaattgaggtatacttgattaaagtgtttttaagaattctttttcaatgagcattttatttagttaataaaaatttgatttgtttatagttgttctgaaaaaatttgattatggtaaatgctacataaaatttaccattgaagcagcatttttatctggggtaatacctgaggttggttgttccacaactacagaaaactaggatacagacaaccagagtgaggttaagagtggaagtttaataggcaaaagaaagagaagagctctctgtgcagagaggggtcccagagaaaatgggttgccagttctgtggtgtaatgtacagggttttatagattaacttgaggaggcagtgtttgatttgcagagggcacggaagattggtcggaccaggcgtgccttttgcataaagcatgtagaagctggtggccccactttaatcttttattatgcagatggttctctacttggccagtgccatgttgcctgcctcttttactagacacatggtgacaaagaaaagggaagatgaaggctccgttgtgaacatac

SEQ ID NO: 10879 - DNA, 1037 bp, Homo sapiens
ttccaatccatgaacatggggtgtctttctgtttatttgtgtatttaatttttttcagcagtgttttattattttcagtttacaagtctttcacctcctcaattacggttattcctgagtatttatttcttttcgatgctatcgtaaatggaattgttttcttaatttcctttctagattgttcattgttagtgtaaaagtgcaactgatttttgcgtattgattttctgttctgcaactgctgaatttgatttttagtaaaaactgtaaattttcttaaaatcattctttacaaatttcatgctttgttcagtccttatttataaaaaattttagatgagtatggaacttgtgattaggccatagttaattttttaaatctcttcacagagcctagtttttaagtatataggtggctgccatggttacaattgaagtgtacttatttccatgagaagatttgtgttgtaaatcaacttccttcctttctgctatgatctgaatatttgtgttccctcaaaaaccttttgttgagacctgattccaatgaaatagtattaagaggtgtgtccctttggcaatattagtcatggggtagagctctcatgaatggcattaatgcccttataaaagaggcccaaagaaatttacttgccccttctaccatgtgaaaatgcagcaagaaggtgccatctgtaaggaacataactatgagaaagaaatttatgtcatttataagctaccttgtttatggcatttttgttaaagcagcctgaaaggactaagacactttacatgttaattttgttatataaaagataaaaaagaccagtaattctgagacctgtagatactggcttgaattctggagtgtgagaagaagatgatgtggctttattatcaaagaataggcagtattttaaatggatgctcatttggtttttgtataagaaaacattacttttgttacaattattagtacatgagattattaaaaatccaaaatagattttaatccacctgacaataaacctaat

SEQ ID NO: 10880 - DNA, 1056 bp, Homo sapiens
ggtcttagggaaggtcattcaaaatgatttagtttataaaaataaatgtttatttactcatttgtttgagaggtatgaaccaaagtacacatatataaaaaggttatggattttaatattttaatgtattagattaaagatgaggctaatactgttgcttgaggatgataatttgacaatttacagtggcataaaggagaaagaatttattggtacttgtaattgagaatactgagttcaaacatggggtaaatccagggactgtaacaatgtcattaggaatatcactttattctgtttattcttttacctttttttttttctcacaaactttccttaggactatccataatgataatcagtaggtttctctaaccggtttaaccaccccagggggaaaattttcctaattttctaatagcttcaaacaaagttgatagcttcaataaaattaggattaagtctctggcttagcttgggtaatatgtgctgaaccagtcactgtggcctgaatgatagaatgctctgagcaagtcagggtcatatgttcacttactactgaagtgagtgatgcagttaggattgagatcagctctgtagtaatgacatgaactaaaagtaagagtgatagaagtttctccaaaagaaaataaggactctttagttactaggaatgagataaaaacaagaatattcacaatagtatagaaacataataataaaaatgtgttatttaatgattgatacaatactagattctctgtgggccttacttaagtggctttcaaatgtttttgcatattaaaatcacttgggaaggttttaaatatctcagtgtcctggctgcacaccaggccagttaaatcagaatttcgttagtacctaagcctgtgtaatttgttttgaagttccttaggaaaatcatgctaacaagaactaggtagacagatctggtagagtcaaggttcaaaaagagggatttcaggggacagagaagttcacatgggagaagcaggatccaatggagagaacagaggggcctcaaagagagagaga

SEQ ID NO: 10881 - DNA, 1033 bp, Homo sapiens
aggggtttctgggtaaaacaacctaatgattcttgctgaagatggccagagtaatcagagtaattaatttggggaatggtgaaggataaggaacctgatcagatatcaagggtggggatactcttgctaaactgactcagtagggttcttgctaaaactggtttttacaagagagagcacaggtaggtctacaagaagattcgggagactgactaaagtttcatcaagaatctttgtcaggagacatgacctttatgatacttaagtttttctttttatgcggttttgttttaaacaggctaatagctcgtcagcttgctaaaatccatgctattcatgcacacaatggctggatccccaaatctaatctttggctaaagatgggaaagtatttctctctcattcccacaggatttgcagatgaagacattaataaaaggtaaaattatttttacatttgaaattatgttttacattgctttgctctatgatagggtttcaaaggtaattgtaaagtttcattgtataaaatctggttttctttctttgcattgaagtaaagtaagcattgattctttggctgtcagatagcactacagaaataactgcctctccatccccctcagtgtcccctcccaaaaaatatgccctacaacagcaaggggcagaggtggaagtaggggaacaccacttaaaaataaagagttaggtggtaatggtgaagcaagatttttcttgactttttaagatactgcagggttgagaggcaagtctagtattatatagaataagagcacaagagcctggagccaaactgagattaaatcttagtcctgctagttaacatttctgttgtgtaactcattcaactagggaacttaacctaactgtttccttatctataaaatggaaattacagtagtagtatattaaccatatagagtttttgtgaggattgagatagtatatgtaaagttctttaaaacagtgcctggtcatcacttaagtgttgaggtagctgctgttttaaaaa

SEQ ID NO: 10882 - DNA, 1053 bp, Homo sapiens
tgttgagatttctatctcatgtcttgatgttctctcagaatgtttattggtctcatgacttttggtgactttcatttctcctgctgtccccatttcttcataaaagctcatgtaaatacctaatatttaactttaaatttcagtaatggcaatcactgtttattttctctgtcagcacaatacaagaagctgatttacagctgtttaaggaaatacaaatgagtggaagaaaaggaaagctttttctgggaattaaagagtaaatcaggttttgttttattttgctttgttttaagagttctatacaatataaatagaaaatgggtgagtccccatagtcacttgtttggctctaaatcttatccattctattattactcctgagaaagctttgtagttgtcatgttactcatgttttaatgactgagaagagttttttcattggtacttttaaaaaatttaaataaatacaaattgatttttgtgtttggtaaactatgttttctagggtggtgtttttaaatgtagtttaatttttaactctgttttaatttgtattctcaaccactagttagcagaaaataaaatatctgtaagtcagataataaaaaacttaaatgaactgtaaaaacctgaagttatgaagaaagagtgacctaatataggtactagtttgtttgttttttcattcattcattctggcccactgtgttcagtcttgtacttgaataaaaatgtcagaaacaccacacttttttctttagtttttcatgcttttttgtcttttcccctcccccagcaaacgtgttattgtgtgtcagcattttctgcaaacttcattttttctactagcatttaaatatttcctgtgtcctagggattgctctgtggattgcaggataaaagagggaagggaccctagtgcccctccaggaggctgtgtatcttgtagtggaggagtccaatcactgaacagatacttacatttagaatgatgagtgctctggtgaaggggtacagagtactacaggacaccagcgtgaagattaaagg

SEQ ID NO: 10883 - DNA, 3335 bp, Homo sapiens
aaaatatgcaactacaaatttatcctctgagaaatcttctgaggagtctaatgtattccaaatgacttaatattctcagacaaatgctttaaaatacttggattatctcaagatttttgaagctaataaagtaaatagaaacacaggccattttaaatggtaaattctagttacataaatataatcttaaagtatgtttgtatctgtaacagtgttagaccagatttggtttctacctccccaatgttataaatgttcacttttgtttttataaaccatattactgtaagatcaatagaactttgcctagttaagtgaatggaaccaattaaacaactagtagctttttataatgttagtgtgaacttgaaaaattgtttttggtggaatttttgtctgtggttagaacattttcataaaacagataaagaatgtgtaatactcttaattttttttttttttttttttttttttttgctttctgccttctaaagtgcaacagtatatatcttgtagaactgtgggaggagagaagataatttttctaccttactccatattcttacttcaaactattttgaatagaggttcactgagccattgctgatagactgtgcatagctactagctgtcacactattgtaggttttttggagagattcatagggaagtgaatgtaaccaggaataaaggctctcactttagctctgggactatgcagtggatcttgggaacaaaataagatatctaatctattttccccattctggctagattttggttgttgtgatgctcctacttcctgtataggtttttgggatcatggtgcaggctagtaataggattcagaattgcttcccttttatatcgaccatgtaagggattctaaaggagggtaaatctcaaagtgctctgaaatcatccctctaaaatctgtcctgtggtgtgctaagatgtctgttgcctttttatgttaagctaaggaacttgaatgccttacctaataactcaactagtagtaagctcattttgtaaatatgaaaatggctgtaagaagtggcattcatgtatattcaatgttagtcaatagaccatagtggcctggatgctttaacaagccaaattccgcaattttttttccttttttccccttcatacttgtatgatctcacctgaccagtgatttcttttcctcctaaccccatgctaccaccattttctggaaatcaaagagatgtggtagtaaatcatacagtacacacgatcatctgagatcaatatgagcacaaaactcatcaagtaggtctgcctggaatgtatataaaaaatgtaaataaaaatttgtaaattagtgtgaactgtatcttgcatatgagactgtgtattgttttgcattctcttcccttttgtagaaatttttctgtaaggaaatgattcagcttgttggttttagagtaaaaatagccaacagttgtggctacacagtgagatcacaggaactggaaatagggtttgtcggctttggttaatgtcagtactcatttatttagcctctcagtgcttaataagacttttctttattttttagttagccgttaggttttgtgaggttagattcctggaagcagtgaatttatacactgttatattaatagagctccgttctttgagtcatgattccaagctaaaggaaattaaaaatgtaatttaataatttcctatttttagggttgttaatttttttctacaaaaaaaccttgaaattttagatatcccaatgtgaatctaatttccatatatacagaaattagacaaataataagtctttagttcaacttaagcatatctcaaatgacttctctaaatttaaagttgatcatgataggatcataaaagacagaaaagacttaagtaatcttgtaatgacaattatttccatttttgctgaactaaaaatatttaacttcataaatatgttactacagcttccagatttaaagaaaaaaagtttcccccactctcaattaaaagttagaaccctccacttttaaaattatacaaatatttcttttttacattacacagaagccttctgtaccattttacgaatttctgtcttcataatataagtgaaaatactgtcatttcaattttctgctttaaattgtttttaataagcattccaaagtgatacagacttaagcttttaatcaatcagtcattcagttgatagacaaagttagcgatgctttatgctaggaaacttgttgacagtaacctgtgcgactttatgcagaagacaaatgctagtaattattatgcacagaggaaaaatcattttaagtatgtggtaaagcagcttcatctttcaaaattgatttgctctggtttttctttagtccattagattccagaatgtccttttactgggaatttagttatgtattaagataacctgttttcagttctttttgaaaagaagacattatttatattgaaccaccttattttaaaatttttaacttttatataccacttgtgtgattccagtgtcatgtcttgggtttgatgtcgttggacagaaaagtgtatcaattattttaaatgaatttttccccatgtttgaggcttagtctgtaaatgtgttgctgtaacagaaaatacttgggtatgcattacttgaatacttgaaaactgaaattaataagatgtattacataatgaattagatttctctgaacagtttttacactgaaaatcttcatttctggattgcagtttgaaatggaatgaagacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgtaataaaagagcagggttaaaaatattgtatctgtattcattgtgaatcctgtagcttttctagttaacaaaaaatcgctttctaaaatactcttaatcccattgttttggttaacatcttacccatttgttgtatttcaaatgccattaatcattttagtacaacacctatgtttataaaaatttgaaaacattacatattgtatttaaaactaattagtgaagagtaagaaaaaaactagccaacagaattgtaggtgatgcattagttaaatttcaaaactcataataaaggaactttcagagattggttgaaacccagtggtatccctgtaaattagctcctgtgactggaaaagaccccaaaaaggcagta

SEQ ID NO: 10884 - DNA, 1033 bp, Homo sapiens
aaactttttgactgtactgtatttaggagcctttgtacagcttggtcaaatttccatgatatgaagtatttgagttttaaaatatactgttattaaaaggaaaaagacatggccattattccatgtgcttaaatgataatttccttattcagtttcagaagaaaaagaatgaaattgggtaactgtcattgcgttagctttatgttgaattgggaaattgtggcataaagcttaaattcgtgtttatcaaatgtgaaccatagtagtataatgctgctttgtatataatgtaagtgctacaaatagtctcagcactgaaaatgtattgatacctcttaaatgaatgcaacttttgatgtaggtgttttgctatgcctcagaaaatatctgtctgagaatttgttaatctgtttgataatgaagatacttcctgttttcttgtttcatattttcatgttcaaaatttaagttttacatttttactactgttaatttaaataaaatttgttctgtggataaaatgaggttggcagtgaagaaaattaaaaacagcctcattcatgtaactggttaagtaaaaatacattttcactatgtgttcataaacttttaatgaagctgtttgtctttcagttcaaatataagtgatgtttaggctttatttctgttaataaggctttttaccattgattaaatgaaggaatgtatctttttgaagagatttatattctgtaaataaaaattcgttgtaacaataaagttgagttctaactacagtgtattcataaattttattgttacttcaacttatttttgaggttttccttgtgaatatctgcaaacacaagactttccaaagttagtgtataaatgtatatgtggagtgattctttgaattctagttttttgttttctgtttttttagttttatatacattaaaaagttttgaaaaaatgtttacttttggaaaaatttggttgagatgagactatggaatattacataacttataaacatttctgtttacctagt

SEQ ID NO: 10885 - DNA, 1013 bp, Homo sapiens
tctgaactagacttttgacttctataaatgttaaaaatgggtggaaataagagagagaagaagggggagggagggagagaggggagcagagactgggagatgagctacgaattattacaagaaatgacaaaatctgaactaaggcagcaacagcagtatggaccgaaaagattaaatagatttgagaaatacttaggtaaaattgttggtaggaatgtaaacagtacaatcactaccaaaaccacttggcagttcctcaaaaagtcaaagacagagctaccatataacccagcaactgtaccttagatatacacccgagagaagtgaaaacatatggtcacacaaaaacgtgtacataaatgtttatagtggcattattcaaaattgccaaaaagaggaaatcactcaaatgcccatcaaatgaacagataaacaaaataaggtatatccatataacagagtattattcagccagaaaaaggaatgaaggaatgatcaacaagcaaaaacatagacgaactctgaaaatatcatcctgtgtggaggatgccagacacaaaaggccacgtctgtacgattctctttatatgaaataatcagagtggacaaatccacagagatggaaaaattagcagtttttagaggctggtgggagaagggattggggagtggctgctaatggatgtgggacttttggggtgataataacattctggaattagtagtaatgactgcacaacccttgtgaatatactaaaaaccatgtacacttgaaaagtgtaaattgtatgctatgtgaatacatttcaattttttaaaataacagagcttaccgacaggggatgagtacaaaggggagggcgaaggaaaagatgagtgatattgggcatgttgaattccctgtactcatgggttgtcctggtggatatgacctgcaggcatcttgatatacatacatgtctggtgctcaggacagaagtccaggctagagatagacttgggagtcttcgatc

SEQ ID NO: 10886 - DNA, 1058 bp, Homo sapiens
cagtccacctcgggggttcccaaactgtgatcctttgagtggtctggaccctgaggtttccgtagcctgggtgctcttgggttgggagagcaaggaggatgaaagcagcatttttgagcccctgttgggtgctctcgaagaggaggagtgagtagtttatctggtcagaattggaaaagtgaagcttaggctttctttccatatatttgcttcacaaaagaaaattgttccttttgttcctacatttccccactcctgattttctagtcaggaaggcatgagaagagagagatgcccctgcaagccagacccttaccctggtgcttatttagacctgattttaaaaatgttgagagcaagccctgagaggggcacaccaggtgatttgcctcgtgtaggccctctgtgcctgcaggacattcgcatcacgagtagctgccactgtggaggagaggaaagttatggttgggaacccttgttattttttttccaccatgtatatatgtccactggttacttgggtgaccttgaacaagttgccttgagctttttaacaccaataatatttattacccatttatttcacagacttgctataggatttagaaagctattcttagcaagtgtttttttttttttttaaatcacattcagatatatcacaaaatattgcagtgaactgtagggctgtccaaattttatgtatgcagcaaaatattttcttactcattagcatatgttttactctttgttttaaaaagaaatcagatgtaaatgcaggttataacaagaggagagctgtgatggtttgctaccaggttttatgtaggtaatatattttgtcactgttgttatatttggtcactgttgttagctatcattggctcgtgagtgctaaatcatgtttatccttatagtaattttactattggaaaatcgcttaagactaaattattcttccagatacaagtatatatgtttaaaagaaattgggattctctttaatggatagatattgggcagaaagtaaggttttacccttatttttgcttaaaata

SEQ ID NO: 10887 - DNA, 1080 bp, Homo sapiens
ataattttgtaaacaacattgagatcaagctcagccaaaatactaaaacagtgaatttgacctaaaattattagaatttgcaacatacttgctgttatcagtagtgtctaaaatagcactgatgggccaggcatggtggctcacaactgtaatcccagcattttgggaggctgaggcaggaggatcacttgagttcaggagttcaagaccctgtctctacaaaaaaaatttttaaaaatcagctgggcacaggattgcaacctgtagttccagctactccggaggctgaggtgggaggattacaccactgtgctccaccctgggtgacagagagtactattgaaaaggagactaaaaattatttgcagataataaaaagttcccaaggcaatcaactaaaatgtagtttagtagggttccactgtaaatcatgtaaatatcatgatcttttgtgtatgataataataaccagtttaaaagtatgaggaaaaaagcccattcatagtagcaacaaaaaatatgccagggattaaactcggtaagaaatgcaattggcctgtagaaaggaaactagtgaactttgctctgaagataatgaggagacttatgtttctggataggaagacaattctttagttagttttaatattttatattgatttgtaagttgaatataactccaagcaaaatctcaggaatttctcatagatcagtgattctgaattattttacatttttatagaataaataagagccaagaaatgtttatacggtaaagaagaataatgaaggaaaagttgtaatgctagacattaatttgaaaatggtatgattttgataaaatagacaaatatttggagcagaatggaaagctcagaagaatgttgtgttgataaaagtgccactgcaaataatgaatgtaaaaatgtagtaatacatatactagaaaagagtgtatatgaatatctatcttgggcttgggagaaagaagctactaaaacatagaagcaaatgttaaatggaataattcctatgtgtaatgatactaaaaattaaaataatttaattttgcttatatca

SEQ ID NO: 10888 - DNA, 1076 bp, Homo sapiens
agtacaagtgctcaaagcagcgttatttgtaatagacaaaaaactggaaatccaattgcctatcagcagtagaatagatgaataaattgtggtttgtttattcaatggaaatctctactgcagagagaaagaatggacgattgctatgcacggcaacgcagatgaaactcagcaaacataatgtaacgccaaagaaaccagacaacattacatatgatgcagtccgtttatagagtccaaaaacaggcaaaactagtctgtgatgataaagatcataataatagttgcctttgagggagggtgttgggactaggagaggggcttttcttgatcttcgaggtgattagacgagtgtgttcactttgtgaaaattcataacttaagatttctgaatttttctgtatgttatactgcaattaaaatgtttctttaaaaacctagttatctcaactgctaggcatgaacactgtcccaatactattcccagtcctcttctatctaaatagtcactattgccatgctgctacttcctcccactttgcagctcactaaggcaggctggagatttttgtgactgctggagtgatttttgccagtttgcttaacccatttcattccatgagtttcctggcagagattccacaagcaatctctgccaggatgactgcttgtagcagtgcttgagttttggtttttactgtgaaattgtaggacttaaatataaacacatagtggaagtcagatatattaatgaaatgcaaatatatttatgtaagcatagcaaaaactagggtttttccctccttaagcatgaagtttattttggaaagtatgttagaattttatacagttaattgattcagtagctgtaccctacagttgagctgtttatattatcaatgtactgtaggttaggttgtatagctcattcattctgactgctgatgactatgtcacattcatctacacctggtgatgtactttcaataaaggacagagaccaggcctaagctcaattctatatgtagaatactgtaaaatagagtaccactttaatcagtatcactgaaatttac

SEQ ID NO: 10889 - DNA, 1050 bp, Homo sapiens
tgggggccattttaaatggtgaaatcccaccaacaaaactcacaaaaaacatggcaccaagtagactgagaaaggacacatgttgacagtatgagagctgaaacacaaaggcaatgtcaccttgttcagtctcagctgggagcgtgtgtgtcagctaaaaactttcacaccctgtgcgtatccacaaataaccctgaaagcaccacaaatagtgatttttgggattacaaacaaatttttagcaactaggtaggtttcacaaatatggaatctgcaaataatgaagattggctgtaattcctttaagaaagcattgatcttgaggtaatatgtttccacaaatgcaaatgctcaattccaggaggatattatgacaataaatggttcttagctaaagaatacttgttccctggtagcatgttagtgaataagcctagtgcttcattgtaaaaactattaaaataatagtgatttgcatctggaaacctcataatgaagacaataactgaactatattaaaacctttgcagtagagccttctatctgcatcactgtttccatggaaaaatatattccaaattccaattggagtgtccttttgcttcctaggtctttagtctgaacgatgaccaatccaccacacgcacctacagtgtaggtcttccattttactctctagtctggttctggggctgggcatagaactgttggagttgatataaagatcagggttacagctcctagagtggagtattttgggctgagacgatggggttttccagatattggatcatgtcatctgcaaagaaagacaacttgacttcctctcctcccatttgactacactttatttctttctcttgcctgattgccctggcctgaatttccaatactatgttgaattaatgactcaatatatgactaaaagttcaaagtgaaacaatgataattcagataggaaaatatgtggcagtatgctaaagtctaaaaaggaatataaaacgtctgtgagatacctaacatcagatttatagaaacagaatagaatgt

SEQ ID NO: 10890 - DNA, 1070 bp, Homo sapiens
ttatgttgttacatgtcgtgaggggtttggtatcttcaagtaaaggttttaaaggaacctgaactagactcaaacttgaccctctgatgctaatcgaaaatacacaatcatcaaatggcattcttactccattttttaactattacatatcccattttgacaagttattcttaccttttttacataggtcgaactggaaggtacacccttatagagaaatggagagatactgaaagacacttagcacctcatgaaaatcctatcatatccttaaacaaatgggggcagtatgctagtgatgtgcagctcattctacgacgaactgggccgtctctcagtgagcgacccacttcagacagtgtggctcgaattcctgaaagaactttatacaggcagagtctgccccccttagctaaactgaggcctcagattgacaaatcaatcaaaaggagggaaccgaaaaggaaatcactgacatttacaggaggtgccaaaggattaatggacatttttggaaaaggtaaagaaactgagtttaagcaaaaggtgctgaataactgcaaaacaacagcagatgagttgaagaagctaatccgtctgcagacagagaagcttcaatccattgagaaacagctggaatctaatgaaatagaaataagattttgggagcaaaagtataattccaaccttgaagaggaaattgtccgtctagagcaaaagatcaaaagaaacgatgtagaaattgaggaggaagaattctgggaaaatgaattacagattgaacaggaaaatgaaaaacagctgaaggatcaacttcaagaaataagacagaaaataacagaatgtgaaaacaaattaaaggactatttggcacagatccggactatggaaagtggtcttgaagcagaaaaattgcaacgggaagttcaagaggcacaggtcaatgaggaagaggttaaaggaaagatcggtaaggtcaaaggggagattgacattcaaggccagcagagtctgaggttggaaaatggcatcaaagctgtggaaagatctcttggacaagccaccaaacg

SEQ ID NO: 10891 - DNA, 1391 bp, Homo sapiens
ccagccttttttttaaatcttcttcccacagctttcttcactgtgaactctttgctcttgccaacaccaatcacttcctaaacacgtcatctgttttcatgcctacctgcttagaaggtccattccttcacttttcaactgagggaactcacactgtacttctacaaagcttccaccagtttcttcccatagacatctcttaaatctatttgacttaacactccactctgccacctaccacatgcttgttttctctactagactcttgaggtctgtggcccttaatatagagggagccttggccgatattaattgctgtttagtacatctttgttgaaatgattctcaagaaacaagcttaaaatattcaaaaaactaatacgggacttcatttggtgtctcttattgttatatggctagatttttgtgcattgtgttttctttttaaaatgtcccgttcataagttgcttagtggaagagaatattttgtgtacttttaactcaagttggaataaaatacaatattattcttgatagaattacgtacatctctggaagaacatcagtcggccttggaacttataatgagcaagtaccgagaacaaatgtttagattgctaatggctagcaaaaaagatgatccgggtataataatgaagttaaaagagcagcactccaaggtaatccattctataaatgtgacctgaaatggaaaagagagacgattgattattctgtgttcagattttttttgaaaaaaatcacaggtatctagtaatggcattttaacatgatgttgaatgtttcatctttttaattgacattttctcctttttcttatttttccatttcttgttatatatcattttctgtttgatttataaactctcactgtttcttagaaactttaatttgtacgttgaaaaataaattttattttggatataaaggtaagtctggtctcttcaacattatttttgtagggctatatacttttaagaaatatttcttaaagggctgggcatggtggcttacgcctataatcccagcactttgggaggccaaggcaggaggatcacttgaggccagaagttcaagaccagcctgggcaacatagcatgactccatctcttcaaaaagtaaaaaaattagccgggtgtggtagcacatgcctgcagtcctagcttctcaggaggctgaggtggatagaccacttcagctcaggagtttgaggttacattgagctacgatcatgccattgcactcccatctagacaaccgagtgagaccctgtctcttaaaaaacagaaatttttttaagaaacattttttctaataaatttgtgtattgacttctcttgcaaaaacaaaaaataatggaaaccttttt

SEQ ID NO: 10892 - DNA, 1132 bp, Homo sapiens
agtaagtggtagagttagaaattgctccttcaggccgggcgcggtgactcacgcctgtaatcccagcactttgggaggccgaggtgggcagatcacgaggtcaggagattgagaccatcctggctaacatggccaaacctcgtctctactaaaaataaaaaaaatagccgggcgtggtggcgggcacctgtagtcccagctgctcaggaggctgaggcaggagaatggcgtcaacccgggaggtggagcttgcagtgagctgagaccacttcactgtagcccagcctgggtgacagtgagactctgtctcaaaaaaaaaaaaaaaaaaaagaaattgcttcttcagatcaggtttgctctctcttacattgcattattttactacaaaaacttctccttttctctttaatttacctccctcttctagtcccaccccaagttttctttcttctcttttttcccttccttttttggtaatttcccctttaggagttatttacagttttgcatgtcagacataaattctcttgggaaaagtatgcagaaataattcaattgtattctgatttcttatagacagggatttactcttagcacttattttaagaataataccaggagcccttatatttgtattacactttatagttttatgaagcgtttttacacatttccttacttaatcctcatagcagtcatgtggtctaggcagtgagggttatggctattacacctattttcaggtaaagagaggaactcagattaaagtgacttgtctgagatctcaaaataagagacagagcctgaatttaaacttaggtctttcgactctaatataaacactttatttaacacactggtcttccttgtagagtaaaagctgctacaagcaaatcgttcactaaggcctctacaaaattagttgatgagacaaggtttttgcccttagcaattacagtgctgaaataaatgatataatcaaatgttctgacttcatttaagccaattaggagtgggtaaatatcattatagcatggcattttctaaagttttaagccttgagctttgttttgttttgtgagaattgagaacctggaattttagttctgcattttaaatcatgaaatgttaa

SEQ ID NO: 10893 - DNA, 1025 bp, Homo sapiens
gtgtgtgtataggatcgtgcactatatatagcttgcttctttttccatcatgataattttcccatgtcatgaattatggcttgcaagtgctattcttaaagggctgcattatttttcattatttggatttattgttatttaattggagctctattattgaacatttagattgcttccaaaattttttgctgttattaatatattgtaataaacttctgtgaaacacatactcttcacctgctacttacctatgacttctgtaagcagagacctctgtatccccaggacctagaaggttacctggacatagtagttgcttaattaaaaaaattattgattgaatgaaagaagactattaaatgttcagttcttctttttttattctgattgcctgtgtatccaggggcctcttatttggctgcatgtgtgagtttggctgtaatgaaagtattggccatgtatgaccataaacaggcattcctatttctgtcacagttatatttgtcattctgtattaatatatctgtatcctgatttctgttgaagcatgattaattttgtttgcttctaagcaatgtagctaccctattgatgctgataaaaataaatttctgaacctataaggctgaggattgggcctaggttgtggtaaactggcaagataatggatgctaccctctcaagagccctctgaagagaaaagtctgctacccttcaccaggtagaaactcctgacagtgccacattttccagtttgactccctgtgataccctgaaaagacagatgtttgactcttttcaaataatattttaacatattttaagacacaaaggcattgtgtcagacttttttcttaagaatatatattgttgccactcagaagttagcttccaaaagaaataagtgtgtgcaaaggtttacgatagtggtatagagaagtttttaaaataaatgtgcatcttttcctatagtaataaaagcacattatgaagaattttgtaggtccagtccacatattccctgt

SEQ ID NO: 10894 - DNA, 1026 bp, Homo sapiens
acaatattcttttaatcataacattttaattttaatcaaattgctctgtaatcccagctccttggaaggcagaggcagaataatcatttgagcccagaagtttgaggctgcagtgagctatgatcatacaactgcactgcaacctgggcaacagagtgagaccttgtctttaaaaagataaagaaaaaaatctaattgctcacaaatagaacaaagtatgagtagataactgaattttatgtgaatacaatttaatctgaatcctatccacttcgcccaacagtgtgtattttgttccaggagtgtcattgccgagggtgaatggttggggcagggggtgtggtagctcccacagccttcatcggtgttcctccctacccacctccctactcttatctggaaaaattacactttcttttatccaatttaaagtctttataaaaacagatcagggaagtctcccacttaccctctttctcatcagattgcccctaaactattctaatagagaaattctggagttgctgtgtgttgtaggagagggatttacagcaaagtgtgacaggtaaaatcatgtaattcttgaaatctaagatacacttttctcctctacgttttatcttctgtggaaatttcttatcatcagtggcatcttcctgtcaattggcagcatttctttctcttgtgatgctttaaataatagtgcgtcttacaattggtggctcttagatttgatgaaataagggtagtggtatgaaaggtactgaggtagcttagagagagcagtgattaatcatgtagtagtcagagaaagcttcccagaagaataactgagttggattttgaagaaagaataggatttctccaacagtatagtcagaaaggactttgtaagcctggtaaagagcaaggcatggaggagatgtgagacggtatggcatgtgtgaggatgagcaagtcttcaggcgttgctgctgtggaacatttggagctgtcggggaaagtcttgaagagagaaactggaga

SEQ ID NO: 10895 - DNA, 1075 bp, Homo sapiens
taaataattaaattaaatgaaaatgaaaaaaaaaatgattacagaaaatgtcttagaatgtgccaaagagcaaataccagcagcagcagcattgctaatgttcattaagcattttgccctctctactatatttccaataactcttgatgcctttctttttaggcttgacaaattcttatgtgggaagtaattatagaccatcatttcttcaggataatgagctcagacatttaatccttaaggtaactaaagatatatttgtctaagttgtgtatgtgctttcattgctgtttgaataggaggcagattttcttccatttgcttcctgttctaaacatatgggactccatattacaccgtatttcctttaatatagaagtttaaaatagagaagtagccatgcattactagtttgtgttaatgaaagtagagacagaggataggcactttccacactatggagcaaagcttgtattcagtgctaagcattttatactacccatctctcacacataggatctactcccccatgatcaccacctccttcaaagccgtctgcctggcatcctgttccctcaggatcctgttcttctcggaggccagtcactgcttacttagagttgttagtgctttgacatttccgtcctcatcattcctgtgcatggcttttcagattcaccggtctagaggggaaactgtgatcatgtgatttgcttctcatgccctcggaggtgataaatgtcttggtcatgtgctgtgtgactactaggttttaagccatagtcaaattaaatagaaggattcttcatacacatttttgtccatttttcctttaattaaaaaaagccactcttttatttgaacagctgaatttaaatatagcatttctggcagggatagaaaggatattgtgtggataaaaaggatttttgaaggtggcaaaatgtacgatttgctttcgaagctttctcaccaatctgtacatgctcgtcagtcgtaccttcatggaaccctgcttctgccctgcagagcatgcccagcaagagtgccagactcttcctatgtgccatatgta

SEQ ID NO: 10896 - DNA, 1050 bp, Homo sapiens
gacaattactctcttttttatatggattaggtcttttctgtatgaaagaccttgtataattgtgtttgggaagtataagtatttttttcttctctgaaaatgcctagtaccaaataattatgtaaaatataaaacaattgattcctgtaatagttaaggtttttttcattttttaatttaatttttatttcatttcacttaaattaactttgttcttccccatttgaggaaaaaagaaagataaattgcaaatgtctgtaagttatcaaaatgtgattgcttgacaaatacattttttgggtatatttcacttcagggtttactgtacaatcatgccattgctttaaaaaactgtttcctttctcaataatagatggtcagaaaatgttaggagataaatttcaaaattatttgacaatattcttttccacctattctctcgcccccttctgcacgaaagctggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaaggtatcattttgaaatgtcaagtgatgcaaagcatggctataaaattaatgtcctaaatattttctgtacagaaaaaataaaatatatggtcaagggaaatatttgaattcaaaagcatcttaaaaataagatttttttaaaccaaaattacttacatttgttcatcacatctttcgaatttatcaggtaattacatattatctttgttgcccaagattttaatggtgttattgaaattgtagtttggggcctatcaagtgggaaaaaaatgacaagagatggaaataaaacttttgctgtgaaacttcattattacattttaaaatataaaggttagatgttaaaaaaacttcaatagtacaagagcctgatttgactaattttggtgaaagtttcttaagatgttccaggtgtgattttaattttttatgagatggtgattcttc

SEQ ID NO: 10897 - DNA, 1032 bp, Homo sapiens
tgatatgcatgggtcactcatcccctaccctgtgcacttctttacgatcctgaccatatgtgggcctacagtcttctgggagggagtacactcaccacttctgaagtttattttcaattttgaaaccagggcaacagcgattttaggatatctgcctcaggaacttttgggaacttcttgttatgaatattttcatcaagatgaccacaataatttgactgacaagcacaaagcaggtaggtatgcattgagcagaatacattttggggaatttaaaatgacagttttaactcttaatttcccattcctgtgaaatttgaagtttgaattaatcttcacaacattgatttttatagtcattgactattatgctgataattatcttttctcgttaagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgtaagtaattttttatgttaagacctttatattgatttcaaatgagtctctttgcttttctcctctcatcttgctaaaccattaaaactgtgtgatcctctggccttttattgtaacttgagatttatcttttgagtaattcatttactgttcattgacattagttctcagaattaagctaaaagttttcatttctgtaatacattccttcttacttgatataatatgtgagggtaaaggcatttattcaagcattttcttcctaccctccatggccattcagtaaacaatgcagacgtggatttctactgtgcattattgtaagaaattgttttgtcctccctgtcatttttacctgcacatcttataagcctggggtgccgccatgtctgtgtaggcatgctcagcacgggggagaacagaaatccagcccaggtgttgctttagcaagctctggtctgtagctgtgtcagcctgaaggaaga

SEQ ID NO: 10898 - DNA, 1029 bp, Homo sapiens
agaaaggtcaggttacccacaaagggaagcccatcagactaacagctgatctctcagcagaaactctacaggccagaagagagtgggggccaatattcaacattgttaaagaaaagaattttcaacccagaagttcatatccagccaaacttaagcttcataagtgaaagaggaataaaatactttacagacaagcaaatgctgagaaattttgtcaccaccaggactgccttacaagagctcctgaaggaagcactaaacatggaaaggaacaaccagtaccagccactgcaaaaacatgccaaattgtaaaccattgaggctaggaagaaactgcatcagctaacgagcaaaataaccagctaatatcataatgacaggatcaaattcccacataacaatattaaccttaaatgtaaatgggctaaatgctccaattaaaagacacagactggcaaattgtataaagagtcaagacccatcagtgtgctgtattcaggagacccatctcatgtgcagagacaaacataggctcacaataaagggatggaggaagatctaccaagcaaatggaaaacaaaaaaaggcaggggttgcaatcctaatctctgataaaacagactttaaaccaataaagatcaaaagagacaaagaaggccattacataatggtaaagggatcaattcaacaagaagagctaactaccctaaatatatatgcacccaatactggagcacccagattcataaagcaagtccttagagacctacaaagagacttagaccctcacacaataataatgggagactttaacaccccactgtcaacattagacagatcaacgagacagaaagttaacaaggatatccaggaactgaactcagctctgcaccaagcagacctaatagacatctacagaactctctgccccgaatcaacagaatatacattcttttcagcactacaccacacctaatccaaaattgaccacatagttggaagtaaagcactcctcagcaaatgtaaaag

SEQ ID NO: 10899 - DNA, 1050 bp, Homo sapiens
agttgatgacttcactgctgaattctaccaaccattgatttatttattttttgagatagggtctcactttgtcagccagtcactttgtcaggtctcactttgtcagtacagtggatggttcactgcagcctcagcctcctgggctcaagtgatctttctgccttggctacctgaatagctgcaactacaggcatgcgccacaacacccagccaatttttggatttttttgtagagacaaggtctcactatgttgcccaggatgatcttgaactcttgagcttaagtgatcctcccaccctggcctcccaaaatgctgggattacaggcatgagccacagtgcctggcctctatcaaacatttaaagaactaataccaataccaaccctactcaaattattctagaaaattgaagaggacattcttccaaattcattccatgaggccagcattactctgataccaacaccagagaagaaaataccacaaaagaagaaaactacaggtcatatttctgatggacatagatgcaaaaatcctcaacaaaatactagcaaactgaattcagcaatacattaaaaagatcattcaccatgatcaagtgggattcatcccagggatgcaaggatgtttcaacatatgcaaatcaatacctgtgatatatcacattaatggaattaagaataaaaaccatatgattatttcaatagatgccaaaaaacatttttataaaattcaacatccccttatgataaaaaggctcctcaaaaatgggtatagaaggaacatacctcaaaataataaagcccatctatgacaaacccatggctaacatcatagtgaatagggaaaaatggaaggcctttcctctaaagactggaaccacacaaggatgtccactttcaacactgttattcaacgtaatattggaaagtcctggccagagtaatttggcaaaagaaagaaacaaaaggcatctaaactggaaaggaagaagtcaaatgagccttgtttgcacatgacaaatcttatacctagagaaacctaaaga

SEQ ID NO: 10900 - DNA, 1009 bp, Homo sapiens
gtggcaggcgcctgtagtaccagttactctggaggctgaggcaggagaatcgcttgaacccgggaggcggaggttgcagtgagctgagattgtgccattgcactccagcctgggtgacagagcgagaactctatctcgaaaaaaaaaaaaaaaaagaccaggcgcggtggctcacgcctgtaatcccagcactttggaaggccgaggcgggcagatcacgatgtcagaagatcgagaccatcctggctaacacggtgaaaccccgtctctactaaaaatacaaaaaattagctgggtggggtggcaggtgcctgtagtcccagctactcgggaggctgaggcaggagaatggcatgaacccgggaagtggagcttgaagtgagccaagatcgcgccactgcactccagcctgggcaacagagcaagactccatctcaaaaaaaaaaaaaaaaaaaaaatcctgatttgaatggtagactggataaagaaaatgtggtgtatatgtaccacagactactacatagccataacaaagaacgagatcattcatttgcagcaacttggatggagctgaaagagttggagctggaggccattatcctatgcaaactaacacagaaacagaaaaccaaatgccacatgttctcacttacaagtgggagctaaacatcaagtacatatgggtacaaacaggggaacaacagactgagaactacttcagggtgcaggatgggaagaaggtggggatcaaaaactacctatcaggtactatgcttattacctgggtgacaaaataacctgtacacacaacctctgtgacacacaatttacctatataacaaatctgcacatgtaccccggaaccaaaaataaaagttaaaataaataaataaatattcatgatttggacagggaccgtgattctttcagctgtcagctctcctatcccaatggggtatcatttagggtgtgggcttcctcattgcccaaaatagctgctcaagccatc

SEQ ID NO: 10901 - DNA, 1026 bp, Homo sapiens
ttaaagaacaagatggactgggcatggggagaaagatgcccagtccatcttgttcttgggtttactcttaaggcagagtgattctttgctgtggcaaaatcttcacttttagctatgtaaatggaaagcaggtatctggctattcttaagaatggtgtgaagcaacctgaatgttgatcttttagtctgagaaattaaattccccgttcataacggaaattgggtgtatgctttgtagcagcctttggttgctttttttaggagaaatatttcttaagtctcgcctggctattattaccactgtatcatcttgtgacctcatctgatcttgacctttctccaagcttgcctttccctgctcttctgtgcagaggactccggctccaatccctggatggctttaagtccagcaaacctttctgtttttcctatcgctcttctctttgcttaacctctcctctttcctccagacccacttaaaagcagttcatcaggaaaacttagctgacagtctcagtcagaactcactcgtgcaggaactttgcaggaagcaggtaatcaaattttggggttttaactgctcaagtaccaattcggtggtgagttaaggttgtctttgaaggttccttccagcccagtgattttgagatctggcatctacttgttatttgaaattgtactttgtgataggaactttacttgcagtatctcagttaattatgacgtagcactagcattacctccattttacagatgaggaaactgagaattttttccaacactgactctcaaaatggctcttttctggatttgtcttatttcttcaaatagattatggactagttgaagaccatgactgcctttgttgacaatgcttgctacctggtaggaactcagtaaatatgtgatgagatgattggttcattcaaccaatatgcattaggcctataccaggctccatggagatgcaaagatgccccagctagaaaatgcagtattagttatactctaagcttggcctcctac

SEQ ID NO: 10902 - DNA, 1664 bp, Homo sapiens
cgcactttgggagtctgaggtgggtggattgcttgagctcaggagttcaagaccagcctgagcaatgtggtgaaaccccatctctacaaaaaacacaaaaaattagccgggtgtggtggcatgtgcctgtagtcccggctactcgggggcctgaggcaggaggattggaacccaggagattgaggcggcagtgagctcagatcacgccattgcactccagccggggtaacaaagtgagatcctgtctcaaacaataaaaaaaaataaaataaaataacaagtttttgtcccgtttgccacaaatcatgtattagtatttgatcatctgtaaagacagttaacaaatggcattgcactgtgaaaaattccatgtttcttctttttaaatgtgacagggcgtggtagctcatgcttttaattccacagtacagcactttgagaggccaaggaaaaaggattgcttgatcccaggagtttgagaccatcctgagcaacatagtgagatcatgtctctacaaaaatattaaaaaattagctggggtgtgatggcgcatgcctgtggtcccagctactctgtaggctgaggtggacgacagagtgagaccctgtcgcaaaaaaacataaaaataaaaaagtttaaaaaaattaaatgaaaggcttttatacagcacattcggaagagtggcattatattttatagtatttaaatgagtgtcttaatctttccttaattatccctttacacttgctgctggcctccggattcagattgcgtcttccgtataactcaaaggcttttcaagtacttcttctcagttttctttcaaagtaggtcagttcagattttatatctaacttgcaaatggaaaatctgaagcatgggaaagttaggtaatttaccaaaactttaataatcagtggcagaagttaaatacaaactaaggtcttccaaagtctcatctattgctctacctatcagatgagtaaaggctaataggagtctattatgtgttttccatttggctgtctttttttagacatataatttaggtaatttaattttaaaactgtaattatcatttgatgattgaaatgacttattcacatttttttttttaagtaaaagaaaaaagagtcagtgcaaacccaagagctcacaaaattccccaaactagtctctcttataaagtgcttggaagtgatgcatcttatagtgcaggatattggagtaagttcatgatgggaatgaaattcagcctcaacaatcttgctctgttcatattttttcaatgttacaatgatgttaattgcaaagatacttctttcccctcaaaacgaccgggtattgattttttaaacagtgttcaaggaatggagtgaactatgtttaatttgttaacatgtttagtcccagatatcagagagtctttgtaatccagagtgacattttgcagactctgattttaaagcctaaatgagagcaaaatattgttcctattataagaaaatcgttagcccaaggaaatgttattggcaaaatagttctcactgccccttagactgtcacctagaagagctcccacatctgcctgtgattatgaccagccttttctgcagttgtgcttttttggaggaagcatggatctgtgcagtctaatatgttt

SEQ ID NO: 10903 - DNA, 1025 bp, Homo sapiens
aagacaaaaagtagctggtaagctcttctcttctttacaattatttccattattataatttatctggattttctagttctggctttaagagcaacatcagaatagcagttaatctctttcctacacaattgattttagaaatgctgttggcttaagataattaagttttcttttgaaccagcaacatggctgaattagctacagctttatggctgttgctgcttaaagatttaataactaacaataaatacaacccgttttgactttcttattttgccagtatctattagaatgaatttgcccagaaggaaatgataggcataaattcagtggaagttgatttatgggattctttctgtggttccgtgacttagaatccaaacagggttgcattctggattcacacagaagcctttgatctttagtgctgattactttgatgccaggataagtagccacatacaactgtccaaacaagtatacttgaagaattctatattaccgttgtttcttggtgctttctaaacaagtaccatcagtgaagaagattttgaatacagatgagccgtgaaattttgcggagctgctagaaaagaatttttattgaattgaaattcattttccctcaccaacatggaattcatacttgaaattgatgttatcaccgttatttaatcaaatagagagcctctttttaatccattgcttgattttttttataggctagcttctgagcatttaatacccaaatatatgcttcctttggcttttttttttttttcttcgagtcagggtcttgctttgttgtccaggctggagtgcagtggtatgatcatggctcactgcagccttggcctcctgcgttcaagtgaccctcccacctcagcctcctgaatagctgggactacaggcgcatggcaccatgcccagctaatttttgcattttttttgtagagatgggatttcactgtgttgtccaggttggtcttgaactcctgggctcaggcaatccattcaccttggcc

SEQ ID NO: 10904 - DNA, 2498 bp, Homo sapiens
gttgagtcaggaatgagatggagtgaccgttttacttaacgctttataaaatgtatttgtcggttttttagattaagtatattttaccctgtaagtttgaattgtgaaaaaactatgacattgtcttgaaacctttaaaacatttctaagagtagatagaaccaataatgtaattaatttaggacatttattttttaaggggctgacatttattcctttctcaagtattacagtaaaaattaggtggggtaggataattttgccaattttttttaatgcgcagattcagagtttgttagaaattatttgcagcagagttgtgggcgagaggcataccaagttgtttcaggctggtctaaaggtagtgagttatctcagttgattgttcacagtcagtttcagttacagattgaatgccttgttctgctcttaccccgttctcactactcgactagcctaaaaaataataataataaaataaaaagaagttgtttcacattatgccttccctgccaagcctaaaacctcccgaccagattttttttaaaagaggacacagagttggttctcaactggatatttctagaacatatgctgagacgctgtccacagccataaatttattacagggaggtggggcaaacatgcaggaattgtaagtgcaaatataccccacttggctcaggaatttgggggccagggaagacatcctgcatcttactggtttcccttgaaggaatggtacccagtttgaaggattcaaaggagaatttcttctcctaagtctcttcctttcgcctcggtgatctgagcagggtttgctgactcggtgttgtccccagtggcctattatttgtgatcggtggggctcctctttacccttggaggaacacatctccaatgctttcttttcttttcataggcacttgtagtggggataggggtgggagggtggcacgggtggaaaccttacctgcttcttggtgcccactcagctctgcagagccttggagctgtctactcaagctggaatctctttgaaggggattttctagaggtagaatagtatttctgacagcctcacaaatatactcatcttttaatattttgccacctttaaaagttgttattcagaataatagatgattccatagcagcctgtagctcagaatattattatgtgttaatttggaaaaaaaatgtgactagtattcagcacttctttgaaccagggtatattacttattagctgtattgcttgatttttcacagactgttacatctccatttaaatcataaatctgaattatgctgtattactgtaaagcctaccagtgttccctagaatagcatggtaataatttttgtaagaaaaaacgagtagtaacaaaacattgttcacattatgggaacagaaagataataacaaaataaaattccaggataggctgggtgtggtggcttatgcctgtaatccctacactttgggaagccaaggcaggcggatcatttgaagtcaggagtttgagaccggcctagaaaacatggtgaaactccaactctactaaaaatacaaaaattagctgggcgtggtggtgggcgcctgtacttccagctactcaggaggctgaggcaagagaatcgcttgaatccaggaggcagagattgcagtgagctgagatggccccactgtactccagcctgggcaagagagcgagactctgtcttggcgggggaaaaaagaaaattccaggatatatgaagtcattatgactaaaaaccacgtattatgtgcatcatattcttaattttattttaataattaattagtcttcctcatcatcccacaagtatatcacagaaataaatacagtctcctctcagctctcattatttttaataatgatctccttggtactaaagaagttgaagattacaactcagaaatgcaaaatgttgggccaggcgcagtggcttacctctgtaatcccaggactttgagaggccgtggcagaataatcacttgagcccaggagtttgagaccagcctgggcaacatggcaaaacaccatctctacaaaaaatacaaaaagtagccaggcatggtggtgggcgcctgtagtcccagctactcaggagcctgaggtgggagaatcacctgagactgcaaggtcgaggctgctgtgagctgtgattgtgccactgcactccagcctgggtgacagagtgagacccatctcaaaaaaaaaaaaaaaaaaaaagtgaaatcttgatgtattagggtttagagaatagctgcaaaaagttattttctgtatctgctggaaaacagcatatctttgtaagtacagattgtaaggcagacagattgtaattatgtggatagagtagcgagtggtaacagagcttgacagaccagtgttcacgtgacagagtgtgcagccctcaagcgcaggtgcaggtggctaacagtacagggttaaggggccaaagtgcac

SEQ ID NO: 10905 - DNA, 1048 bp, Homo sapiens
ctgagccagtaaataggggagggtgtgctgtggtggaaatgacatcttcaggaatgttgttggccttggcgctggcaaaattcccaatgaactaagaaattgcgaagaggacgtccccagtgaggtcaagaagtggagtggttttttggcaggtattgtgcctttaggtgaaactgctttctttgcctctgttcttgtgaaaaaagatgttgtggtttcctacaagaatactttaaaagaaaattgccccttaatttttaaaaaatttgtcttagtttttaggatttgatcctgatgataatgatacactggacagtaacctgtaacactgactttgggggatttttttctgatgtcagtgactgtgacaacagagtcttccacactgtgatacccatcatgatcaagagataatcactggaaatgtattaacgtttgcaataggggttgcttttcttattttttatcctctcttttgcttccttccctggacagccatcgtcatgacccacagcttgagcctggaagtgttcaactacagaattggaatattttcatttacgcaaccttctccccctcccatcctgcaaatctctcctgcctccaacaagggtgacttgaagaaaggaagaggaggagcttgaggagtgggatgagaggggagaagggaaaggaaccagggaaggaatatcaaaacaagagcaaagagcatatacaggaagagatggtaggaaataaagatggtagcgcctaggaggcctcagcgtcattcagaagcagggaaaagaatcaatgtaactcaagaaaggatgaaaataccctttcttcccatccacgtgtttccatctcaatcctcacagggtcctggtcctgaagtgtggagcaaggagttggggagctcacagctgggcaaagaaagtcttaacagtaacagagaatcctttatatatctgtttatttgactcgagggtcctcctcggccagggattatttgggggaaataactggctttatttctcctataatatgaaattcattttgaaaagta

SEQ ID NO: 10906 - DNA, 1064 bp, Homo sapiens
agttttttttaaaatgtggtgtcccattccaagggagaccaattcctaaagggtaaagaagggttaaagtaggtcacatatatacagtagcagctgtaaataagcttacttgaactaattacttgaaaactggtggaaaaaagagaccaactttgttattttttaaattattgatttttaaattatgggagcaaatccatctccaaacatgatactcttgggccaatgacggatcatcaaaatgtagattcattgtgtctgtgtggtaaagggccaaagtcaataattgggacaaatggtaaagatgattttaaaatctgttgtatttaggtcccttgacatatcattagcaccttaagtgagaggttttctttttcttatcagtgtccttgacaagcattcatattaacatattcattctctcttctccatcacccatacccacacatacatctagtatgtttagggttctgtgttcagatattttgtttgcacactactttttaggaaacttataatgatggagccctacagtgaatccttaccagtgttcagtcctccccaaaacttgcataaaaatattcttagctatttttccagccttttttgcagttacaaatgctggataaatagactgataaaacctcttattttatttatgtggcaggttgcatatttatgtggacacataggttgcactgctaggcattctgtattgttttaaagaggatatattatttagaaaaatggacatatgaatattattaaaaattgagtcttaaatttaaatgggaagggaagaaaacaccaaataagaaaaaaatttgcctttaagagttacttttgttgaatgtatttgacttagttcttattttaaggctaaaaaaactttgtcatatttaagtcggcagctttctaatttaatcttagctttgtaattcatgttttgcttttgtggactaaggtaaggacagcatttaaatatttgtgctggagtgaggggaagaagctgttacagaagtggaatggtttctggtggtatttctgaagttaggtaaagtgct

SEQ ID NO: 10907 - DNA, 1775 bp, Homo sapiens
ttctcactgcttttcagtcttctctgtacttcatttttgtgaaaaagtgaaaatcacatataatctttatttaaaaatgctcaccaagcactgcagactttggagttagggattcagcagcttgttccagtgaaaaggaggagtgaagctggggaagttagtatctaagaggggcaagctgattgcatgtgcatttatacctatgcctttaaaacattcccataaaaagtattaataaagaaatttccattccacactagtactgatgaaaaggtggttgattttgccttgtgataattatcaaaggatagtttttcatccttagattttattcacatgagagattttttttattttctctgttgacttaggaacacatcataaattcacaccaactgacacgttgctgacgtctgtacttgacataaccatttttattcatacaggaagcattaaatataaaagatggtcagttttgaagagcaaagggtgctgaaatgacttgtacggttggctggtgctttctcaaatggattgccatagttcattactagtaaagaaaaggaaaatgtgatttacgttgtcatttttcctattaaaaaaaacccttaagaatggggcacttgagctgtccctgcaatgttttcatatctagtagtcattttagggaaagtgataatctgtagaatgaatagttatgttttgatatgactgatactttctttgttaaaaggttgtattaagtcttcaatttcaagtctagcttaaaagtgtaaacattatgtgattcatttgaatacaagaatgcctatgaaatacccactataacagcattccttttgtgtttagaactatagaagaaaatgtcttcaaataaagtagttttcagtcactttttgttatctaagttctatgtatcagttacgtatgcagggctgtgccaggactgggaggaaatgggtgaagtgacttgggagcctgaggtgggaggattgcttggggccaggaatttgagaccagcctgggcaacagtgaaatcctgtctctacaaaaaatagaaataaaagaaattagccgatacagtggtgcatgcctctagtcccagctacttgggaggctgaggcaggaggattgcttgggcccaggagtttggggctgcagtgagatctgattgcaccactgcactccagcctgggcagacagtgcaagaccccaactcaagaaaaatgaaataaatggacaaccattttctacacactcaggacacactgatggaggagaaggaggatggctgacctagcagagcgacacccaaatctaactgagcacttttttttttcccaggaattattctaagcattttttatttaaattatttaatcctcacatgaatcccatgtggtaaatacaaatatcctccgctttacagttgaggaaactgaggcactgtaggttacaaattgccacttgagaaagaggagaagggaaaactacatacagtggtcactggtttaaagggtatcctttctcttgctagtggaggagtgggtttccgagtgagccagtctgggagcctctggtcctgctttgcagcagcgcgttccatggctgacctgcctgggggtgaagtggcagcctcttcctgtgggcatggttacaggaggtgtgtggaggggcacctgaacacttctgttgaggccagggatcctaggctcctgtttgtaggccatcaacatttccttggcaataaaactttaaaaacccatttgaggctg

SEQ ID NO: 10908 - DNA, 1050 bp, Homo sapiens
agaatgcaaaattagcaattcctagtgtaagcaatttcaaattttcacactcatcatgaatttaaggatgcaaaggacctgctttatattcctgcatttttttgtgagggaaagtcatgttaggtatttctaagatgtatttttctcttctctttactctccttattacatttgaatcatgtgtagttttaagctaggtatttatttacttatttgttaccagacaggtgtctcatgtttgggtggtatatattgctgccaaaggctcaccacagagttgctcaaggtgaagagagtgggtttctagaagtacagctaattcttctgtagcgtctagttagtgtaaaatataaaaaatcaaccaaatacatttatacacaattaaaggaatacttatacgcaattataggaatttagtaaataaaactttttagtatcattgctaccatgcataattaacatttttaagatttattacgtatttactcagtagaggaacagaatcagttgacatttctttaggaccctgacattatggcatatgaagaatgttgggagtgcctagattgcctgttggaaagccttggatttttagttaatgactcggctagtcttcataatggtgaagaggaaaactctttcagatattgctcataggatgtcagttttgtcaggaatatgctcaattatagagagaaaggagagtgaagagagaagggagaatgaagagggaaaggcgaatgaaggtgtgcttcagactttttttttttaacatgcaagtctaatagttatattgagtggattaaagtctatatgaattagaagtcatttatagatactggtactcaattacatattaagtacagaggtaaaaaaaaatgacaggttattcatactaaagtcaggatgagatgaaaaatgtgctgagtataccagcacttttaattcaaggaaaaatgaaaatgagtggttaaaacaagtgttaaaagaaaaacttcagccaaattaaatttaaaggagtttaattgagcaatgaacaatttgcaagtt

SEQ ID NO: 10909 - DNA, 1026 bp, Homo sapiens
cccctgggttcaagtgattctcctgcctcagccctccgagtagctgggattacaggtgcccgccaccaggcctggctcatttttgtatttttagtagagacagggtttcgtcatgttgaccaggctggtcttgatctcctgacctcaagtgatccacctgcctcagcctcccaaagtgctaggattatagatgtgagttgctacacccagctcaagattttttataacactttcacaacttgtttaaaactttagctttatctaattttaaacaatcctttaaccctttaaactttgcaaaaatttacatcccatgctttcttataatcttttaccaaaacacatttcattctcctcatactttgcatgtaaacctatttttttcagtagtctcaattatatgttaaaatggtaattcttagcaactttcacttttggtgcataaatttcttttcattaatcctttcataacttccgtagaccatctacaacatgcttgtactttctgacttgtcctaaacatccttctttttaaacaaccagtcattttttactttaggacaataatttaccatacaagatcctttcttatataaaatctcttttctttataaccctctttgcatagctagggaacttggctaattccatatgtccccagggctttaaagtcaaggcagtgtatgaccttaaagcatttaacaaacctagtatctgacctgaataatttagatcgtatatctttatttttgccaaaaatctttaaaatgttttatttcccaaagattactaaattcacttgaactaaaaggcattacagtttttatttttctttcaaaatatttaagtgcctatttttctttaaaccaattaattagagctcttttatataaacattacacacacaacacatatataactgcacagacagaagattattacagttgttgtaagtttctatttaccagtttctaagtttttaaattggattactggctataggatgaagtctttggaagaacaggg

SEQ ID NO: 10910 - DNA, 1029 bp, Homo sapiens
acaatttttcatgaccagtgaatgctagctgaagaaactgaaaattttctgaaattgtcagtataaatcatttatttcagtagaccttgctatgctttgctgttggaagtaaatataacttttcctaagattagtcaaaattcactgagtttgtgtcatgctttgttagatgctgagaatagatcaaagtttgatctctatattttatttaattgatatcaaatgaacataattaatgatgatgttgaattttttttaatacaagtatgaaaatgccctttctctttgtgattgtttggtactagtcattaactttgttcccattttgtataaatattatgtattagaagttagaggcagttttctgtgaagagtatttctacttgattttatgttatttgataaatagatgttttgaatagcagcataaaattaaatgtataaatttaatattattgctgtattgtaatctttttctgtttaattttttggcttgcattattttagtcgagtaaagtattttgtatctgttatttttatggtaatatatcttttcttcatataaaataaaatttgagacctctgcatccaaaatactaaatataaaagtttataaattatattaaaatatgtctcagattatatagagtgatgcgtagtcattgttaccttcaaattagccacttggtgaaatatgtcactttttagtcgctagactatgtttgaaagctgtaaaatactggcgagccacaatttaggaccacgtaaaatgtgaaaatcgggtttatggaaacagattagaatttattttcattatggaatgttttgtttcaaagtttgttgaaaaaatatattttgatgtataataaaggtatatagtatgatgtttgtgagattatttttcaatagtttaaaaatacttttttattttatgtaacaatataatggtacatttcaagtaaagaatttgttcaaatctctatctcccttacaaagctaatgattttatgtccccctttaatctgtttt

SEQ ID NO: 10911 - DNA, 1047 bp, Homo sapiens
tgtgtttttctcatccctcatctcccatgaatacatgacttgatttatcttgatcagcctagtaacttgctccacatttttccaaaagtgcaaagcagtttcagctaaaaatacacatatcaaaatgatccaaaagttgtggccacagctcaaaaatgctgatcaattttgaaaatctaaatcagccttggccctgaaaccgagggaagaacctttgtggtaggggacagatttccaaaaactcaccacagtcctgttcttagctggagtttgtgctgatgttgccagacaactgaggaatagatgcaaaaagcaggaagcattattgaattgagctctagtgccaatttgggaaaagcaaattaaaatgtaaaagaatatttttccactcctggcatctcaacataaaatggcaaaatacatggttgctgaaaaagttacagaaattgctaattttgccaaaaagtaaaagccaattgcaaattcttttttgcataaaaaatgcatagacagttagaaattctaatttacaaataaatatgtatacatttaagttggagagtattttgacataaatgactgtgtgtgtgcgggcttgtttcaatatcttatatttttcaggtgccacttgaagaatggatgatgatgattttggtggttttgaggtatgcactgttatttacattagtttgttttaactttgtgggattataatggagtaaactattttgaaaatgtattatatttcattggcattcatgatatttccttgatcattttaatgtaattctggagtaaaaagatgaaatcaagaaaaataaaaaaaaaccctctaaaaattaaaactgatgtattattatagaacatttggacttgcccataggaatggtttaaattgagttaattaagtgctaccagtgtaagcactaaaggaaagattttaaaaattgtcagcagatgattttattgggatacatgtctgttaggaaatacttgtgagatgatggatgagtactaaagatcctgtcacatatttgcatgtttata

SEQ ID NO: 10912 - DNA, 1032 bp, Homo sapiens
tggcccctattagtctttactttgaagctggatcttttcctatcctattaactcagagcatgctttgattgggggttaacgtgactcctgggggttgattatttcaattaggtaggatattgaaacaaaagtctttagaagtatatttttaagcaggtatagttatttttttattttttctttgttgtatttaaaaataacacacctgaatctgctatttaagaactagagtgttaaccaatttcataatttttcttctatcctatccctttgcctttgtccctagaggaaccactgtcctccattttatgttagcatttccttgattttgtaaaaaaaaaacaacaacaacaacaacaaaaaattgtgtgtgcttgtgtgcacatatatatatatataagagctttgcttgtttatgtgctttataaaaatgggttcatactgtttgaaatcttcaggatttatatttttaacccaaattttgtctctaagattcagtcatgttgtttcatatatctgtagtttctttattttcactgataaataattgattatgccacaactcaggtacccatcttatgtcagtatttaggttgttgccacttgtttgctgttatgaacagtaactggtggaaactttctgatatatatttttagtggtagcaagtctttctttatttagcagttttgcctagggaaggattttgtggagaccaagttatttttcctctggtgagtaattcttgagatgtgttgtttcttttttattatataatttcccctttgctgtttcctctttacttttattgtgacttacagaaaaccttgaagaaatggacaaataattcccatatatccttcattcattttcttcaaaggttaacattttaccacatttgctttatcattttcttccctttccttctcatttttcttattctcctcagtatttatttagtgttctttttgttcttacactgaggacattcaatcaaaatactatgtcccaaagtaacttgggttagttcttac

SEQ ID NO: 10913 - DNA, 1035 bp, Homo sapiens
tttatttgacatagccagataaccttagatattcctcttaggagtctggcctatcaaacttaaggcattgaagagtagaaaatgcatgttttgtgtagtcagggatatgtttggtggggatggggaggtggagagagagattgagagacattgagcaaagaaagtaataaaagaaatatgttgagagagactgaaatagagtgagagcaggagatatacacatacattgacatatattgtgtaatatatatatatatatatatattcaaatacatatacaacccctcttaatgtccctatcaatttatcacatataataaacagcataatgtaatatatacacatatgttcatatgtgcaagcacacatattcattcgcatagccatatatcatatgtatatatggaggtgggaatgggagagtagaaggaggagcttgagggagagagtttgagaggaatgatactgagccatacattctcaacttttccttaccaactcaaggattcaggtcacctcaccttttatgtgtagagagggagagagaaagggtggggtaagaggtcaagagagttgttgagtttcctattacacagaaaaatgagcttagggaaaaggtgtctccaacagttcaatttctttacctgtactttcattatttataaaatatggaggggagaggaatgttcctttttcatctttatggtcttttctggttctataattatacaactaaatttatgtaactggtttgatagcaaattttatacagcaaattcttatggaatatttgtttctcattttataaaacgacttctctagaaataatgtatcatctgaccttttggtacactggtaattttgtagtcctatctaggctgatgcctctgttttttgacagacactatgcattattctaacattaattttaggaaaattgacattacttttctaagagtgaggtaatgtttttgctggcttgccagctacttttgccaggataggagagagagaaaaatagcatctgaaagatgt

SEQ ID NO: 10914 - DNA, 1024 bp, Homo sapiens
tttccctgttttagacaaccaaggtttcaactgcccatctacttctctatcagactattacattactctaaggaggccatctctctgtccattgttggacattatgggctgcacagtgtgttccttggtgtgaagaaatgatggtcaactatccaaattcatacagtatcttctactctggtggaatactgtcaattcctgtcaagacccatgtgtagccctccagggctaccagcatcggtctcatttgccagctatgtttagggccaccagggaatttgctccatagccatctgcagcctctgtctcccttattgacaaatagaacagttcctactggcattatgtatctgagagtgtgcaaaaggaacatgcctagattcagcccacgtctgcactgctgcagtgcccgcgtacccactcatgtcgtagacccaggtggccaccccaaggcagcacacagggatatctgcttgttgatttcagtcaccttccaaacatggaaaggagttctgatgagcattgacttgttctgttttaatgcatccctcaaaatgttgatagcaccatgatctacatgaaccttgaattatttttgatgtgttactgttttgttttctctcttctttctgtaacaactattgtttggttgctcgatctactgaattgcctgttttattgatttttctttcctttattttctctctctaatctgtctgattttcttaactttgtttttcttttcttttttctttttagtcagggtctcgctctgtcacccaagctggagtgcagtggtgtgatcttggctcactgcaacctctgcctcccaggctcaagcgattctcccacttcagcctcctgagtagctgggactacaggtgtgcgccaccgtgtctgactaatttttctactttttgtagagacggtgttttgctctatttcctaggctggtctcaaactcctgacctcaagcaatccacccaccttggcctcccaaagtgatgggattacaggtgtgagc

SEQ ID NO: 10915 - DNA, 1026 bp, Homo sapiens
agaaatattaggtattatcattatcatttctatatgtaacatgtcagatttttttagtgtagcaattgcaatactttttcattatctcatagctgatcattagttggttgtcttcgtatagattcttatttcagtcttcttagaaatatccacttcggaataaaagattgtggcccatctcttcaccttcttgggctcagttaaaggcagcattctttcgttaactttgaaaataaatagattgctacagattgatgaaaaggacgtgaaattttgttgaagtacaaaagaaaacaaacaaaactaacctaatgtgcctcatatgccaaattttcccatgtttacttaatttttttctcttatgtcatgatttcaaaaatcttttattctgataattaatgacagtaaaattaatgtacatcttggaagactacataggcacatgccacatcgaagattgtttactgcaagcaacataagaattttcctttacttgtttaattgggcttttgtcttgaacttgtcattctctaatatatgcactcgctcagacttcatgagttcttaatgtctcatcttaatgttctccatcaaagattaccatcttatctattatgtagagtatcatatttttgagataatgaggaactgtattagcatgatccttttttgttttaaggtccactcaacagttgtgattgatcaggttactttaatcctttgattctcaacttctacagtgcatagtaaattatttgtgttgctttttaaaaatgcatatgccaaggagttttctttcctggaaattctgaatctgtagatgtaggtaggggctagacatttgtcgagtttttcttttttaaaaaaaattctattaagttattctgctaccccatgggaattattaaccattgtcctatctttttatatttgttggtcaatgtattctattttctttcagccattatttttctaatttttgttattaattaatattgagtctcttaaggttttgtgggtgggtgt

SEQ ID NO: 10916 - DNA, 1051 bp, Homo sapiens
ttcagttaattctaaagcagaataattagaagcctgcactctagagtcagactatatgaattgatccctggctttgtcacttagggcaagtctcttaatctctctgtgcctcatttttttcctctatggatgagatacacaagtaattactacctcatagtactattatatgtattatatgacatcagatgtgcaatagtgcttagattagagcttgacatattctgggtgtttattggctgcattatctttgtaattcttagctaagactgtttgtatagctagtatcagaaccagggctgggattcaggttttctaatttctagtctttagaagaaaagtttgttactggtatttcatatgttgtcttgtcaaagaacctttactttttacaaaatttactttggtgtcactgttgtatatgaatactagaccaaccttttcttcctctgtactgtttcaacttacacttttgacaccagatgtgtgggagttttctgcatcaacaaccagttctccaactgcctggacaccaaatcggtgttctacaattcaattccattctgacactaactcatcaaagttaacgttcgacttcacaagtttaacagctcagtcccagaagactgacctcacttcagatgccagttgcaagtattaggtccccagggtacccacactttcctctgacttgactacagtgttatgagtttccacaactggtctccccttccagtttgataatttgctagaatggctcacagaactcggggaaacattttacttacgtttcttggtttgtcataaaggatacaactcaggaatggacagatggaagaaatacataggacaagttatggggaaggaaggagcctggtacagagatcctaaaatcttggaattttcagggtgataagagtatctgtggtagcttcgagatcagcatgggggctatcatcagaaaaaccgaggcatgaataaagggttgaaactttcagcctcatccctccagcatccaatggcttaataagttacacctatataatgaaac

SEQ ID NO: 10917 - DNA, 1025 bp, Homo sapiens
tggctctgtgtccccacccaaatctcatctcgaattgtaattctcatatgttgagggagggacctgatcacctcctgtctagggagggaagtgtttggtttatgagggcagtttccccatgctgttctcgtgatagtgaattctcatgagatctgatggttatataaatggtagtttttcctgcatgctcacactctttctctagcctgctgccacgtaagacttgcttgcttccccttccaccatgactgtaagttttctgaggcctcccaagccatgtggaactgtgaatcaattaaaccttggtttgtaaatttctcagtctcaggtatttctttatagcagtgtaaaaacaaagtaatactgacatcgtggttgctgccaagttttggcaatagataaaatggatgtaaacatccatgtgcatgttttttgtggacatgagttttcaacttatttgggtaaataccacagaagtgtgatttctggattgtatgttgaaaccacatttagttctgtaagaaactgttaaactctcttccaaagtgtctgtaccattttggttatgcaccagcaataaatgagaattgctcttgctccacattctcaaaagcctttggtgatttcaaatgctggattttggccattctgacaggtatgtaatagtatctcgttttaattcacatttccctgatatgggaaatgtgatgtgaaacatcttttcatatgcttattgccatctctgtatcttctttggtgagctgctaaagtcttttacccatttttttttaagtcaggcctttttttgttgttgagttttaagagttttctgcatgctttggaaaatagtcctttatctgatacatcaatcttacgtattttatcccagtctgtggcttgtcttttcattctcctgacactatctttcatggtgcagatgtttttaattttaatgaagttcagcttatcccatttttgtgtgtgtgtgcgaattgtgcctttggtgttatatttaaaagtcattg

SEQ ID NO: 10918 - DNA, 1028 bp, Homo sapiens
tttgaaaatacctttagttttttggagcaattgctaaaataaagtaagtaattgtctcttctatatttttgttctttatttagtaaattcagcaaacatttagtcagctgcaccatgtgccaggtactgctctagcctttggaaatacagaagtaaatacatcagaatctctgcgtttctagtttttcttagggagcttacattttggtggggtatggaactgacaatcaagtatgatgttttgggatggtaaatagcataaggaaggagcagggtaatgaattagtgatgcagatgaagagctggggtgctcttttagataaagtgagtgagatcaggcctcagagattaactgaattggcacttaaaaagagacttgaatgtagagagtgggaccaagtcatgcagctattttgaagaaggaagttccttatagagggcacaacatatacaaaagcctgactgataaagaagagaacctttgagaaaaggtaaggagaacaggatggctagagctaaatgagcaaatggaatacctttatgagatgaagtaaaaaaggtgatggcccacaaggaaagtgaaaaaagtgattgagatggaggggtgaatatccctatcaaatattgctaatatgtctagtgaaatgtggatttacaatggagtagtcattaattcatgtagtatcttattatgtcacattgaagggactcaaaaaaattgtaatttaatgtctaaaagggattagtggatttacagtcatagcaattatttttagtttttaaatatctatatatatttcagagaagtaaatagatgacaactaagttttatgcataagatatattacaaggataaaatgggagagacagagggatgaatacaaaagtttaaggaaagagaaggaatgatgtaaaattttctagttaatatgtttatatattttttaaataagtgatggttaggtatacataggttatatcagaaagagtaactgttcgagttattatgtcaacaagcatagtacaca

SEQ ID NO: 10919 - DNA, 1030 bp, Homo sapiens
aaggcaggagaatcacttgaacccgggagggaggtgaaggttgcagtgagccaagatcgcaccattgcactctggcttgggcacaagagtgaaactctgtctaaagaaaaaaaaaaaaatcattttactaatattcccctctctaaagtacttctttttaaacacaacatttcaaaactccagattccctttggaattgctaaataacctctaacagagtttctggaagtgtagactatggattacctgcatcagaattacttgcttgggtgattattaaacatgcagattcctggttctctgcctaaacttttcgaatcagaatctcctaaagaagcttcagaaatttttattttaatttattttccagatgattctaaacacataaacattattcccagacaactaaagaaatatctctaagtcaccacagatgtgactgacttcattgaaagtgtacttcaacaagtccctttaagtttgaccacttcatgtatgtcaagaatctgaacagtgaattaactttagctaatagtaggagccaagaaggtgcaatggtaactgaagagaaaagggtaataagaaaattttttcttagtttgaagtgtaatttgaagagacactcaacataaatatactagtggattaattttaaaatatgatgttgaagaagtagagagtagaatggtggttaccagaggctgggaagaggagtggatgaggaagatgttgatcaaaaggtataaaatttcaattagagaggaggcataagctttagtgatctattgcacagaatagtgactgtgataaataataggcactgtatatttcaaaattactaaaggagtaggatttaatgttttcattacaaaaaatgataagtatgtgaaatgatggattcagtaattagcttgatttagtcattccacaacgtaagcatgtatgaaaatatagcattgaaccccatatatagttctgatcaattaaaaataagattaaaaacaggatgactacagtcaataataattta

SEQ ID NO: 10920 - DNA, 1039 bp, Homo sapiens
atcctagaaagaggtcccttgttttaaacaactaacaatataaacttgctctattttgtaaaacagttttgtcacattgtcagtttcaggttcttgactttgccacacaaaagaatctgagaggaagtccaaagtaagagtaggcaaagaagtgtattgcaaagccaaagcacattgagagaagcagagtgggctgctcaaagttagtgacagcagctagtgcctcaagagggattccctttacgcaagctattcatacatattcataaaatactggtgatatcaagaatgcaaaagtggacatgcagttggagcatgtgctcagtatttacatgctttaacatgaattgcatgtgtcattaacatgtaaaatatccacctagaggtgtgttttttactattaaaatgaggaaaatgtcactcacaggtaaaacccaagcctagctgcacatgcgggaccctggagacatccttagttttccccaaggcaggaatttgtagcgtatagcttcttgggcttttggtgctgactggctggagactgaggaagctacattataaataagggacttttgttctcttccccaagctatattgcgtattaggaacttgtaagcatctggcggtctgctggtgtcctgtaggactatttatcttgcaaaatagttaggtgctgatgcacaaggaacccactgcaaaagagcccacggggcttcacacaaggggacaaggcagtatggcctcctaatcttacttattctgcttcaatatgtctatctttgttgtcacccaaaactgtatgactaatttccttttcctcgaaaacctagcttttgatgttctgatagcttattgtggtacaagtcaaatctacttcccatatcatcatgatttgctcattaacctccaaagcccaggtacatatggatttcagaaaatggtggttagcgagagaacattaatttgaagaattggacccacaaacattaattcattctacaggaatgtatgaccacataataaaagccatacgtgctag

SEQ ID NO: 10921 - DNA, 1024 bp, Homo sapiens
tgcaaccgcacagggccttgcacttggaagggccctgcgtttggtaatgttctgctatcaccgtctgctggcttaataattttcaaagaggctctggatcttcattttgaactgggtcctacaaattatatcctgaccccaggctgacaaacttggtctaaaactaaccaaataacagtgtttgaacagcaatcccacatttacggtgagttctccagtacaaacctgaaatttatctgctgctcacttaggtgctcttggacatgtcattcagtcttcctacatttcagtttcctcattgacaaaataaagacaacagatgacaccttctactttctttattttcaaggttgtactatctctaagtaaaaagaggtaataattgtaaaaaatgtctacttgctttgaatagttcttttctaaaaaatatgctgttgttgaagggttaaactttgccctccatttttcagaagtagcttgaggaaggttgattgagcacactgaaaagactgtagaacctttctgacccttatagtttggtggaaaataaaacaaaaagtaggcaagtattcagtgtgttaaatactcctgaaatatcattatttggacaaaattagaattttcaactaaaggtgcagaataacttcttggatcccaaaggtagttattgaattaaattaatgtttgggtctaattcatccaaacgtcgaacggtgagaaaatgagccaatgactgaaattttttgagggggtaatcctttttgtttcatttaatttaaaaaatctgtaagttcaaaagtttgatcaagtcatcctttaaaatatcctaggaaatgccaaatcaatttaaagtacacctagtctcttgccaaatacacctagtgaccttttgtaactctggtgcctcttaaagaggaactgagaaaacaggcaagtcctctgtccccagactcctcccttaactactctctgacctcaaaacttatctttattccagctgtccttgttagcatgatggcaatac

SEQ ID NO: 10922 - DNA, 1068 bp, Homo sapiens
ccaggacgggggacagccttgtttttctaatatggtaaggcccatgttctttgatattgcttcttgtagtataggatatggaaactagagaaactacattagagaacttattcaaaaaatatcttcctttgctgacaatatatggcttaatttacgtgtttattgaatgttctgtcttaatttcactggatgaatttgctagggctgctacagcaagataccactgactggatggctgaaacagcagacatgcattttctcacagttctggaggctagatatctgagatcaagatgctggcagggttggttccttctgagggccatcgggaaggagctgttcctggcctctctctctctttggctggtagatggccatctttttcctgtgtcttcagaacattttctctctgtatgtgtttgtgtgcaggtttcctctacttataaggacaccagtcaggtcagtttagggcccactctaaagacctcattttaactgaattacctctataaggtccttatctccaaatatggtcacattctgaggttatcaaggttagaacttcaacatattaatttgagggggacaaaattcagcccataacaatctcttaattgcattgtgtgtgactcctgatgtcaatattcagaaagttgctgatatacatcatgggaggaggaaagagcaaggacacttatatgtagcaggcttctcctgtgcctggaacattgggctaggtagttcagagattttatttccattcatagccacttgctgtgtacttaccctatgccaggttctttacatacattcccattaagcctcacaacaaagcaacaagccaggcatgagccccattcaacagaagacagaactgaaatgcaaaggtgaaaattcttttcaaagctggcattcacaccccgacctatcatactaagactcctttgttcactttccacaacatcagagagacacctacctactccgaccttgtcaggcagtccatggccattctatcttgtatgatctaatttcaggaatacttttcctatgatgagtggaaaaact

SEQ ID NO: 10923 - DNA, 1028 bp, Homo sapiens
gggattaatgggtgttctcttcttctgaaatacaatgttctgttctgttttcatgaggctccaattgaaaactcattcctgcccctgtcctcatttccctccctgggtctgtgaacagctttctgaagagacagagagaagtgagctagctctgggagtaggcagtggaagagcactacagtgctttccatacctagctgaaaaggacctgtagaaaatctgcagacacatttatgatcagggacttctttcccttcctaaccaaaatagaaaacaaagtctcagataaacaggccagatctccaagtcttgcgcatttctccagtcctgtctgcatttcccccatctctaccctgagccaggctcctaccagccccgcaagggaaaagggagtaaaacagcctttcaatatgcttaggaggatttgtcacaggtgattctccataaaagtgtaaggagaaaacttgtaatgccatatatgaactgaaatggacaatcgcaagattatgtgtggctgaagacatcaccattgagacagtaaggccggttagacgagctttcagtgacagaagttaaatatgatgcttttgaaacaccgatgtgtgtaaagacactaaaaacaaatgcaacataatagccaaaacttgtacttgacagaaacacctagagctactgcaggaatgctttctctgtttgtgtatactctgaggatggttaccactgaagtgttaagtggctaaattataattgctatgggaactgtaagtgaaacttgacctttgatacacttacatgttcagccataacattgcattaacaggctcttgcatttacctggtgtatgcggctttgcttcaggctttcagggagagtaacttgaactaaaaattgtttaagaaggagaatgaagaaagcttgattcctttcaaaatctcatccactcctagcatcagagctcacttcttcaaaattgtcttgtaacaatgcttttcaaggcaaggtaacaaattcttgtatagagactacta

SEQ ID NO: 10924 - DNA, 1058 bp, Homo sapiens
ccgcctcggcctcccaaagtgctaggattacaggcatgagccactgtgcctggcccaaattttcttttatgatcgaccactcttcacattcatcactcactgttataagaaaatcggtctctgagcattacatactcttccaatctatttgaacttgtccccattgccttgtgtagagacttactaatgtttcaatcatagtgatatttcattgttttgattgttaaagagaaattattcaaacacattttttaagtgtcaagaaagattttattcaagactattgcaataggggtcaagactattgcactaggggagagagagtgaattcaactccaaatacaaatagggacaagtggggatttagagtaggagagaaaatggacagttactatgaggaacttgcttaaggtatcaaggaagggggtaggaggagaggaattctcctcactcttgatatctagagtgatattttacctgtttctttttcttcatctggattcttcatgggacaccttgatatcactctagatatcaagagtgaggagaattctcaataaactggcttaataggattctttgctaaagcagggttcaggaggtcaatgtcaaggcttagttcagaagaggagcctgactaaagttgggtcaaagaggaagtctttgtctttgttaatctttcaaatttgaattcacccactaataaggaccaatttagaatgctatatgtactttacaagttcttttctagacctggaaaataagctccatcattactcataatgacattataggtaactgacgccagctgtcttcataagaacaaaattatctagcagaattgcacacacactgacaatttggtccaaatgaattctaggaaatctgattaaactcagagggtaatgaaaatatttgtagtatttatattgtgcttagtatttgccaggtactgtcctgaatcatttgcatggtttaatctcttagtcctcccaacagtctattgggaggtattactaacagtctgtagggaagtactattactagccccatcccag

SEQ ID NO: 10925 - DNA, 1080 bp, Homo sapiens
atgacgtaaactacatcaggtggtgttaagtgctgtgaagaaatggaaaggatgagctaaacaggagtccagagtgtgcaggtgaggtgggtattacagggatcagcctttcagctgaggcagcagatcatgcaactgtgagtgagggaggcctctgggtagggggaggagtgagggctgagagctgcagtagagcatccttgggcatgttctgggaacagacagcactgtgtctgagtatgtgttgtgatgggagagggaaaaggagcagtgataggaaatgcaatcagagaggtcatggggccacattgtccagtgccttgcatgtgagccaggcaacccttggagagttttagcaaagaagtggatcaccgggtctgacatatgaaaaatagactgttagtgctgcaaaggtgagggcagcaagaaacacttagaggcatttacaataatggtttggaccagtttggtacaagcagagatggtgagatgtgatcagagatgtggttggatatactttgaaggtagagctgatgggatttgccaaaggaatggaaattgagtgtgagaaaaagagagtcaagggtggcctcaacatctttggattaaagaactcatagaatagagccttactcactgagatagggagaatggtgaagggaagagactgtgaggggtagttcaggagattgttttgagtcaagtaaagtcagagatgccttttagatatcccaagtactgtggtgggtagagtttgtcatatttgatgaacttatagaagtcaatatctgaccaaagcaagcataggagaccatgctgtccaatgtgctgaagagacaggcttgggccagactacactggccttggggagcactttggagatttcagccctcatcctaaaagcaacaggaatccatgagtttggggtatcagattaagagttccaaactgggactggctgcagtctggcaacgagtttggagttggggattgataggagtaagagtggatgcaggaatatttgttaggaaatacaacagtccagacaagacactgtggtggcttaggtcatgtggtggt

SEQ ID NO: 10926 - DNA, 1151 bp, Homo sapiens
aattagtagatgtctctcctcgtgtcataggttaatgcttgaacttggctctggattgcatttgcatgtttctcttcttgctaatcaatgcttctaagtctttactgtatcaagagcctattcttcattattaattttgtttttagatcaatgtaaaatacatttaagtctttctcatatttcaaagcataaaaataaacaaacctcctctggccattctagctccttcttccctccagagctaggcttctggaacaagttatcctgttatagagcttccacagcttcacttgcttttaatcttactgactgcagtctaatttctgccctccccagttcaatgaagctcctccttcaatgactgctaattatgtcccagttgttgaaactgatggacattgccctattcttatttcacttagttcttctgccccatttgacactgatgagaaatctcatttgtcttcagtgtccttgctttctcctctatgttcagtctttctcacgctccttgtaggctcttcctcttcgatctgtcccttaaatattggtatgacaccactggatgaactcatctagtcccatggttagagttaccactgatgtgctgaccctccaaactagaatttccaacccaagcttgttggaatatctagttgctttattagatatgcaaaagcaacagaaattttgcataaagcttctctcataatctttttcagcagacccgatagttctcttttttcccctttcctagtcaatatcatcagcacctgtgtacttatcttaagcagaaaccaggaagtcatccctcttcagcctcaccttctacatccagtagtcacaaagtcctgatgtttttgccttcttcttattaaatttctgtcccttctttcacccttttcacagctatattttgattcaggctctctatatttctctgttaaattactacacatagtctgttatccagttcccctgcttcgagttgctatttgtctaattcactctccacactgcaactggtcaactttctaaattgcagatctgttcatgtcacttccctcctcaaagttcttcagtggtactcttaaccttcaggataaaacttatccctttatggtatagctcatgattacagctattatctc

SEQ ID NO: 10927 - DNA, 1090 bp, Homo sapiens
gcctgctttaaaattatctgccggaaaaggactccagagatagtgccactggagctcaggaagagttaatatgttcaagaaaatgcaggagggcatttctttcaggtagatgcctaggctctgcctactttgcatgcttctatctgactatgtaaggcaaaaatttatagaagtataatcatgcctttgctgcaaaatgagaaatagacatttaagaagaaatttccatctcatcgaatgagcattttggtgctatagtaattgtttcaatttaaaacattcatttgtacatattttctttcttttttttttttttttttttgagatagggtctcactctgttgcccaggttggagtacagttcacaatcagctcactgtaaccttaaactcctgggttcaaaggattctcttgcctcaacctcctgagttgctgggaatacaggcacacactgccaaagctggctaattttcaaatttttgtacagatgggatctcactatgttgcttaggctggtcttgaacttgtggcctcaaacagtcctcctgcctcagtctcccaaagtgctaggattacaagtgtgagccaccacacctggtttatatatattttcaatagttttaataaaatatgtttatatttaataagatatatttatacaaattttcagtagttttataacaacaaagtcccttagaggcagaggatagactttttttaaatttctgagacatggtctcactcttatcactaaggctggagggcactgcatgatcattgttcactgcagcctcaacctcccgggctcacgtgatccacccacctcagcctcccaagtagctgggaccacaaatatgtgacaccatgcccagctattgtttttaatttttttttttttaagacatggtggtctcactacattgtacaggctgatctcaaactcctggtttcaagcaatcttctggtctcagcctcccaaagtgctgggactacaggcatgagccaccacacctggctagagaacagacttttaacaacaaaaaagtactttttattctaaggttgaatttaggaggctgtataaagtaaa

SEQ ID NO: 10928 - DNA, 1029 bp, Homo sapiens
tgctttcttaagatatagactatgttccaaagagctcgtatccaagacaaatagaacacggcagaattatacacgtgtggtggtggggaaacaggtcatattaagtctggtggagtggagggaggcatatgagaagacttggaagagtggatagagtgtggataggtgagatgtgcacacgtgcctggcagggcagctggagctgggaaacccaggcgtgtttgggacacagccagtagtccatcttggcagcgcatgtgttacgtgtagggaagaagttagagatcaagctggaggggaggatgggccatactgtggagattttgcataccatgcagaggaattgtatttaattctctatgcagtagagatccattgaaggagggccatgtgtgcgcatgcatttttgtgtgtaatttggggttgtttgctcatttgttttcatcatggaaaaatactgatgaaagtgggcttcaggaatattaatatagccaggggccgggggaggcagtggattagcatagggagtagacggaggaagcgagacccattaccagagaggagtagtatggaagactagaatgagggtgaggcaacaggtataaaaaacatctccatgttttgggaaagaaaaaaacaataggacatggctactgctttgcatatggggttgcacctatcaaattaactccagattagaacatgcatacttgtcatgttttgcatttctagtaccagggatttaattcttttaaaattcaattctgttgaaattttactccatgaagcaatgcgtttttgagagctaatcctgatatattcaaatctcaatgacttaagtttatggagtggacttcttttaaattagtgattccctgatttgcccgactgttggaatttccagggcatgttgaaaatacagattatcagactcttaactctgcagatgtatttagtgattctaaaatggtacccaggaatctggatttttcccaggggccctgtgtaattcatatttatgagcaggca

SEQ ID NO: 10929 - DNA, 1006 bp, Homo sapiens
tttctaaatttctcttaaatctgcctgtcttctcttcttcaggcctactgagaaattccttatgtccaagtatgttcctagtcccaactgccacaatctatcactacattgcttcaacaacctctaatcttcaaccttccaattctctctctatactgtaataataaattatctttttaatacataaatctgatatttctcttcaaatctttgtaaaacttcccttcccactacacttaagagcttggattctatcctaacatgttttacaaagcccttcaaaaaccaggtcctgctaacctctcttcaaacccaatcactcacagtctacgttccaaccatattaaatcactttcaattccttaaatatcctattctctttgccagaaatattttttcttccccctaccgcatctctacatttgactaactcctacttactcttcaaggtccagtctactcatctctaccttgagcaagcagggggaacaaaaaaactttccatggccttcaaagtctatctgcttctagaacgttgtacctttatcacactatttctaattgcctctttttctgtttcctccaccggattgttagagcaggaaccatgtctaacttgatctttgtatctccaatgcctagcgaacaggtattcaatatttattgagaaaaggaaggaaggaaattttcccagaaacaccacagtagcacatctttcaaatcacagcagtatgtcatacttaggtaagtaaatatataaaaataagatccacaagaaggattttcctgttgtctactgtcccaggacctagaacagtggccatcacatagtcagtatagcactgttaaacaaatgaataaaacagtgaattacatttctaaaagtttatataaatgttatatttgtataatgagctttctaaatgctcttttaatttatatataagcataaagatacggcaagcagttagttttacaaatctcctaataatacatacaacctatt

SEQ ID NO: 10930 - DNA, 1080 bp, Homo sapiens
cggagtgcgcatgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtgggtggcccgtccggagcgggaaaacattccggaagtggagggccgggccagcgtgattgacaagcgggaacccctgtgtggggacgggtaggcctaggaaggttgtgcctgcggtggaactgggcggtgcgcagaagtgggcattaacagcagccgcgtgtctgggtcttagatttggcccagctgtgttgagcttttcatggattatcttacgtagataagacactgcaacagtgagtgagcgcttgtaacccacctgtctcttacggaaactgagccccagcgatgctaactttagcaaggatacagctgggatcctaaacttggcaatcagagcccagagccgataaagttagctgcatgagtctagcttcccccagggcgggaatcgaggcggagcagggtacagtacggaggccaggaatgagtgcacttgaccagattgttgacggaagtgtcataaaaatggacttaaatgctgataagcagctgtttgggttccacacagggtgcgagctcaggatgcacgttggaggggacacagggccagagcaaggtgggaatgcgggtattatgggccaggccatcctccagctggtggagcaccgcagtactgcagtgtgtggccctggcttaacagcagtgcggaaaagcttttttcttggggctgtggtgctttccaggtgtgtgaagttaaaacattttagggccatacggtagatagtacctgccacatagttgtcttggtcagccccggctgccatgacaaaataccataaactgggtggcttagacacagaaatgtgttttctcacagtc

SEQ ID NO: 10931 - DNA, 1143 bp, Homo sapiens
aggcccgagctgagtagatgaggctgggagcctgaccagtctcaggctgaccagtgctctgtcttgagaggagctgctggtcagctttttgtcttgggattcagaacgaggagacatgaagactttttacttggcagtgggagctgaagctgaaaggtccaggggctgatgaggccacgtgtaagcgaaagtttgggataagcagaaaccgagtgcgctgagggagtgagattgtggctgtatccggcacctggctgagcaggagagtgaaccccgtgggtgtgtgtttgctggtgacgttcctggagctgtcttgaagtccgagctgccttgcagcttgtagtctgcctctgtttttggctttcccagatagtttcaattcttactctcagtttgtgaacctcccttcagtgaacctcccttcacttatgctggatatctcttgcaaccggatgagcttcactaaagcagagtcatttggacctggattcgaatccctggttttccactttttagctgtgactttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcttcccctttccttcatgtgttaaagctttttcagtacatacccctctctcaggattgaattgtaaatcatgttttttgattacccttcttgtaataattcctctacctctgtagtcatgtttttcttttttcattttttcttgtccccagaatgtctaacaaaacagccaaatatacctctgtgaagacagagggtaaaataatgctagttctgtgagttctctcttcttgtgcaaatccataaactgccaccaatctgtagtcattttaattgcccctaaaccgaagagcatcgtggcaactacctttcccctcgtaaatagagtgacactatcactagtcttattgaggccaaagttataaagatgggctctcgatctactaatattagtaaaatgggtttgggacttactaacatttgtgcttagaagagacagacctggcaaagagcttggagaagtgagttccaa

SEQ ID NO: 10932 - DNA, 1068 bp, Homo sapiens
aacccctaggctcaagcaatcctccctccttggcctcccatagtgctgagattacaggcatgagccactgtacctgacccctttcaccttgtttagcctgacaacccatcttctccctctcaggtctttccatctcagtcttctgcactccaggcttctgcgtcttcttcctctgctcagcctttaattgtcgatgtttctggttctatagcttcatcttcttgtgtgcagtctctgtgaatgtaccctgtggctttattacctttgacattcttctgtcttctaaatcatctcctgaatagagtgttttctcctgtcctgggtgtcccgcagcccatagaagcagccatgctgtgggacaccctgagtggggtttgtgttacctgttgtgcctaccatgcccttccccgccgtggatgcacaggtgccccaccttagctgccccagatgctgtttatccttgatagtcaccttttaagccttatacaggtctatcaagttgagtcaccattaccacttggtgtgtgctgtgccttgtgtaatactgcagttccgggagtcatccaacctggaatgcatgctttgcggggatctatgatgccctcgaattgtatgttacatgtgaacctgtgagcattttctaggggctctgcacctttgtgtcctcagctctgagccccatgcttgctgcaaccagcaggtgttcagagtgaatgaatttgcttatcttggcataaatcatgtaactgttgatgataccccaggaaggtgagcctttggttataaatccttttaacattttccagtctaaaagttttgtggtcttattacacgatgtagaaaacagtgggcctcagttattcttttgctgttgtgccggagtataccacggttgtttttgaaagataactttgaccatacccttaggaacttcctcagctcactttcaaatggagggcactggctttctaaccattgtgtctcccagcccagtgacagctgaagctgactgcttccgatatcacagacagcacagaagagccgccctccaggtgctgctgggaaatg

SEQ ID NO: 10933 - DNA, 1045 bp, Homo sapiens
cagtattgtatcctccaacgaaaaaagacaatttgagtattaggagtccccctcccttctcctataatttcatataaaagccttccaacttgtagcggactccagaacactttgaactctgttggtatgtcttcccagattgatcctcacatttggcctccagtaaacctttatcagattatttctacctcaagaaccttcgttttagacaacagtgcatatatgtttgtaattgttaccttgatgggttgatccttttatcattataaaatgcatctctttatcagcattttttgtcttagtctgttttgtctgatactagtataggcattcctgctttctttttttgagacggagtttcactcttgttgcccaggctggagtgcagtggcacaatctcagctcactgcagcctccgcctcccggattcaagtgattctcctgcctcatcctcccaggtagcagggattacaggcatgtaccactatacctggctaattttttgtatttggtggagacggggtttcaccaggttggtcaggctggtattgaattcctgatctcaggtaatccacccacctcggcctcccaaagttctgggattataggtgtgagccactgtgcctggcctgcattccagctttcttgtagctatttgtgtgatactttttcatcattttactttcagtctgtgtttttggatctaaggtatatctcttggaaacaataacatatagttggatagtttttaaaatccagactgacattctctgtcttttggattgtgatattatgaaatatatctctggtctttatccctgttttcaggcatacactcctaaaattcgagcagtctccaaagtgataaatgtcttttttgtatgctaatgagttgacttatggctgacatcccctagtttcagaatggagggctggtcacctgaaagaccaaggcccgattaaagggttgggacttttcagccctacccctaattcctggtaccaattgtctatcttagtccattttctgttacttatagcagaa

SEQ ID NO: 10934 - DNA, 1029 bp, Homo sapiens
ccccaccctacggtcacctctatgttaccagacactcctgttactcaggagattacaaaggtctcaggagctctgtgtcaggaaccgggttcaaagaccacgtattagtgcaaaagattgtataccccaatctacaagagttttaggtgccccgtgtctggaatcatgggcagagaccaagtatgtatttcttatcgtgggctactatgacagtaatgccacagactgggtggagaaatttatttctcccagttccggcggctagaagtccagggtcaatatgtttgatttctgttctcttgaagcttctctctcagtggcttgcaggtgactgtcttcttgctgtgtcctaacgtggtccttcctctgtgggccgacatcgctggtgtccctcttcctatgggggatactagtcggattagagccccactctaatgacctcacttaaccaattatctccttaaaggccctatctccaaatacactgagggtcagggctttcacttatgaattttggggagggtacaattcagttcatgagactctctcctccaagttgacgtaaaagccaggggacagtgagggggacgggcagttatgaagcatcattaattctccttagaagtgctgcttttcttctgtcagtgaacactgtgacccattctgcttccaaccttgtggactagtcaaagtagtgagaggaacagagtcctaacgcctgagagttgtaaaatgagtgtcagcatgtggtggctgccttttttttttttttttaacggatagactttattttctagaagagttttaggtttaaagaaaattgaggtcaggcatggtggttcacgcctgtaatcccagcactttgggaggccaaggcaggcagatcatgaggtcaggagtttgagaccatcttggccaacatggtgaaaccccatctctagcaaaaatataaaaaatgagtcaggcatggtggcgcgcgcctgtagtcccagctactcgggaggctgaggcaggagaattgcttgaacc

SEQ ID NO: 10935 - DNA, 1047 bp, Homo sapiens
catgtgtcctttaatatctggagatgtattaacctcttcagttcatgtgaggggaacataattacatagtaaagataaactcattttttaattgaggtaagcatttcaaatagaaatcatttttccagtcctttttttagagttgtgttacatgtggttatatctagggcctttcaaaatctattttcagcttacatgattttcctttgttatagtactaaaggagatgattagcaatatctagagttctgaaaatgaatatttaaatagtttcaggaataaaaagtacaaaagaagactggttaaaatttgttgctacaaagaaaaggacacagaaagacagccaagagagaggtaaagtcatctttttaaatcttcattcacttatctccctatctggtatatggaaattggattatggttatgatatgattgtaaagtatgattttatccatgttcttttttttttttcagtcattcagtgtttgtgtttgagtggtaggaggacatttttgtgttgtcgtgctgtggaatgaaaggctgagctttattttattttaataggaaaataagtcttatcacaatgagttagctaagaggtttgcatattttacctgtataggaccagacagcaaatactttaggttttctgggtcataaggtgtctgtcctgactactcagctctgactctgtttcagggaaatggctgcagataatatgtagatgagtatcagctgtgttctgattaactatttatttatttatttatttatttatttattttgagacagagtctcactctgtcacccaggctggagtgcagtggcgtcatcttggctcactgcaacctctgcctcccaggttcaagcgattttctccctcagcttcccaagtagctgggactgcagttgcataccaccacgcccagctaatttttgtatttttagtagaggcagggtttcaccgtgttggccaggccggtcccaaactcctgacatcaggtaatccacctgcctcggcctcccaaagtgctgggattacagaca

SEQ ID NO: 10936 - DNA, 1050 bp, Homo sapiens
actgtgcgcctgtcacccaggccagaatagtgtttgaagaagagtcatagctccaaaataacctgaaaactaaaaatatacatatataaaaataccttggatctaaacttaagagttttttttacaccgcatgttctcactcatagatgggaattgaacaatgagaacacatggacacaggaaggggaacatcacactctggggactgttgtggggtggggggaggggggatggatagcattaggagatatacctaatgctaaatgacgagttaatgggtgcagcacaccagcatggcacatgtatacatatgtaactaatctgcacgttgtgcacatgtaccctaaaacttaaagtataataataaaaaaaaagagtttttttttaacttaaaaatggttgaaatttaaaatgttgtaaagttgaaaaagagccccttagaaaggaatgattcagcattactgatggcattttaaaaaggaaatgtatctgtgagacagctttagaaaagttttgcagcttggataccgtaaactatgcactaatgagcttcaacccattttcttgcttattttgtcaaccctgacaccaaggatagttaccagctgctgaagaagcactttctggacattgggcagctttttcttttggagccaactctattctttttcagggttatagttaaatcattcaacacaaaaatatgtacttacacagttttagagcttgtcacattggtgacctgatgaatgccacttaaattacctagattcatctttaagcagaattgttttcccttcagatgcttagaaagattgttagtttcttttatatctttaagttctaaatcacaaaatcatatggcaagaaaaaccccagatttcttttccaatctatgaataaacataaagagacagttaatacttaattgatctatctgaactatgatttttaacttctctcattgtttttatttttttattttattttattttattttgagatggagtctcgcactttcacccagcctggagtgcggtggtgtgatct

SEQ ID NO: 10937 - DNA, 1050 bp, Homo sapiens
tcgtctcaaactgttggactcaagacatctacctgcctcagcctccaaaggtgctgggattacaggtgtgtaccactgtacccagcctcagtttgttaatattttacaataatttagaagtagaaccctttcttaaggctgggcgcgctggctcacacctgtaatcccagcactttgggaggccgaggtgggtggatcacgaggtcaggaaatcgagaccatcctaacacagatcgagaccatcctaacacagatcgagaccatcctgactaacatggtgaaacccccgtctctatgaaaaatacaaaaaattagccgggcttggtggtgggcgcctgtagtcccagctactcaggaggctgaggcaggagaatggtgtgaacctgggaggcggagcttgcagtgagctgagatcgcgccactgcagtccagcctgggcgacagagcaagactccgtttcaaaaaaaaaaaaaaacaaataacaaaaaaagaagtagaaccctttcttaagagcattctcaggtcttctatcttaattactgtagttatttccagtcatgttttataatcaggtgctatttttcattgtggcataataagtaatatatttttgtaaatcatgttgaagtgcttgagacaatacaagcaattatttgctaaaatttagaccagggtctcaaaacaacaattacatttttagataatggtcacagtaagtcttttcagaaaaaagcaacgaagaaagctctagaccaatgagattttagtcatcattaatcaatgccaagcgaaaaaatcttaagatgtatttaaatttgtgatgccagtgtgattcagaaatttgaaaaatggatttcaaagtaatgctgtgagcagataggtcattgtataaacataactaatggttcattcattcattcctacaataatgattcagtgtcagatttgggtgttgaaaatacagcagagaacaaacacaacagaaggtccatatttgcggagcctacattttgtgggggaagagagatgataaacaaaatgaatgagtta

SEQ ID NO: 10938 - DNA, 1024 bp, Homo sapiens
ataggaaaaaaggacaaagagcaactagtcagagaggatttgcaagtaaatcagtaaatgggaagagatgttcaatctgagtagtcagtgaatgtaaattaaggaagtttactttttttcccattaatttacaaaaattttaaatatgataatatacagtgacaaaattttttttttttttgagatggagtctcgctctgtcgcccaggctggagtgcactgggcaatctcggctcactgcaagctccgcctctcgggttcatgcccttctcctgcctcagcctcccaagtagctgggactacaggcgcctgccaccgcgctcggctaactttttgtgtttttagtagagacggggtttcaccgtggtctcgatctcctgacctcgtgatctgcctgcctcagcctcccaaagtgctgggattacaggcgtgagccaccacgcccggccccaaaatttttaaataatgataatatacagtgtcggaaagtgtgtagaggtagaagtgtgaattgctgtgaactttgagaacgtggattggcagtctgtattaagatctaaaatgcatacagtgcttgggcccagcagtctcacagaagccataggtgattgtatgtcagttcccaaataccactcgttagagagaagcactgtttaacatctagtatctcatttagaccctgtttgagcatagatcatatgtgtgtggaacataaaagtaatcgaagtatgctcattctttttttaacatatctttccaggcttctatatagttaaataaataatgctccttgacatttatgtatttatttatttagatggagtctatttctgtcgcccaggttggagttcagtggtgtgatctcagctcactgcaacctctgcctttcgggttcaagcaattctcctgccttagcctctcaagctgggactataggcatgcaccaccattcccggctaatttttgtatttttagtagagacggggtttcgtcatgttggccaggctggtctcgaactcctgac

SEQ ID NO: 10939 - DNA, 1059 bp, Homo sapiens
atgtatgcagatggtccctgacttaacgatggttcatcttaatgattttttgactttataattattttttgactttataattttttgactttatataaaccatattttgggtgcccacacgtctattctgtttttcactttcagtacaccagtcaacaaattacatgagctattcaacactttactttaaataggctttgtgttaggtgatttttgcccaaatataggctaatgtaagtgttttgagcatgtttaaggtaggtgaggctaagtaagctgtatttgataggttaggcgtattaaatgtatttttgacttatgatatttttcaaactatgatgggtttactaggacataatctcatcatcagttgaggagcatctgtatatgtatgtgtttagatagatataattagatatctatatataatagattctatgctatgggcattgtaagttctaaattgcttcagtggcattattgtacattcttacataagattgaagaattttgtgattttgattaatttatatccttcaaagtgaccaggaaggtagagtttgcatgcagaaaatttgcatgtatattaattccataaataatgtttgtagttaaattttcattttgtttaaacattttttacaagatagagtttactcagtgctgttatttagcagctgtgtgtatgacttcataatttagggggctgtctgttttgtgttctaagccacgtggctgctgtggtgactgctttagaaactttcagttccctttgctgtgaaacaggtttcagtgcatcgtccctgtgtataaggtcaggtttcttacatggactcactctgtttctgtaaatttgtctgagaattttcaaggcagtgctttcatggcctctcctctaattttgtgtgtgtgtgtttgtgtgtgtctgtgtgtgatgatgaaaaagtcaaaagccctaaaattaaatcagagtttaatccatgtccctaaactagataagctgctttagaccttttccttatcccttacacgtcgctcagtaaatacttgctgattgac

SEQ ID NO: 10940 - DNA, 2012 bp, Homo sapiens
aacttcattgtgcattcaatttgcattgcctttgctgtgttcacagtggcactccatgaggcttaactatggagatcctggtgctacaagccgttaaatagttctctcttctcaacctattcccctatcctgcttttcttttcttcatagcacttattacctcctgattatattttttgtttgccttttgtctatcacctgtcattcttttaccagaccatctagtctcatatgtctatataacctttctgaaaaacatcctgtgggaaatataccatatatacagaaaaagtgcacaaacatgaatatacagtttaacaaataatataaacctgctattcatgtagccaccacccagatgaaggaaatagaatatcataagcaccgcacaatctccatttgtgcccttctccatcgtagctttctctgtcccagacaaccattgtccacaacttgttgtaataatttacttaattttcttttatagttttatcacacataatttagtttttgtctgctttttgaactttacatgaatggaataatattgcatatattatttaatgctttttctttcatttaacatttttttttgtgtgtgtgtgagattctccaggttgttgtacacagtgctagttatttcattttgttatggtatagtatcccattgtatgattgtaccacagtttatccattttttagttgatgggttttgacttgctttcattgtttgggctattatgaatagtgctgctctgcacctgttgtacatatagcctggtgaacatgtttgcgaatttctatgagcgtgatcacggtggtgtagaattgccaatcttcaacctgcctgtattttccaaagcgatcataccaatttatttaccttccagcagtgtatgagaattctctattctcaccatcattggatattgtcagattttaacatttggctcaactgatgggtgtataatggtatcctatggtacttataatttgcattatccctagttactaataagcttgagcaatttttcatatttttatttcgatttcctaatttatgaaatgcctgtttaagtcttcagccatttcaaatgttacctgtcttttcaaaatgatctataggagttctttgtataatatatattctggcccctagtcctttattctttgtatgtgttgcaaatatcttcatctctgcagtttactctttttgtggtgtcctttgataaaattctcaatttggtgaatgtaattgaatttattaatttttctctttgttatgtatttttgtgtctttaagaaatttttccctatgtagggaagaaggacaaaaattgtctttcataattagttctttaacccttcataactttgagtatataaattattgtgaccatctttgaatctacagtagttgaattgcatatatagaggcttgagttcttaaattattctttccagggtgaatattagcatatcacaataggacagtagggacagtggctttttcgctaatgaaatctaagatttttccttttctgctcatgaaaaatgtttctgcttaaattgtaatgagtgtacaagaggcataaatccacagtgggtacaaatgtcaaagattatggtttaaaccagcaaaatatgtcttcttagatatacgaaacattttgtcaaatagcccctggcatcatctgggctaaatgaagaatcaccaggacatgtgatacagtgaaactattccacttatagtaacagcacttagtaattgctttcattaatccaggcaggttaatattctatctacttgcataacaatgtcaaaaaatctattatctactgaaaccttttatatagcaagttaagctcctatttctttcataaagattgagattcaaatattaatccaaactactcagaatcactttctcttcctcacttttctgatacccccactggagagtgactgatcagtgcattatctgtcacctcagagctcagagtgcccctct

SEQ ID NO: 10941 - DNA, 1049 bp, Homo sapiens
ttgttttcttacggatatatacctgaaactattcttgttaagtgagtcaacaaggcccacctggcagaagaggaaacccaagaacattaaatcagttaagatggaggccaaggcgggtggatcactggagctcacgaattcaagaccagcttgggcaacatggcgaaagttcatctctacaaaaaatacaaaactagccaggcatgatggcgtgcacctgtagtcacagctactcaggaggctgaggtgggaggctggcttgggtctgggaggcagaggttgcagtgagccaagattgtgcctctgcactccagcctgggtgatagagccagactttgtatatatatgtgtgtgtacatatatatatatgtgtgtgtgtgtgtgtatatatgtaatacatatatattacatatctaatatatataatatatatgtaataaacatcatgtatatatgatgtttattagccctccaatgcttgaaatcaggggttggaatcaaggctaaccaactctggtctggtcaccatcactgaatgcttgcggtagccatgtgaacattgtttattgtcgtatactcctgggagagtcccagggatgagcttttataaagttgcagacgggaaagggactctcactttggagagaattaagcatgtcacccagttgcctaacaagttattgctgtgcaggcaaaaaacagacaaaagactcacccaactctaagatttttttgatggacttctctaagttcattatgataaagttaatattatgatttttccagttctcaatattttgggtctaaccctttttttattactttatgtatatgttctgggctccgtagactctctggagtgacaagaaaatcttgaaaaataaaaggcgaggtctattggagagctgttcgtggatgattctgatacgtgctcttggttaagaatcactgctctggttttcttcccagtgcctcttacccaccactgttagatcagttctttaaacaccacttaaactcccacttttgtcagcaacctcctcttgaca

SEQ ID NO: 10942 - DNA, 1062 bp, Homo sapiens
tgtgagcccttcaaaggcaaaaattgtgttctttggttttgttttcctagggccttgcacagcacttgccactcttgattaagcatgcttaagaaatgcttgttgagtgagtgcgtgaaaggggggccaataacttgtatggttatttgtacgccatcaaacttttttttttgagatggagtctcgctctgtcgcccaggctggaatgcagtggcacaatctcagcgcactgcaacctccgcttcccgggttcaggcaatactcttgcctcagcctcccgagtagctggaattacagtcgcgcaccaccatgcccagctaatttttgtatttttaatagagacggggtttcatcacgttggctaggctggtctcgaacttctgacctcatgtgatccacccaccttggcctcccaaagtgctgatttacaggcgtgagccaccgcacctggctcatcaaacgtttgatttatcggtttcctagcatataaactagctgcgaagatgtgtatttttttgagaagccatgtggagagagtaggggacacagaatctgctcttcaggcatgctgacagcaaaaagtgactactagtaggccatgagggatggaagagagaaatactataaaaagcatagttgtctggggctatttaaggaagacacaataacacactgcacatcccaggacccctttcaggcatcactataatagcatggtgtaagaactgtgtcctctcagtcctgttcagcttcagccactactatcctttgtctattaatacagcaccaaccacttggtcccaaaggaacgttctggcgagaaatgtgcagagagaatcagttcgccagcaggtgcgattctggaattgtttggctgccagagacccggtatttggtgtgtccgtcattactgggtgtttgtgtccccaagccagagtcatcatgttgaccatcctcctgaactggggctctggttggattcccacctgtttacctggtgccttaacgttcttctccacttatcttgccatacccttcctggagaggaaagaagacaattaa

SEQ ID NO: 10943 - DNA, 1677 bp, Homo sapiens
tcttgctttgttgcccaggctggtctcaaagtcctggcctcaagtgatcctcccttctcggcctcccaaatcctgggattacaggggtgagccaccacacctggtcttaggtttcttaattttatttctctgtgtttctacaggcttttaggccattttactaataattacttttttttttttttttttagtttttttgagacagagtcttgctctgtcaccaggctggagtgcagtggtgcgatcttggctcattgcaaccgctggttcaagcgattctcctgcctcagcctccctagtagctgagattacaggcacgcgcgccatcacgcccagctaatttttgtatttttagtagagacagggtttcaccatgttggccaggctggtcttgaactcctgaccttgtgatctgcccacctcggcctcccaaagtgctggcattataggcgtgagccactgttcccagcctgctaatagcttttaaaaaggaatattgattttcatagttgtgtggcagacacagctgacaccactagctaacttaagcatactctgagaatgaccttgcatggcagatgcacctgacacaaaatttaagcataacctgaggatgaccctgtagcctaagaagaatgtgtattcagagttcccagctaataaatccaggaaggccaactgggagagtcattccttatctgtgagtaacatctgaaccctcagcccatcctgtggaacacaggccatataggggattgaggccctttgttttgggttagatagaggttgctagggggagggtgctaagcaagaatgctgtataaactgcatgctttttacaagcagttgccattgtctagtccagcccgtcaccactggaccaccctgtatgtaaatcctctcagtaaaccttgtctcatttactggctccaggtctctttgaaagcctctcaaacatggcgccatccctattgcagccattagagtccggcgtggcagtggtcaggactgttgaagaaggctgagaatttagggcactgtgaagtgtttaatcatttatcaaggtatcaatttagtgtctctcaaggaaaaaacatatttgttgatttgatttcatgccaacactgatgttttttgctactctatggccttgaatagtcaggcattgactgtaaccaaaaggatgtatggaaaataattgttttcttttttgagatggaatcttgctctgtcgccaggctggagtgcagtggcgcgatcttggctcactgcaacctccacctctcgggttcaagcgattctcctgcctcagcctcccgagtagctgggattacagacgcatgccaccacgcccagctaatttttgtatctttattagagatggagtttcaccatgttggccaggctgctcttgaactcctgacctcgtgatccacccacctcggcctcccaaagtgctgggattacaggtgtgagccaccgcgcccggccaaaataattgttttctatccttagtgaagagctaaagagaatttccttagaataacagcaaaggaacttaaagtgttcagaaaaacaaagtgaggatggtaggaatcctttcgcctgaaactttggaaaaaggtggatgaattacaactaagtcatcttttagctttgctttcttgatcttccttc

SEQ ID NO: 10944 - DNA, 1107 bp, Homo sapiens
agactctgttaaataaataaataaataaataaatagatagatagatagatagatagacaaataaagcaaaaaaacctattactgatatacagaaagtttgagtcttctggatagaagatcaaaccaaccacaacattccgttaagccaaagcttaatccagagcaaggtctttcttcagttctatgaagactgagagaggcagtgctatggaaggagagtttggtactagcagagactggttcatgagatttaaggaaagaagccatttccattacataaaagtgcaaataagcagcaaatgctgatgtaggggccgcagcaagtcatccagaagatctagctaagattattagtaaaggtggatgattttgaggggttcaagacttcagtggaggaaggaactgcagatgtggtggaaacagcaagagagctagaattagaagtgaagcctgaagatgtgactgaattgctgcaatctgaggataaaatgtgaatgaatgagtacttgtttcttatggatgaacatccttcttaaagatggaatctactcctggtgaagatgctgtggatattgttgaagtgacaacaaaagatgtagaatatttcacaaacttagttgataaccagtggcagaatttgagaggattgactccaattttgaaaaaagttctactgtgggtaaaatgctgccagacagtattgcctattacagagaaatctttcacgaaaggaacagttgatcaatgcattaaacttgtcttattttaagaaattgccacagccaccccaaccttcaacaaccaccaacctgatcagtcagcaggcctcagtaatgagacaagaccttctaccagcaaaaaagattgtgactcactgaagacttagatgatcattatcattttttagcaataaagtatttttaaggtatgtacattgttgttttagacataatggtattattgcacattactagactacagtatagtgtcaacataactttcatatgcactgggaaaccaaaaaatggatgtgacttgttttattgtggtatttgctctgttgtggtggtttggaactggacctgcaatgtatcagaggtatacctg

SEQ ID NO: 10945 - DNA, 1050 bp, Homo sapiens
cttggccaccaaaccctaattcagagcaaggccctaactcccttcaattcactgaaggctgagaaaggtgaggaacttgcagaaggaaagcttgaagccaatgggttggttcatgaggtttaaggaaagacaccatcttcataacataaaagggcaagtaaacagcaagtgctgatagagaagctgcagtaagttatccagaagatctagctgagatcattggtaaagctggcttcaccaaataacaaatcttcaaatgtagatgaaacgactttgtattggaagaagatgccttcaggctaggactttcatagctggagaggagaagtcaatgcttcaaagtttcaagggacaggcttttgtcccttgggctcttgttaggggctaatacagcttgtgactttgagttgaaggcaatgctcattgaacattctaaaaatcctagggcccttaagaatgatactaaatgtactctacttgtactctattaatgaaacaacaaagtctgaatgacagcacgtctgtttatagagtggtttatcaaacgtttaaagcctgctgttgagacctaccactcagaaaaaaaggttcctttcaaaatattactgctcattgacagtgtacctggtcacccaagagctctgaaagtataaggagatgactgttgttttcatacctgctaacacaacatccactgggcagccaatggatccaggagtcattttgactttcaagtcttattatataagaaatacattttataaagatatagctgctgtagatagtgattcctctgatggatctgggcaaagtctattgaaaaccttctggaaaggattcacaattctagatactgttgggaggaggtcaaattatcaacatgaacaggagtttcgaagaagttgattccaaacctcatggtgactttgagggctttaagacttcagtagagcaggctgggcatggtggcctataattccagccctttggaaggctgaagcgggtggatcacaagcatagagttcaagaccagcctgggcaacacagtga

SEQ ID NO: 10946 - DNA, 1103 bp, Homo sapiens
tgtcctgaaaccattcacatggagcctaagttaaaatgctctgggttcgggagtgtcttcctggagatcactaagggcttcaggactccttgagatggagttttcttttctctctctctcttttttttttttagtattttaaaatgtatttcgttaattagcagcagtatgccaaagttgttccattattatattttgttcattcttttgtacaagtgtcttccaatgtgatttgataatgccaacaatttgcaagtgattttattgcagcatgactttggttcccaggaatgctgaagcacaggtcctagaacagaggcttgaaaaggaaataaaagggatttgatcataaatgcttctggggttggcataccagatcattttgagctcaaataggagacaaaagaaaggatgttgggaaagctgtatggtggagaggctgaactgttggaatgaaaagacaagaagcatattattatgttaattccagcaccctagatctgcaatgctgaaaggactgccaaaactaaagcttgtcctacaccacgttcatcacaaagaaattctgtttagacgttgagttaaactttctcaactgtattcagtacaggattaagtggttgagatgggccattctgcagttacactgtttccgttccagtctgggtctcctcatgtattagctgtgtggaccttgggcaggtaactcctttgtgcctcaaagaaatggagatgacgataatacctacctcagtggggttattgtgaggataaaatgcgattaatagaaaataattagaatggtgcctgggatacatactgctcattaaacattgtatatttttattattagtgcactgtgctataataggatggctatctagaaaacatcatgcaatttgtaatgcacatttatcatccagttaattgaaagaggtagtgatgggacagtggtggcagacattgaatgctcagggatgaaaaatgagacaggttttatcttgttttgttttatttttgcctctcattaggtatccacctacttttcaaaattgtgttattttaatctttattgcatacagacatattctcagtaaattgag

SEQ ID NO: 10947 - DNA, 1215 bp, Homo sapiens
gtcagagaacacgaggcttgccaccatcttggaagccgcccaccaccatcttggaagcggcttgccaccattttgggagctctgtgagcaaggatccccggtaacattttggcgaccatgaagggacctccgaagcgtttgtctcttccagaattgaaactgtaaaactacaaatggttcttcaaatggagccccagatgcagtccatgactaagatccaccgcagacccctggaccggcctgctagcccatgctccaatgttaatgacatggaaggcacccttccggaggaaatctcaactacacaacacctactatgccccaattcagcaggaagctgttagagcagtcattggccaacctccccaacagcacttgggttttcctgttgagagaggggactgagagacaggactagctggatttcctaggccgactaagaatccctaagcctagctgggaaggtgaccgcatccacctttaaacacggggcttgcaacttagctcacacccaaccagagagttcactaaaatgctaattaggcaaaaataggaggtacagaaatagccaatcatctattgcctgagagcacagcgggagggacaaggatcaggatataaacccaggcattcgagctggcaacggcaaccccctttgggtcccctccctttgtatgggagctctgttttcactgtttcactctattaaatcttgcaactgcaaaaaagaaaaaaaaaagaatcttcaaatggctattgatgctaaagaaagttctgaaggagcattctccaatgcagttatttcctacagaagattttaagtgattttttaaaaaactgcctcttttctaaaaatatttcagcttttattttagatatgggggtacatatgtaggattgttacatgggtatattggatccaggtagtgagcatagtaagcaataggtaaaaaaatgacctcttattcaagagggtacctcattactatttacaaagtgctttcaaacattctttctcattttttctgacaactctggacgtccccccctacttttagaagaaaactaacagtcccaaaaatgttttggtgtaagtcaatatatgaacccaggtccatgtccagaactgtttaccactcacctctttataaaacggtaactgtggccaggcacggtggctcactcctgtaatcccagcactttgggaggccgagg

SEQ ID NO: 10948 - DNA, 1133 bp, Homo sapiens
tggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcaggtaatctcattctactggtgaaagcatgccagtcaaagctttcttaactaatttattccctaattttattgagtatcgagtatcgtcaagatgagagttcagattcttggtaagtggataaataaaactgtcccagtgccagatcagaatgtcataataattattgtttttaaatgatgaaatacctgtgcccagttaggtggaggcagaggtgaggaacttaaagcaggaacacaggagaagatctagatgcctttctgcagatgtagaaaggcagctcaggcggtgctgggctga

SEQ ID NO: 10949 - DNA, 1043 bp, Homo sapiens
tttaccttggtgggagtgctgcgaaatataggcaggaaaattattttcacctttatttagtttatctgaaaagatattcttgaaagacacatatttgagaaaggtgctgaataaatgttggtgttgataaagagaagcaacaaagcaccaaataccctcctgcaaacgcaagcagtgccagtgaatagtaggtcaagggagctcttggtctttggagaatgaggattaatttcagattcagagtgtcttctccatttgccatcatctggggaaaaccacgcccttattatctcatctacagtgcagctttcaagtcctcatctctagttcccataaatctatttatataattgacatctataccataagccataatattgtttgcactattaacatgttttatataaacctaagggcaaaatatgactttattttatgttgtcactttagagaaatagaaaagattagagtgaatgaaaccatcattctcagcaaactatcgcaaggacaaaaaaccgaacaccacaagttctcgctcataggtgggaatcgaacaatgagaacacatggacacaggaaggggaacatcacacaccggggcctgttgtggggtggggggaggggagagggatagcattaggagatttacctaatgtaaatgacgagttaatgggtgcagcacaccaacatggcacatgtatacatatgtaacaaacctgtacgttgtgcacatgtaccctagaacttaaagtaaattaaaatatatatatataaaataaataaaataaaaaaagaaaagattagagtgaatgaagaatttgtgagagatctgactctaattttaggtcggaataaaggaatttattattgtaactctgctataatttaaagacccaatgattcagagtggtcataaataaccaataccatattagataaggcttacacaaggacatgctatcctggggcattcttgatcaagccatccagataacttctctgacttcttcctaaaggttgaatattaacaatttaggtctggg

SEQ ID NO: 10950 - DNA, 1064 bp, Homo sapiens
ctgctggcaccagtctattatattcaactgtttgcccccactgtaactacataacaaccacctctattacaacagtgattataaggcattatctgagagggtatatccaaactgtaccttgcaaagggacttctatctgcaaagaatactaagaaaacatattatgagaaagtcacaataggtacccagagaagccaatctctaggttaaccaactacttccctgtccatttctccttataaatgtgaaaggagagcctacaatgaagaaatcctggaagggcatctcccagctctgagactctctgatgctatgaattcaagttattctgtccatgactgggtctggaggtcactgtgtaaaatctacgcttctaaataaatgttatgatatctcagcatactataccatacttataacatgtatgcttataacagcatactataccatatagtatagttcccaagaaaagggaatgtttcttcccccctaaaaaaaggaaaattcccattatctaatatataaaacaaacttttttgatgatttaaagtgactgtgtgttgtgaactgagtagacaaggcaggaaggagtagtgatgttcctgagttcttgctgaattctgacaacgtgccaacactttgatttctctgtcaaaatgggtgggatttgatatctaaaaaagtataccattacatatctaaaagtatattgttacatggaatatggaagccactgatttaattctggaatgtccgtcaacatgacagccacctaaactcctctgaggcattgtaaacggttaggaaaattgacctttctacacactaaatctggcttcagtggctctcctgagctctaagggagttgggcaggggcagcctgagctccggctgtgagcatagctcaactgatgtgtagttagaatgttcatggaaggcccaggcttgctacttcccattcctttattttaaatgatgtagtgagccaggcgtggtggctcatgcctgtaatccccgcactttgggaggccgaggtgggtggatcacttgagcccaggagttca

SEQ ID NO: 10951 - DNA, 1030 bp, Homo sapiens
gtaagatgccgtctcaaaaaaaaaaaaaaattggtgttttcttggtttgttttgtgttttagtttaaggagacacatttcctcatcttaaggacttttttgctgctctgatgctggtcatctagtccattcttttgctctaaactgagccttgcctcccagttcttcattgcacttcagattgtgtcttactacaaagagaaaattagtctgtgatcagtttggatcagaagaactgaaaatgtacatttagaatagaagccagggatgtgatgcacacccgtgatcccagctactcaggaggctgagatgggaggatcacttgagcctgggagttagaggctgcagtgagccgagatcgtgccactgcattccggcctgggtgacagaacaagaccctgtctctaaaaaataaaaagaagaaaagaaagaaatttaaagtaggaagggctaccgtttgcttctggccaagcttcacctctaaccataggatcttttaaaagactagttctgaggtcctttactctgagtaggtatttatggaataagccattatgtattgacattagaatcagttaaacataaatttttttctctttttatgcactacttgacatcaaaagcaaaaagaggtaagttggctataaacctgtaggtgaacctaatttttcttagtagatttgttcctgagtagctttgcttcaattaaatttctgtgaatcaaatacttttacattaggaagattgtcattggaaattcttattcttttctttgaaaatgaataagcatcttctgtaaacttagattttcaagatatctagtatttaaacattttgcttttcctttaatcaagttatacttacggtttaatttgcttgtgaagacaaggcattttcaaacacttggtttagttttgagataactgaattgtttctcccaccagaaatgtggattacatgttataagtctttcctattttcttaaaaatgaaaaaaaaagccaagaaacaactgacattggtgaaagtctg

SEQ ID NO: 10952 - DNA, 1163 bp, Homo sapiens
tggagaccatcctggccaacatggcgaaaccccgtctctactaaaaatacaaaagttaactgggcgtggtggtgcatgcctgtagtcccagctacttaggaggctgaggcaggagaatcacttgaacccgggaggcggaggttgcagtgagccgagattgcaccactgcactccagcctggcgacagagtgagactccacctcagaaaaaaaagtaatacagaaagtgaccttgcataaacttagtttctcatttctaaacaaaaataaaatgtatctcatagagtttttacaaggattcaagagcttttgcatgcaaattgtctgcaaatatatatatatagcactttttataagcattacatattaccattatttctcatccttctttcttctacatttcttctgcccgctcttccttttctgtcattgcctaaaatccctattaatgaatagtttgaaagaacatggccaggtttgcagaaagaagaaagagagatatccttttccctcccataaggactaaaagaggatgtctctgtgctttgatcattaaccatggcgtgttgattttaggacaatctataactctctgtcaatttcctacttaacagctttcaaaattaaatgttcttgcttttctactaactgttaatcatctgttcttattgaaaggtctttaatgaatattgactgtttactccaagtttataagatttttggtctaaagtggttgtcttagtccattttctgttccttataacagaatacttgaaactgggtgatttataaagaaaaggaatttgtcatttgcagttatggaggctgagaagtccaaggtcacggtgagagccttcttgctggtggggactctgcagagtcccaaagtggtgcagggcatcacatggcaagggggctgtacatgctaagtcaggtctgtcttcctcttatagagccaccaatttcactcccatcataacccatgaatccattaacccatgaatccattaatccatgaatggatttatccattcatgagagcagacctttatgatccaatcacctcttaaaaagttccacctttcaatactgccacattggagattaagtatcaacatgaattttggaggggatattcaaaccatagcagtggtatctatttaa

SEQ ID NO: 10953 - DNA, 1064 bp, Homo sapiens
cagagtgagactccatctcaaaaaaaaaaaagaatatatgagttgcccattttcaaaacaggaaaggaaaagaagaaagcacacgtccctttttttctcacttgttgaaggaaagagactgaaaaatcatgaacttatgaaagatagaggaagaggtgcctaaggagaaagagaatatttaagtaagaggattaatacctatatatgtcagaagaagaaatgtagaaatatagtttttacacggtggaaaagaaaagtttctctaaactgtagaccaacaaactttgcctcatcctcggcaaatttctggaaatggatgaattacaaatgctctctatagaatggggattgttaaaagccagtgtgagttcatcaagaatgacttgaactggactacccacattctctatctcataagaccagggaaatggtaaaataatgtgtctgaacttgggcaagcaattaaccaggcatttttttttaatattcttgagacaaatagagaaatcaattctagaggataatataattgtgtagactcataactaattgaatgatatgtgcaaagggtccaaattcattgacttatatttatgaaatatggtcttcacttagcctgaccttattattaattgctaatcttacataaagctatcgaggtcatgattctcatattttctgatttaagagagaaataaatgctaaatgacggaataggatccaaaatattcatcagataggaagaggcgaaatatttcacatgtattttaaacataaagtttaaatggatatgaaatattgtgctggaattccaagcactgtaagatggaggaaaaatgactttatagcactacctgtaaacaaagctcaatggaaatagcagtgtgatgtggctgcccaaaaatgccatgaggtttctgctgttttaataggactgggatgtctcagataagacaagacagtgccactgtactcttcactgggcatatcttaccacacatgatttcctttcttatcacctcatttttagaaggatgtgcacaaaccggaacaaggtcagagag

SEQ ID NO: 10954 - DNA, 1048 bp, Homo sapiens
tagtagagacagggtttcaccatgttggccaggatggtctcaatctcttgacctcataatcctcctgccttggcctcccaaagtgctgggattacaggtgtgagccaccgcgcccggccgctagtcaaattttaaaaggcccaaacccaaatgtgttttgtcattttaccctaggaaactcaatgattttgcttctttattcttcaagattattcatccagaccctgataggcctgagcacaggttcatttaaactagaggctatcacaggcgtcgtttggaaagttacattatacacttaacaaatgggaaatgttaggctgggctcggtggctcacgcctgtaatcccaacacttggggaggccgaggcaggtggatcaccagaggtcaggagttcgagaccagcctggccaacatagcaaaaccccatcactactgaaaatacaaaaattggcagggcatggtagtgcatgcatgtaatcccagctgctcgggaggctgaggcaggagaatcgcttgaactcgggaggcggaggctgcagtgagctgagatggagccactgcacaccagcctgggcaaaacaacgagactccatctaaaaaaaaaaggggggggggggtgaaatataaaactcttccttatacctccaagcccaagcaggtagggggaattcttagagcaaattagacttccacaggcaaattctttatcctagtgaatctggatctaccagataactatagaatcctctaaactccaaagccttggtcaacctgtcagtaccatcagcatcactgggagctcattaaaaatgtagaatctcagatctcaccccacacctaatgaatccgaatctgccctttatactgagctccccaggtaatttgcatgcatattaaagtttgaaaagaactgatctcatgaaatcttacagctaacacagagacctaggagaacaagaccgtgcaaaaattgagaagaacttctgtaaaatgctgggggcaagaaaatagggaaaacaagaaaagagaagagtgactttgagg

SEQ ID NO: 10955 - DNA, 1019 bp, Homo sapiens
ctaaagtcaggtgaaagactataaatagtaggatagatgtatgtttcatatcccaagatgggctttatctaatttgctagtcccagtgcaaaatgaaaatgcggggctccttgatcaaaaaataagaagaatttcaagacagtgatagcaatgcattaggccaaacatgaggtccttctaagcacagggctttgtttgactgcagggatccacaggccatgaagccagccatgccccagaatatgctgaaataatgattcaggatctcaacactgaatgtagctattcagaaactgggctttggtgaccaggcgctgtggctcacgcctgtaatcccaccactttgggaggctgaagcaggtggatcacgaggtcaggagtttgagaccagcctgaccaacatggtgaaaccccgtctctactaaaaatacaaaaattagccagacttggtggtgtgcacctgtaatcccagctactcaggaggttgaggcaagagaatggcttgaaaccaggaagcagaagttgcagagagctgagattgtgccactgtgctccagcctgggtgacagagtgagacactgtctccaaaaaaaaaaaaaaaagttataaaaaaaaagaaactgggctttgtttttaacaaaatatacttctaagtttctgtgcttggaaggaaaaatactaatgtgtttacgtcctggggaaaaatatttaatgctaatatatcaatgagttctaaagttgaatcttgcaatacttccttattccaatgtagccataacatgtcaactcaaaatttctaaacaactctgatatgtgtatcaggtcatactaagattataaaaatctttaaatctttaaaaaagcaacagtagacattttaattagtgtatattaaagtaaaactaatttaagaaccctactgatacttttatagtttgatgtcctttgaagttgtaaaatattaataatgtcagtcaaatgtcacaggaagatttgcctaactgaaaagagctattagt

SEQ ID NO: 10956 - DNA, 1050 bp, Homo sapiens
cctgtctcagcctcccgagtagctggggttacaggtgcctgccaccatgcacagctaatttttgtacatttttttttttttttttgagacggagtctggctctgtcgcccaggctggagtgcagtgacgcaatcttggctcactgcaagctccgcctcccgggttcacgccattctcctgcctcagcctcccgagtagctgggactacaggcgcccgccaccacgcccggctaattttttgtacttttagtagagacggagtttcaccatgttggccaggcatttttttttttttttttttttttttttttaaagagacgggattgcttggcacgggggctcacgcctgtaatcccagcactttgggagaccgagggggaggatcgcttgagcccaggagtttgagaccggcctgggaacatttcaaaaccccgtctctgcaaaaaatgaccccttgtggactgaagtgggaggatcgcttgcgctcaggaggtggaggctgtagtgagccatgatcgtttcactgtattccagcctgggcaacagagtgagaccctgtctcaaaaagagagggagagggagagagagagagagaggggaggggagtcagagagagatggggtctcactgtgttgcccaggataaggctagagtgctgtgcctattcataggtacaatcgtagctcactatagcttcgaactcatgggctcaaagctatccttctgcctcagtctcttaagtagatgggactacaggcacacaccattttttttttttttaattcaaagaaaacccagagcagttttttttaaaatggagaacctagcactaccttttctaggtgtgttacattgtctcgatattgtaaaccggctgaaactcaaaattcttgttgctattttcagggtcgaaaagtaattatcttaataggtacagccattccccttaccatgataaaatctgtaatatctgtaggagaatgatctagtgttttgagaagtagtctcaaactactggatgaccacaccctgttcaatttgggaagggta

SEQ ID NO: 10957 - DNA, 1040 bp, Homo sapiens
gttgtgctatcaagtactaagtcttacttattctttctatttttttttgtactcattaatcatccccatttcccctcctccccagctgcacttcccagcctctggtaatcattcttctactatctccatgagttcagttttgatttttttagcacccacaaataagtgagaacatgcaaagtttgtctttctgtgactgacctatttcacttagcataatgacttctggttccatccatgctgttgcaaatgatatttattgatattttgtattttattcatttcaaatgtatttatttctgctctgatctttattgtttgttctaattttgggttcggtttgctcttgctcttctagttctttaagatgaatgttaggttatttatttgaagtttttcttctttttgatgtaggccctcataggtgtaaatttccttcttagtactgctttcactgtatctcatagattttggtagttgtgtttccattattattgtttcaataaatttttcaatttccttcataatgttttcattgacccactgttcattcaggagcatattatttaacttccatgcgtttgtatatgttccaaaattcctcttgttatttatttgtagctttatttcattgtggtcagagaagatgcttgctattatttcagttttttttgaatgttttaagacttgttttgtgacctaacatgtcatctgtccttgaggatgatccatatgctcaggaggatgttctgtagccattggatgaaatgtttcataaatacttattaggttcatttgttctattctgcagattaagtctgatatttccttgtttattttctgtctagaagatctgtccaatgctgaaagtaggatttagatgtctccagctattactgtattgggatctgtctctcttttttttttttttttttttttttttgagacagagtctccctgtgtcacccaggctggagtgctgtggcacagtctcggctcactgcaagctccgtctcctgggttcacgccattctcctgcc

SEQ ID NO: 10958 - DNA, 1078 bp, Homo sapiens
aagttctttttcttctttacatttccttttgttaagtctattctactgaagtaactcttctggaagccatcctgtttcactattatttttcagtgatttgggaaacagttgtataggaaaaaaatttatgtctttgcctgtggtacatagaaatttttgtggaattctcattgccagtaagtaccagacagaattcagatatcatctctcaatcgtaatgaatctagtggtcagtgttgcagccatcagtgggcagataactgttcctccaaaagcaagttaatgcattcatttgtctatgaatgaatttttgatagacaatatttaaatattggtagacaagtaggaagctactgaagaagtgattaatctgagtgtaggtatatcaatttgtaaatgcagttacactgcaaagtaatacaactggctgaattggttagatttacacaaaaagtaaagcttcagtgatcacatggtaggtgaatgattttatttgagcattctccttgctttgaattctagtctactgttgtcctttgaaccctatgactcttaatagccaagagtgtattatggtaaagaataagtggggcgcagtggctcacgtctgtaatcccagcactttgggaggccgaagcaggaagatcatgtgagtgagcccaggagttcaagaccagcctgggcaacatacagatactctgtctcttcaagaaatgaaaaaattagctgggcatggtggtgcatgcctctagtcccagttactcagcaggctgaggtgggagatggcttgagcctagcaggtcgagggtgcaatgagcagtgattgtgccactgcactccagcctgggcaacagagtgagattctgtctcaaaaaatgagaatgcactagatacacaattttattgaactttctattatagaaaatttcaaacttatgcaaagtaaagactagtatgacccccatttacccatcatccagctttgataattattaacacatccaaatagttttatgtaataaagatttataaaacgtgtgtgtgtatatatatctatattatatatatattttatata

SEQ ID NO: 10959 - DNA, 1033 bp, Homo sapiens
ttgatctcctgacttcgtgatccgcccgcctcggcctcccaaagtactgggattacagttgtgagccaccgcgcccggcctgattggtgtgatttttatgttttggtggttatgttaaatgatggcagtaatagtacattaacagctgtgctataaaaatcaacctacttatttaactcacacattaaaattctttgaaactacacagaactataaaggaacaaggacttttagtctcactgtgtgttgtgtggtcatcttttttttaagtaaagcaatattaaaggtatattttttctgttcattagaaaaagacagtctacagccataccacccggaatgtgctcaatctcatctaatctcagaaaaagacaaatttccacgaagagtaagctgattttagaattgaaactcagtttagcattttgtgtgaagctgattcttccccctatttaaaaaaatggaatagatgtaaaattattactataaaatgattaatattgcttttctttgaattattcttttttatgattgtgtatatcgaagtcttttttgtgatgcttctcaacttctaaacaaattctggtgagtgatcctaaactgaaagttgtggcttgagggctcgaagaagtagagtgcttgtggccgggtgcagtggctctcacctgtaatcccagcactttcggaggctgaggctggcggatcatctgaggttaggagtttgagaccagcctggccaacatagtgaaactccctctctactaaaaattaaaaaattagctgggcatggtggcacgagcctgtaatcccagctacttgggagactgaggcaggagaatcgcttgaacctgggagatggaggttgcggggagctgatatcctgtcattgcaccccagcctgggggacagagcaagactctgtctcaaaaaaaaaaaaaagtagagtgcttgttcatgactctgagctcatttagtctcagccttcagtttctggtgctacatcacttgggactcacacgccaagcccctatca

SEQ ID NO: 10960 - DNA, 1063 bp, Homo sapiens
ctttctgtgaatttatacatgtatgtatatatgtaaaaacactgttgatttgcaattctgtctttccatagaaatgaactttttctatcgaaattgtttaacttaaatattttaacataaattatttacatggatctttatgtataattcatccttatatataccccttaatcacgtagtcatgagaagataactttgctttctttacagaaagggcagagaggaataagataagaaactgaaacaagcaagaatgaagagagatgtgggggagagactgctggtctccagaccacagcaatgtgttttaagataagatgaaatattttaactgcagaagggatataaaatctatgtaattacatgctgatgggatccattgcacccaggtttttgaccttggcctgtaaatgctagactatgatatcttgttattctttttctcctttgggcttttaaaaaataatttcattctcagatcattttctgtactgtttactgaggcaaaaaaaaaaaaaatctgaagtcaatcatggtcttctactttctggactgagcatttggcagaatgcagtatcttttcctgtattttgacatgaaatagcacatggcttctacaagatagttttaacttgttggggtcaccgggagttatatgatggtcaaccccttttcccaaaattcattgtggtagttttagtggaaaacgtaaatcaagaaatctcatatcatactttaataaataaataccaaatacatagtgacatataggtttgggaagaaactagtctgtggggaccattataagagaatcacattatatattacacagtatatggatattggaatgtatcacttgtggggggttctcttcattagcaaaacagtcatgtctgtctgtatataagacttttttttttttaaccaaactagcatttcattttgtgagtgacaattgacattttaaaataagcataggccgggcatagtggctcatgcctgtaatcccagcccttgggaggccgaggtgggcagatcacttcaggtcaggagtttgagacca

SEQ ID NO: 10961 - DNA, 1046 bp, Homo sapiens
acatgttaaaagttttagtttgaatgtctggaatttgtttgtttgtttgtttgttttggtgcattctagagtctccaagagtcagtcaccatgagtacccgtgaggtagatgatacttattttaacagcacctaaactggggtttaggagctatattttccaagaagtgactcagtctaattctgaaatgacaaaagcagttcatatcattttattcacacttgaactccactggagtcagggatgaaatgtcatcttctattccaagaatgaagtcttcagataatgtccaggtgcttcagaactaactagtcatcataagaacacagagtccataatttctccaatgtatagttttttgtggtttctagaagcatcaaatgaatcacagtgctaccaaactccacacagaactagtcacagtgtccttcctatccatcttaacattaggctcatttttacatttcaggtatttgtacattttcatagtataatagggatatatcaggtggaagttccactcactatcagtcacaaagtagctgtaatctgtatatatgtttttacacagtcatgtgaaatttatttatatacacacatataatcccagtttgttcacttatactgctatataatggtccattataggaatatatcctgttgaaatttgtgtgttccccagtgtttgctatagctgtttttgtaaacagtggtactgcggatattcatataaatgtctcatgtttgagaatttctctaacgaatcaaggagtggaattgccagactgtagggtatatttattggatattgctattgcttctcaggatggctgtaatttacattcccatcaacagagtgaagtttatttatatctgtactttctatagtcacattttaaatttatggtacctcattgtggtttctattgcatcctcctgattactagtgagtgtgagcatcttatcatgtttcttggctctttgaggttttgttttgtgagtttttgttgatatctctgcacattattttgttaggtatttttaag

SEQ ID NO: 10962 - DNA, 1160 bp, Homo sapiens
gatatttttggcttttggaatgttattgatcataacatcagtctgaattctctctcctacagtccccatttacttactgaactcagcaattggtggtaattttacacagtaccagaatttagagtgttgtgatgattcagaaatgtttttagttacactaaactgaatgtcattgaagattgagtctatacctacaagatgtttaatttatgttgaggatataatttacttacctagcagcttttcatccacagtgtctaaaagatgaaaagtcccccaaccccaaatctatgaaacatctcttctttcccaaatcacgtatgtaatgaagtaaatgatattttgatcttatataatttttatgtcaaaatatgtaaatgactgcatatgcctaacatatagccctgaaggatttaaaatgtctgtgagtttggagttgcaaaggtactgggcagagctttgtattggactgataggggaatgccatggcaataaagatcctgagaaatatacaacctaagtaggtatgccagatagtgacatttgttggctttggaacactggagtatttataatggaaaaatagcacagagtaatctaaaatagcaaatataattgtatagggaatgtggagtaaaggatattaaaaacttgctgggaaattagaattttcagtgggctaatgagggaaaacataaggtagttaaacaggtgatgagaggatatattaaaggctaaagaagggcatgtacaaagacagggtataaacatctcataagtgtctttttacatgtagttgattcaatcctaatacttgtagagggccagtggtgaagaggagggagcctacgcagtattcttagtctgcaggagagaaaatacacgttacctctcactatccaaattcttactagagattaaagagttagataaacttcttgagaaatctcttactgtacacattcttgccacttgatattcaaagatcaggaaccaggctgatttggacaacttgttatctacgccttactctctgaactcggaacctcataaatttggatagtgaggaatacattattcttttattcagcactaaatctattaaacatatttaaggaatggcatatgccagcctgggcaacattgtaatacccggtctc

SEQ ID NO: 10963 - DNA, 1637 bp, Homo sapiens
attgcaccactgcactccagcctgtgtgacagagtgagaccttgtctcaaaaaaaaaaaaaaaagaaagcaaaggaaaaatttatgtttataatcaagagaaaagaatgtaaaataatacatggtatataatacatgtacatataacatgatacagggatagaagtaggattataacctgttaatatggctggctacctgacttcccatgtgtttcatcaggttttgattgttaaaaaaaagttttaggaatcatgatttaattcatttttaaaagcattaatgtctatgtacttgaaatgaagtttattacttcatagttcattgaaattttaatatattttaaaatttatttttagggagtaagccctgaaccaattcatcttaagattttttcacccaacgttgtcaatttgacacttgtggatttgccaggaatgaccaaggtaaggaaggaatagttgtagatttggtcaggttgttttcacttcgttgacatcccatatgagaataatcagcttctttttgcaatcactttgatctgttagcagcatttgataacgttgagccctcctttctccttgaaacactttctttacttggcttccaggataccacactctacaggtttatctccagtctcactggccactccttttcagtctcttttgctgtttcttctcatctccccaatgtctaaacagtaagtgccccagagctcagtttatggaactctcgttttctctaggtacactttccctttgatgatttcatcagattttatggctttaactacgtaaggctctgtatattgacggcattcaaatatctccagacttgtatatctagttgctattcgacatatacacttaaatgtctaatagacatttcaaactctaataccgaattcctgacctgttcctcaactagatttggtatttctatagtcttcccccatcgcaataaatggcaactcatgccatttattggcaactcataaaaaagctgagttgatttttaattgttagttccttggccatctctgtttggtgcagtggcttatcctgtaatcccagcactttgggagatcaaggtgggaggaattctttgagaccaggagtttgagaccagcctgggcaacatagggagaccacgtctctacaaaaaatacaaaaattagtcgggcatggtggtgcacacatgtagtcccagctgaggcaagaggattgcttgagcctaggaatttgaggctacggtgagctatgattgcatcactgcactccaacctggccaacagagtgagaccctgtctctaaataaataaataaatggcaactccattctaccaattgcttagccagagtttgtagtcatccttgacactaatttatcccacattccacttcctgccagcaaatcctcttggctcttcctacctttacagtatatccagaactcaatcgtgttttataaattcatatttactgtcctgatctagccactatcatgctacctggattactgcacaataatcaataataggtcgtccttgtgatctcatcttagtagacagtgatacgattaaagtgaaaattcgattgtgtcatttcttggctcaaaacttctccagttccttgt

SEQ ID NO: 10964 - DNA, 1024 bp, Homo sapiens
gctttctcactgttttgttaccttcaagaatagttttaaatttagtattttggtaggaaattcagagatttcctagatttcagagatggaattgtatttttggacatttcctttcctctttaaagatcttgagatctgttcagtactaatagatctaatgcttctttcttatgcttccagttagtttgcacttgttaccctatatatagcttcacatatgcttcagaagcttaagcaaattaaaaaaacaaatggggactgtgagagtttgagactgttttcaattcttgataaccattttagaggaaaattaaataatgtataaattattcagactcatcgctatttcaagattttctgccatttagctcctttccttaattatccagatttaaagttctgaacttcaaataaaggtttataaatgtcttatcttctctcagcccactgtgctcagatattaatcaaaccatctaaatcactgcacaagttttatttcattcatgacgtcacactgaatgtgctctctctccttaagatttcatttggtatgtcattcatgtatagttaacaaacatttaaaaatctaattactcatttttaagttaatgtgtaacataaatatactacttatatttaaatgtagttcaccttaactgacatactaaagacagattttagcaaatattttgattcagaatgatacctcaaactaccatttttctaactgccataatcctctattaaacttatataatccatttttagattgtaagatcttaaagaatacctaaaaaaaaccctcttaaatgttgatgaattgtttttccattataaagtcatttttgacttttagaagtcaagactaatacattttctagaaaacaaggtacaaaagcacttgtgattaatggtagcactagatttctttcagcaaatccttaagagtacagaggttgaggggacttctgttgtttgtcacattccgcatttgaaacaactcacagtgactgtcagcctaaga

SEQ ID NO: 10965 - DNA, 1050 bp, Homo sapiens
tcgtgtattttatgtgtggccccagacagttcttcttccaatatggcccagggaagccaaaagattggagacccctgctagcatttaatgcttatacacgtatttacttgtaaatatgttgtttctttgataggatatgatttcaacataattacggtttatttaaaataagaaaaataaataactttcaaccattaagaggttataagactttaaagggaaagtttaatagggtataatttcaaaataattgctttttatttaaaataagaaaaatcattaaacttcaaccaataacaggttaaagaatttaaaggtaaaagacatttcaactaattacaaatactttgtttttttttagttgggctacattttaccactctaggaatagctgttaattattttttatatagggtatttttatgtatttaatgttgacaactgacgtttccaatatgcaaaaacttgcgtaactgagaaaattataataaaaatagagattgagaatatatttttaacatatatccatgagtcaaaactaatatttaatatttgggatttgaaaaattatttctggggtaagaaattttgtcacaatataatatctgtatattgtgctttttttaagagagaagtttttgatgaattgaatgttaattaaattttatctcagcatatcaccatcagaccaaaagatacagtatttttctaacaaggaaaagaaaatacatacatatatgtatttatatatacaaatttgtatatatgtaatgtatgtgtgtgtgtatacatattaatttcctctttttttttttttgtaagaattgagacagggtgtcagtatgttgcgtgggctggtcttgaacacctgcctcaagtgatcctcccaccttggcctaccaaagtgctgggatttaccatgaaccactgtgccagcttccaacgagaaaattattaaatgtgttggtttttcacagtgaaacttaattcagtttagttgaaccatatatgtgtgtgtacggcatatacaagatgaaaaagaaagggagg

SEQ ID NO: 10966 - DNA, 1047 bp, Homo sapiens
attagataaatgatttttatgaaaataaacaaacagaaagaagttacgctagagctggcacagtgaagatcactgtggtcccaggtactcaggaagattacttgaacccaggagtttgtgatcagcctgggcaacaaagtgagactctttttttaaaaagaagttacaatgtagcaaaaagacaagtatgaaataatatggtggttatggagatgaagaggtataaaagctgtactagagaaataaagcctcatgagtcttaaaggttaaccaaggaccaaaacagctattaatatcattctgcttttactatgtgtttgtgacaggggcaacaggatcatcgaccggacagacagacacaagtggaccatcagctaaagtaacagggaattatggacaatcatctgaaataccagggacaattaaatcatcatctgatgtttcagggacaatggggcaatcagatacaacatctggaccatcagttgcagtgacaaggacttctgaacaatcgtcaggagtcacggtggcatctgaaccatcagttggagtatcagggacaactggaccattagctgaaatatcagggacaaccagaccattagtttcagggttaaggacaactggatcatcagctgaaggatcagggacaactggaccttcatcaagagaatcagtgacaactagaccattagctgaaggttcagggacaagtggacaatcggttacaggatcaagagcaactggattatcagctacagaattagggacaactgtgtcttttactggaggattaggtacaagtagatcatctgctagagaaacaaggacaactggaccatcagctgacgggtcaggaacaactggaccatctgttgtgagatcagggacaactagattatcagttggagtgacaagagcaactgaatcatcacctggagtgacaggaacaactacaccatcagctgaagaatccaggacaacaggaccatctgttctagtgacaggaacaactggacaatcaggccaaggatcagggacaactgg

SEQ ID NO: 10967 - DNA, 1045 bp, Homo sapiens
tctataaaatgctattccctggaacttctcatgcctcacatcaccaggctgagaatttttttgtcttatttatttttacaatggtaaagtgattagttgtaaagaggaaaaattgccattgctactgacctaaatgattgttagtcatactgaaatgtgctcagagaatcattgctcaacatgtgaaaagcttatccttgcaataaaaatccctctattttctgatactctgataacattatatattgagaagtcacaaagatttactgatatatagcaagtgtaatttcttctttgtttcctctttactttctgtctctttttagtgccttcattgttcagggaagtgtcatgccaaggtatattgacaatactggtcctttttgagcatccaaaaacagtggtatttctcgaagctaatgattgcctattatttgtttcattagggaattaaaatttgtcagccttttctccaggattttgtttcatccagagaatattttccttcccaattgcttgcagttgacaccactatttgaatcctgatgaattatttctgcttcatgtttgccatagaccttctgctcagcttgcgtatgcttatatactttacttatcataaacttccttgtgtttgagatggggtaagcgttgttgatgatgggtagtaatagagaattattccatctacatcagatcacagttttttttttcaatgtttaataataggttttagaattctgggcaaaagtaacatctcttttttttttattatactttaagttttagggtacatgtgcacattgtgcaggttagttacatatgtatacatgtgacatgctggtgcgctgcacccactaactcgtcatctagcattaggtatatctcccatgttgtgttagtccattcctgcattgctataacaaaatacctgagactgggtaatttataaagaaaagaggtttaattgacccacggttctgcaggctgtacaggaagcataatgcaggcattgcttctgaggagacctcaggtagcttctaat

SEQ ID NO: 10968 - DNA, 1050 bp, Homo sapiens
aacactgcctcaaacttataggacccctcaaaacacagtaatgttttggatgtttttaagtaaacaaagagaatattttagaaatgttcttttgtaataatatttcatattctgaaaatcccagaggaaggttgtctatttattagcagatgcccacactacttcttccatattggtagatatgatcatgataatatatgtgctgtataactgatacattataaggcactggctgttctcaatatttacagttcataagaattacctgagattgttaaaaaggaggaatcctgactctcatccctacagactccggcttagtagatctgatatgggacccaggaatctgcatttctaacagtgtctctgttgcttctaagagcacattccagaaacaaaaattttgatcaacctagatggagttaatgcttgtgcttcaacaaaacatacatataaagacgtgcgcgcgcgcgcttgcgcacacacacacacacacacacacacacacacacacacacacacccctgctcagattaagactatagaattgcttttaaatacctcaaggatcaccacaatgccagagccatcaccattacttctttctcttactctgttcattgcttttctccttttcctctttcatttcttttctttttctttttttttttttttttttttttttttttttttttttttgagacggagtctcgctccatcgcccaggctggagtgcagtggtgcaatctcagctcactacaagctccgcctcctgggttcgcgccattctcctgcctcagcctcccgagtagctgggactacaggcgcctgccaccacacccggctaattgttttttgtattttttagtagagacggggtttcactgtgttagccaggatggtctcgatctcctgacctcatgatctgcccgcctcggcctcccaaagggctgggattacaggcttcctctttcatttctattatctttcttcttttctaacaaaggatggctctttacaaacattgctagccaatctgagcatcccttt

SEQ ID NO: 10969 - DNA, 1037 bp, Homo sapiens
tgcctagatgctgatttctgaagactgatttagggtggtggttgccaaaggttggggtggctgtggcaatttctaaaaagatgacactgaggtttgtgagatcagttgactcatctgtagcatgcaattctgttttatagccttttacccacagtagaacttctttcaaaattggaattgatctctcaaatcttgctactgctttattcactgaatttatgtagtattctgagtccttacttgccatttcaacaatgttcacagcatcttcaagaggaggagattctatctcaagaaccactttcatccataagaagcaactcctcttctgtaacagttttatcatgagattatagcaattcagtcaaatattcgagctccacttctaattctatttttcttgctatttctaccacttttgcatttattttctccactgaaatattgaactcctcaaattcaacttcttccaaactcctgttaatactgatacttcgatttgacttcctcccaaatgtactcaatgacatctaaaatagtaaattcttttcaaaagatttttaactgattttttcccagatccatcagaggaattagtatctatgcagctaaaatcttatgaaaggtatttcctaaataaaaaaaacttgaaagtcagaattactccttgattcatggctgcagaatggatgttatgttagcagtcatgaaaataacagcagtctcttcatacatctcccccagtgctcttgggtgaccaggtgcattgtcaatgagcagtaatattttgaaaagattgttttttttctgagcagtcggtctcaacagtgggcttaaaatatttagtaaaccatgctgtaaacagatatgctacatccagactttgttgttctatttacagagcacaggcagagtagagttagcgtaattcttaagtgccctagaattttcagaatgctaaatgagtattggcttcagattaaagtcagaagctacattagctactaacaagaaagtcaacctgtcttgaaattttg

SEQ ID NO: 10970 - DNA, 1114 bp, Homo sapiens
aaagtgctgggattacaggcatgagccaccgcgccaagcctaatgtggctttcttagacttgtctactcatgactagtctaagaattagactatttgtttttattttcacctatatttatctctaaaatatgttagaatcaaaagagtaagttttgaaaaacatatttattggtactaatttggtctcttcggttctagtttttttcattgacttttaaagacttaattaagagtatgcttatttcattgttaaatactatagctagatcacaggataagtaacactcatctcaaaggggtgtgtgtgtgtgtgtgtatgtgtacacacacacgagtcatgcagtacaaccagtgaattaaggcacagagtcaaataccatttcgtttatgtgactgtttgttttgtgtttttgagaagtgaattgtatttgaaatgcaaagacaatacagtagatggataattgaatgatattttaaatctccttgaaagtttaataatcataacaattttttgtgtaattaaaatatattgtcaggccaggcgcggtggctcatgtctgtaatcccagtactttgggaagctaaggcgagtggatcacgaggtcaggagatcaagaccatcctggccaacatggtgaaaccctgtctctactaaaaatacaaaaatattagctgggcgtggcagtgcatgcctgtaatcctagctactcgggaggctgaggcaggggaatccctcgaaccagggagttggaggttgcagtgagctgagatcgcaccactgcactccagcctatttgtaacagaggaagactctgtctcaaaaaaacaaaaaaagagaaatatatatatatatgtgtatatatgttataacatatatacacatatatttatacatatatgtagtcagattgtttaaactgaaatccagctatgaatgtgtaaaatataaagtgaaatatgttttttctcatttaagaaaacaaatgcattagttgaatctctctctcctctttcggaatcccaggcatcacacttatctagacatctcacttatcagaattatgtttcacacagtgatacttacataaaggatataatgcattccatctccgt

SEQ ID NO: 10971 - DNA, 1010 bp, Homo sapiens
ataaattcacaagatctgccagataaatctgagtgatgaaaaataaagggtagataactcaaccttgtaatgaaacatgttataaatctactgtaattaaaacagaggagtatgtaaataatcatagttacatttgagctgaagttgtgacctttgatttggatggctatagaagtaaaattgtgtcaatcattgcaaaatgcagatttaccccagtatattttaaaatctatgccatcctccttatctttttactttttgccccaattcagatttatgtcacctttcttctggaaattatagtaactctaactgctgttcatacttacagtattttcttcttcaagtttctcctaaaaccttagccaaaatgattgatcataaacacaaaatgtgtcaactccttacataaaatagtttaatgcctcttcattgcatccttggcaaatgtcaggcatggtaacatggaataaaagacaatttagggcccagccttggcctccctcttcagcctcatctctagcactgaaataactctgagagcttcctcttgtcccctcctgatatggttttattgtgtccccacccaaatctcatcttgaattgtagcttccataatccccacatgctgtgggagggacccagtgggaggtaattgaattatgggggtgggttttcccatgttgttctcgtgatactgaataagtctcacaagatttgatggttttataaagggcagttcccctgcacacactctcttgcctgccgccatgtaagatgtgcttttgctcttcctttgccttccaccctgattgtgaggcctccccagccatgtggaactgtgaagtcattatacctctttttccttatcaattattcagtcttgggtatttcttcttagcagtatgaaaatggactaatacccctcctatacacctggccatttctcactgcctggaacttttacctttttgcactcatttcctagcatcctatatatataattgatg

SEQ ID NO: 10972 - DNA, 1023 bp, Homo sapiens
aggtaggtaagattcttttacagaagaggaaactgagatggccatggcatagtagcttgctaaattctcacaaatagtgagggacagagtgggatttctaagccctggtaaattatataacacagtctcaaaatctgctgaaataattaaaactttctaaagattgattgtgcacacttattgtacatattctcagaatatttatttccttgctgaaatagttgttgtacttgaaaactgttgtgcttatttacattgttgttgctaagctatttaaaacacaatgtaaaatcaaaactttatttaaatagaactttggcttttatcctcagtgtattcatttaatcacaaaaagtaatgttaatgtgtttgttcctaaagtcttttgtattgctgttttgttaaatctatttgcttactgatttaattaatgatttgtctatgacagacctaattggagattactatgcttaaaaaaatgggataaagtcaaagaaataaagctgtagaaacaatttagtggaagagaaaatgctttgacaataagcagtagtctaaaaattttaagtgcgatatatattttttatctatgttttcttgctaagttaaaattaaaatgtgctagacttgaaaacagacaaaacacccctgaggttcttttacctggttttataccacagtattctttgatattagtgaattatttcagtttgcttctttgcattgttataggaatgattaacctggtgttctcctgatttattagtgctatctgaaaagcaccaatactttattatctccctggaattctttttcattttgtaagaatcattgagagactgagctatataatacttgtatagagctgtgtcttcttaaagatttaaggttaatcattataaattaatagtcattgatttcacatagtggaccagtcattgtagcaaactgaatgtacagtaaacagcctatacctctattgtccacctttcagttaacacaccacaattcactgatttcttt

SEQ ID NO: 10973 - DNA, 1048 bp, Homo sapiens
gtactccagcctgggtgacggaatgaaactccgtcttaaaaaaaaaaaaaaaaagaaagaaagaaaaagcattccagcatttcaaaagcattgaagaatgtgctctaaaggctcagaggcagagcatttaatgaaataatcagagaactgtaccatcacctctgagataattagaaatgtgtgtatgtattggatggggcttggtcctgcaaattttaggtgttactggcctttaaaaggggtggagggtactaaatatcctgtaatccttgggtggattctcttgatcaacttatctgatgcaccccaatagggtgtttccctgtggaattgtaatagaatatattagagtgtgatacatggaaggacaggtggtggtggaggatgagaagagatgttggacagtagagagatgcaatgataaataatggcagatattttagaaatagaatacatttaacctggagaccaatcagttgggtctgaggtcaggcaaggttgtgactgccaccttttagatgtgagtcactgtgtggatagtggtgcttctcaatcagacaggaatatatggacagagcagatgtgagcctgtgggagatgttgaatttatttttgaacaggttaaattttaggggtctatgggaaatattcaagtataatgtccagtataaaactgaaaatagaaatctggacttcagaagagagattgggaatggagatagatttgagaatcatgggttaataataatgaacattatagtaatgaaaagttactttaaacaaatgtaatgattcaaggaaatatatatttttaatatgatcaaggagagtatttagaaatttcaaatttccaatttattttacatagtctctccttggtctgaaaattactaggggtcaaggggtcaataatactatgatataagatgtttacttcttaattagttcttaataattgaattatcttatttctgctgacctttccttttttttttttttttttttttgagacggagtctcgctctgtcgcccaggctggagtgcagtg

SEQ ID NO: 10974 - DNA, 1110 bp, Homo sapiens
gaatattctaataagaaatcacattagacataaatttaattctgctacaattagagaaaagattgaggcttgtgaaagcttgttgaattaggatcacactcagagagtattagaatctgggctagaaccatttctcaggcttgcaaactaaaattcttttcttcatatcagtctgtcatcctgtattctttccatgaatggtcactatgtatattttttactttggctttaggataatttgccgagaagcttaattttgaagtaaaataaagtcaatgtctagtgttatttatttcttttataatgttgttcttgcaaatattctgctagatatgggaaactctatatatttaagagggatatgttcttatttagacagcccagacagaggaaacctgactatttatctaatctgtgctgatgcagaaagtcctcaattcaggattagtcaatgatagtgtaaataagtgggaaagatatgtattgctgctttcatgagcaactgagctgcagaattaataagcacaataggcacctataagctgtgggttgcctatggccctacccaaggagaacggccagttgtaaaattggttagggtgggtggtgtatttatgaggtgtccaaaaaataaaatatgagatctattataattatttggtaatactaattatttaataatatcaattttatatgatttttaatttttgtttaaaagacaatttaaatggtcttgatctgcaccctcttccttaatgctatgccgagggaaatacacacatagcaatttggacagaacacatggcaagtggcagaggaggattagaatctaagtctccagggctcctggctccttagatttctcagaaaattatgcttgtaactttatatggtcaagtaaatttactggaggagaaatctggttatccagatactggaatactaattttggcttcacctccaacccttcatataaacttttttctcatatttatttcttatctgcaaaataatatactgcagatgttatatggaattgtgaattattcacataattcggaataaagttgtttctaaattgccttcaagtatttgtgctttaaagataga

SEQ ID NO: 10975 - DNA, 1031 bp, Homo sapiens
atgcatagttccggtgtccatatgcacattaagagaaatttgtatgcttttttcccctgttagtctgtcttttgttacagaagtgtcccagctaagaacctatgagagttagggaaagaaattacacattttgtccccgtcagcacctacttgtggggaaaaaaaaaaaaaaatcaggttgtatatgtaatgtggaaccagatcatgaaacactttggactctgacatcaacattttaaacttataagaaaaacaataatgcccttatctctttctgtcactctaaattatgccttactctagcattcttcaaagagcataagccaagctgtgtcatcctttagtacttcttttatgtggcttcctcttcctggaatcactcccctgtctgccacctggaaaatatctactcttgtcccagcacttagatgaatgaaacattttctgaccttctccttccccaccccttcagggaggttattctagtttctcctttctgcttgctctgaatctagtacttatttttatcacagccttataacattattccatccattcgttcaaatctttttctattataatgtagtactattagaccgcaattacttttgcaccaacctaatacattagaaatgtaaatactagggaagtggtggtaagggggaactcatttgcataaatttaggtcatttctcttatacatacctagtaagtgttccacaattcaaggttttacccagatgtgcgtacaacctgaaaatcttcaggatgctggcaaaataagaaatttagtttaataaccctatcattgtacaatgaggaaaccaactgagataaataggatcattgagcagcactttgcatgaatattttttagttatgcctgtaagagacagcaacattatttttgtattgctgaagtgctttgagagtaatgccctggtgacagcataaacaaaatacaaaggccagtttgtttttatatataaatgggggattgttggtgaagagttgtgccagccagtacagag

SEQ ID NO: 10976 - DNA, 1051 bp, Homo sapiens
accttgctttgattatctttgtctttgtcttcagtattttactagtaaagccatgtttcgaatcctgtcaaaattgtttggagaaatgctttagagtcttgatcccacttgtttaaaatttccattgaaagctctgctgttatctgcagctgacctgggtgcaatggtttgggtacctgagtggaaattttgctcaactttaatttttcagtcagaattgtgtaagctgaaccaattgatgtatctatcatgttggctactgtttcttctgttaattgtagatctcttcagttagggcatgaacaagatgaatgttttcctcacaaattgatgtggatgttgtgtcactgcaggctttatcttcaacattgtctcatcccttcttaaaatgagttattcatttgtaaactgcccgtttgtggggaggcattgtccctgtaaactttttgaagagcatcagtgatttcaccattcttccacccaagctttaccatgaatttaatgtttaattttgctttaattttagcagaattcaagttgctctgatagggtctcttttcaaactgatgttttatccttcttagtgtctcaaactagatcttgcttagacatgttttaacaagctagtacaactttattttgatgcaaaaataattgaaacccatgcttagattttcacaatatgcatttttgaagacccccttgtatgtaatttggctaagggtctgaatttcagaaaagaaattttggctagacatataagtttgaatttattatatatgatctttcaagttacaagagtagatgagaatatctagggagagaacatgaaggagaagaggagaggggaagagggaagaggagaggaatgatgagaaggatacaggaagggaggagaggagaaggaaggggaaggagaagataggggagataacttttggaccatagatctttgagggaatataaagtgcatccactttaaaggcattaagctgatcttaatacctgatcacttacacgacaacaagctatgattcacttacaattacct

SEQ ID NO: 10977 - DNA, 1047 bp, Homo sapiens
acctccgcctccagggttcaagcgattcttctgcctcaggctcccgagtagctgggtctacaggcatgcgccaccatgcccagctaatttttgtatttttagtagagacggggtttcaccgtattggccaagctggtctcggactcctgaccccacgatacacccgcctcggcctcccaaagtgctgggattacaggcatgagccaccacgcctggccacaatgattttttgaagttattgaatgcaagcaaaatcacaaatattgtttttttgtgtgtgttctttactgaaagtagaatgtagccctcacctatgaaaatatgaatgcctttaagcaaagccttcccttaatttaaattgaacctaaaaaaatgcttcttgcagtagtgaaaaaaatatttttggtaatctaagagtgatattatttagaatttccctctctaatccttcaccaagaataaaatgaaatcttagaaacggaagaagtcttataaagattgtgactaaccctttagtttttacaggtagaaactgaatttctcatgattgattcttgctgtctaaggacctactatttatgcatacccatgcaatgaaaactaagtttaaaagcataaatagttaaaagtgtaataataattgaaaattgcagtaacgtttttcttaattgtataattattgattcaagtttaatgttctttatgtgaattacatttttagtttgagggaaaatattttttaatgaattgtttttgctttgctaagtgatctatttcaagaaacagtctttctccagaaaataaaggaaatttcaatgaaagaaaaagcactcttctgttattccaaacatgtatatttcttagatcttaaccacggaagagtaatgttgaaagaaaatcattcatgagcattgattaggaaattggtgcccattgagatatgctcagcatcaatataaacgtaatttttctttaaaagagctagttgtatgtcagttgacttgctgaaaatgcttcggttatattattaaaaacagaaatttcagt

SEQ ID NO: 10978 - DNA, 1040 bp, Homo sapiens
attttctacatgcattcttttcatcatcacatcagaaagttagatccctgtttccagtctatttataacactatccctatcagttaatgctctgattatctgcagcatgtcttatattgttatgatattatgtggttggggagaaaaagaattgttcctctttttcactttattaaaagtaatcttagagtaatgagaaaagacataagtgaccactaactctaggctgaggaaaatccagatttacttgtatatttgtggctcggaataaatttttaaaaacccaactgacttttatcattttcaaattgtgtgactgacctctagtggtcagaatatgtcacttattgagcagaacccactgtcaattagtttgttttattgaaaaattactttgaaatttagagtcagatattgatattttgtattttatttatggtagaacaatgcttttaatactttatacagtatatctgcatatgtatgaatctaactggtgcatagatggctatcaattacatcccaagaaatcaatttatggagaaaaactcaacaaaatatttgtcacttgagatacctcacaaaaaaaagacaaaatacgtcatgtactttgatgtttccttgtctgtacttgagctaaattacaaattatggtcctagagactcagaatcatagagtacaaagaaataccacctgaatcatattcttaattgtctgacttcacatggagccgtacccaaattattttagaactgtgttagctccgtagagtttctaggtctcatgacctgtgatatgacctttgtgtctttttctcatagatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatgtaagtaaactgtaacttttaaaaaagggcaagcgtgtttaggtg

SEQ ID NO: 10979 - DNA, 1030 bp, Homo sapiens
cccagttatgcagaactgtgagtcaattaaacctctttcctttataaattacctagtttcagatatgtctctattagcaccatgagaacagactaatatattacctattgagaaaattcatctcaaaatattattttttcagtccttctagattgtgggttcaagctcatatacttcagcatcatttgagttcctagaccttttaaaattccttgcacactcctggagctttgtcgtaatatggtgtttgctcaagctaaactggtccaatttaaatgccatatttgcctcagagtgctatagcccttacctacttctaactaccgtcctcatcagtcactctttcaaagtacccattttgatttggcttatatatcattatttatttatttgtctctttagcattttacagtgtgtggtacacactcaatttgtgatcctaaacaatgcctttcacctttctaagcctgattttttctgtaagcctgaaggattaatacatctttcaggactgatgtgctaaataaatgaaataaagtgtctagtttgaagagtgctgtgttgtctgagtaaatgttttccttctttccctctctccttctctcttttcaatttgtttccctttgcctttatctctgtgggcatttcttcttttctccttagtttcttgccttgcgtctttcttttctactctcttctccttcttctctttccttctccctcattttctttctccaccttcctgagttccatgcagcactgatcacaatgtttgacacatatctgttgctcactaaagacaggattttttttagtaaattgagtcacaatggttatgcagctgtcagaacgagccaatattattgaaaatactgagaagttatactatattcatactgtgcataaacaaacaagtctatccattatgatatgacctgtacctgtacagagaaaagcttccatgttggagcagctctaatcctgtagaattaccatgtttaagaataactaatattgtgcctaataatta

SEQ ID NO: 10980 - DNA, 1032 bp, Homo sapiens
atttcaatatgtgttgctagaagataaaaatgtttgggggggatgggcttaatacttttacttttatattaatactttcattttaaattaaatgattttatgtgaaaatgagtaaattttaatgacatattggaaaagaaatatttttaaagaaacatggtaattcatacaatttttacctagttacttatgagatttaacaacagtgtggattttttttttttttttttgagacagagtcttgctctgttgcccaggctggagtgcagtggcataatctcggctcactgcaacctctgcctcccaggctcaagcagtttttgtgcctcagcctcccatatagctgggattatagatgtgtgccactaaacctggctaattttgtgtatttttagtagagatggggtttcaccatgttagccaggctggtctcgaattcctggcctcaaactgatctgcccccctcagcctcccaaagtgttgggattacaggtgtgagctaccgtgcccagccagtgtgaaaaatttgatacagatttttatattgaatcaaataaccatcaacttggtgcttttacttactaaaatgaaagcatttcctgtaaccgataggtatattggaatgtatggcaaattaagaagtagctgattattttctaacaaaaccatttcaccagttggaaaactaggtattttattctgaccagattctcattaacgtaagcaaaccaaagaattcttattacacacacttagagggtcttgtagtagtaatcttaggggtgagacctcatccctaagatgatgacagatttgaaagtttaaatttcattgaagtataactttccaaaagtatttaagtttatgtgcaagttttttttttaataccctgccagagtaggtaaattatcattagatagacctttcattttaaatgagctacatatactttttatttttggtctgactgatcataccattaatactaacaccattaatactaactttggagtagcaaatccaataaattct

SEQ ID NO: 10981 - DNA, 1132 bp, Homo sapiens
atgtaaaatagcttaccaaatttttttaatgccaattacatgttggtaatactttggatatattgggttaagtaaaataaaatgctaaaattaatttgacctgtttctctttactttagatatgactacttcttctgtggcttggctatatttctgttagataatattaatctaaatctcatctttccttaagacctggatcagttttccatctatttacaaagttacctttgtagctttgtaccagccttcttaaacatttggtcctcaccccctctcaccctactcccccttcccaatatacttagcttcttcaaagcaagagtaattccctatagtgctgttcatatggtggacactatatacattatataatacacacacacatatctgaaaaaatggctaatattaccactttatcaaaaaggatacttatgaaaattgaggcctgttgtgatgtttttgcttaaattggtggggagcagaagaaggattgatgtgaaggggagaagagacattattctactctgagctattgacatttgacacttgacatcccccaagtgtatcctgccaccttaggccactgatagctctgtactgctgtgattttactgccatctggtgtcagattaggaaactgtagttcagcattttgtctcttcaatagaggaaggtaggcaatctttcctctctatcctgtaagcaagttaccaataagagctcatataatttcaatgtaggaaacctttattttccttgttggaatactctttccttggcttccatgataaatgcattctcctttctaatgtttctctgttctcccattcttcgacagcccatttctctcttcatggtagagtttttttagccccacgttctaggcctgctgttctttttttcctttgctttcctctataccaggctttaagtactgcctatttacagacaaatttatattgatagccaaaaatgtcctctgagtttgagactagtatctttagttgcttacctagatattacacaaacatcttaaatataacatgctcccatcaaaatgtggacctctcacctgcatcctcatttcttaaatttatttttctcatttcattaatctatcatgccagaa

SEQ ID NO: 10982 - DNA, 1023 bp, Homo sapiens
gtgggattacaggtgtgagccactgctcctggccagccttgtaaaatttagagtgaaaacctctcttactcttttccaacccccaattttattttatttttatttttattttattttatttttatgtttaatttgtcatgcctgaacctacatgacattctgtacaatcttagcatgtcatgctggctgagttgcttagtatgtgtttgaataaattaatgacacaactacttttctagagaaagcattcttatctttctagactctgcagcctgcagtagagctcgttcacataacagttccttgtgccttctatgtgcaaggcactgtgttaatattatacaatgatgtccctgtcactagggaactagaatatatgtttatatttctcaccagctaataccaactttatcaatatgtttatatataactttgatacaataattgatatgtcataaatgagttgacatgagcatgtcaaggtgagaaaaattaattcacactctgaggatgtaagaacatgtcataaaggagatgacattgggctcagccttatttcagatttctacaagtaaagaattgtcttctagttagaaggaattatgagccaaggtgcagaaatcagaaaagtccaggatatttccttttcaacgtccttctcattaactgtctttttttcaaataataagagttttaatttaacagcctttgcctcttacatgatgaaagtgatggaaaaccatttggagtcatcagattgtcttcccttgaagctgttgcaagattcttgagtttagcaaacatttattgtctactctttgcagagatagatagagtggggcttcccaaaaaacatatttttggatacaggtatattaatgatgatgcaggagataagaaggttattttaaggatttaaaacaaacacaggctgggcacagcagctcatgcctgtaatccttgcactttgggaagccaaggtggaaagattactcgagcccaggagtttgagaccagcctggg

SEQ ID NO: 10983 - DNA, 1028 bp, Homo sapiens
aactttttaacaaagcatgagtaaaagaagcttgaggttcttacttgaaagcttgtaatgaagttattaaagatagttattagtgaattagtcttattttttatcctcaaaaacagaaattttgggggcgagcatcttctctctgttgacctgctttgggcctcttaatggccaaaactctaagatcttgagatgaaatgtggttgagccgtaacgtgatgctcctgtcttaggatctccaatatccttcactcatcctttgagagctcatacctttaatatttggggtaatttaaaaataaagttggtagactaaaatatggggtaaattgaatgaaacagagcatatgactttattaatgcctgcatctagctatctatctatctttctctttctttctttctttctttctttctttctttctttctttctttctttctttctttctttcaagttatttagctttgaaagtaaagttctttgatcaagaaaaagtttgttctgggaaaactccattttcaagtattccttaactacttgggctgaactatgaaaattttttctattttcccttcctgttttcagaatagttacataagataatcttgcaaaaaagtgaatggaggtcatattttaaacaataaatgggaaaagtaattattttacctatttcagataccagtttttgctttaaatgtcacaaatattgcagcacctggctttttttcaaaagaggactgagacacggggttctgcacttatcagtcacttaagctgggataattagccacgtgttaaaattaagttttctagtataaattgaaattttgaaaaagacgtaaaatattattataagtataaataacaggttaaaataattatgccctcattaaaaaaaattaattttttcctttttgttcatacttttagattaatttttcctattttaatgatcattattggtttgtctatagtgattttactacatttttaaattcaactgcttatttcccattttgtgctcaca

SEQ ID NO: 10984 - DNA, 1100 bp, Homo sapiens
gcttcgtcggacgacaggagccccagacattacctgggggatgctgaagaagacaactcaggaggctgagaggatcctgctccgaacacagacaccattcactccagaaaatttgttccttgctatgctctctgttgtacattgcaactcacgcaaggtattggtcctttttattctctcactttgcctgttacccgtacctactataccctattaagcccattttctaaatctgccttttttcagccctattcccttcccagcgtctagcagtgtgactttttagctaggagggactaacatacccccagtggggttcctcagtaacagccatatggaaggatatgcaaaaaaaaatctctcctagaaagacccccactcctgggggtcgcttcttagttagaaaagaatattactaattatactcatgtttgtctcttgttgtttactaattctaggatgtaaagccagaaaacaagcagtaactgctatgcctgacaaaactgttgctgcacacatctgtactcgtcaatcaacaaaacctgatgcaaaaaacagaaaaggggtgatgtaggagatggtcaggttggtaggagaagctataaggaaagacgcaattggaaggtcgggaggttttccaaagcttcaggagagaataaagctgaaggcagctttattaattaattctcttaccctgaggctgagggcgaacagtaggtagcaagggagtgtaaaggaatttatctagataagtttgtttacttatgccctccggaaatcatgcaagactgctccctgcaaaggggggcgacaatgttcattactcacaaattgtgttggcttcaggcctttggtattctgtctctactgaataaatacaaatggttccagcctatcaggactgcactctcttctcggctgcactaaagctggcactcccccagccgttctcatgcaaaatacctgtgtcagaatactcctttcatccatcactcagccagagtcttcaggacagactccgcatgggacttgtccaaaaaaactctaatcaaaagaggaaaattttggaatatgccaggaatagtggaattttatttttt

SEQ ID NO: 10985 - DNA, 1048 bp, Homo sapiens
ttctagtcttgtttctccttctccccgcttccctggggtttttccttaccataagtattctggtccgagggttcagttcctttagtcaagatgtcacaagtttaaaaacaaaacttgagaaactaccaaaggctcaggagttgtccactttgttgaaatccattaaattagagaagtctcactaacagatgtatttaaatataggtacaacaaataatttctttttctccccttccccaaattacagtcagcatttaaagctgtttatggcttgccatcagcattattctggtaggcttgttagtgttaaaatctatttgattttttttttttttttttgcctcttaaagtctaattttaggatggatgaattcagatgtttaccagagtgtgtattttacataatgttcttgattaaaaagacttgtttgtaaattatccgttgtttttgcatatgcccagttgatgtgataaaattttcattgtcttgccatataaagccttggttatcaacaggtggaatgtagatattgtaaagctttttgtgaattaaaagtgcaaaataaagcaaccacatttaagtagattgtcttttctcttattttaacagggttaacgtattttgctaaaatgtgagctttattactctgtactgcaagattacttcttagtcttcagttcacctactcagcagcaggatagaggaagtgtgagaattgaaaaactacagcagtgccccctcatctgtggttttgcttcccatgtataagtaaaccatggctaccattgtccaaaaatattagatggaaaatttcagaacaactcgtaagttttcaactgtgtgccgttctgaatgaaatcttgcagcaccgtgctttgtcccacgtgaatcatccatttctctagtgtatccacactgtatacactacccacctgttagtcatctgtaccatttactcctgacatccagccattgactatgtcatggttccatgatccaggatcacccaaagcagatgatcctccttctgatgtatcgtcagaaggt

SEQ ID NO: 10986 - DNA, 1050 bp, Homo sapiens
ctaaattagtaagtgaaagaatgaataaacaagtgaaatatacaaggaaacttgcaatacaatataagtgctacaataaaggtatgaacaaaatgttgcaggaacagaggagcaaaatgctgaaccttcttgtgaagactttatggagaaatattattcaaatggtataattaaggacaagtatttgtctattaaggacagaaatttgccaggtgaaaaatatgaggaagggcattccagaaagaacaaagagcatgtgtaaaggcattgaaatacaagtacatgtggctggctaaggaattgtgagaagccaggtgcattctgaatgcaagggctgcatggagggttgttgcaaatgatggggctggagaagtagtgagggtcagagatgaaggtcgcaagcgcaatgctggaatttatccttaactcaaatatacaatgaaactgacaaaaattggaaaacaaaatactttttatactgcagataagatcctgtcatttctttatagttagactcctcgttacagaaatcaaactttagtgacaacttaggcattcctaataaaataacagacattttaaggttttaaataatatgtccattacatcatttgattattagacatattgtatattcctcattgtaaattttctcaatgtctaacaaaaatctttgcacgattatttagttattaactttaagaatattctttgtggagaatggagatgccaaatagtcgtttactttttgtgtttgtgatttttttacttttggtccaagaactttagtaaaccaacagtttagctcatgatgctttcatgaattaacccacatatttcataaatctaggaagattcctagagttttaaaaagatttcctagagaattgttcaatatttttcatggaaataataatagactaagcccatgccttttcttgtgtgtatgtgtagctctctatctacctgaatgtttgtgtgtgtttgtctatctctctgagtgttgtgtgtacagctgtgtaacacacacacttacatatacagtctttt

SEQ ID NO: 10987 - DNA, 1023 bp, Homo sapiens
aaatgggacaatagtacttacttaagttattgtgaggattaaataaaacagataaatcacttgccacactgcctcgtttatagtataaattcagcaaacgttaactactcatgtttaaaatgtgccagtttggtggaaaatgggacacttactgttttaatttgcacttcttcaaatatttatgagactagaagaaattgatataatgaactgctagaattgtggatcattttgaatgaacaaaatgaataagcacttaaataataaaacacttatcatgtgccagatacgtttctaggctgtcatgtttacatttgctcatttaattgtctcagcatccatattacatactgttttctgcatttagcagataaaggagctgaggctcagtaaggctgttaacttgcggtaggtcacatatccaggagggggcagaactagactttaaatttaggatgtataactctgagccctgttttctttcgtcttaccacagatgctgccactttattagattgtaggtctctttagttttattactctcaagtatataaagacactcaaattaggttataaataatccagtgtgattaaagatcaaaaacatgtaaattagatgtgattcaagatcatgtctgtaaatcagtgctttgagtgtgttagaaaattcttgacagtattagcataaaaattcaacggacttcttgaaatcttatttgtgccatcattgaaaattgggctaaagaaagtgagcatcagcctagtccttaaccaaacttatcacaagttccaaaaatctgaattatttagcttttactgtaaaatagaaagaggtttggccagctgtagtggctcacacctgtaatcccaatactttgggaggccaaagtggtaggagcacttgaggccagcagtttgagaccagtctgggaaacacagtgagacctcatctttacaaaaaaatttaaaaagtagctgagtgtggtgtacaccagtagtccaagctacttgggaggatgagtt

SEQ ID NO: 10988 - DNA, 1050 bp, Homo sapiens
aagtttgtagctcttcgaggacattccagtgggaccctcattggttccctgcaggatggtggattttctgtcagccgccccccaacccccaccaggttcctgagtccgtccctcgcctgcagctgccgctctgcagaggcgggccggcccgggcaggctcggcccgtggcgcacgcggcccgcgggctggagtcagcccgtggtgcgggcgagagggcaggggcggggagaagccatgcctccagctgcagaggttgcacacagctggcatgatcgcggtcacctgcgcggcgccggtgcccttgcgctcgcgttgcccggcccgcggccgcggactttgcggcgggagcgcggcgcggtgaagcaccggcgcggagggcgcccggcgtaggcggcggcgggtgtgggccgagccggtatttatagctccgtgacagcagcagcggcagcgacgccgccggcccgtctcgccgcgcttcccagcgaggccgccggcgcgccgagggctgtgctcgaccgcgaatcccgtgtgcagtcgccccgcgccccgcgcgacccttcgggtgagtacgtgggcccgggcgttgggcgagcctccccagccgttcggtccagccgcagcggagccctcccggccctgccgcccgtgtcccggctgccacctcgtcactgcccgcgagtgcggaagcagccgcggaaccccggcccggcccccgaattctccggcgcctctgctcctgccttcctggggatggcagccaaagaggcagggtgaagtgtcaaggagggaggggggacgcgccagccctctggctaagggcagaggagactcccgggcgaaaggctcttggtgggagtcctcaaactcccggctccagtgtgtgtgcagagatacggcgggagagcagaccttgaactttccttgcttcagcgattcctagcctaggaactgagtaaaagccctatttttcttaattaaattaacaggttgcagttcgtaggtgttgttcttgggaaaaaaacaaagacttgggtgtttgggtgtttgct

SEQ ID NO: 10989 - DNA, 1028 bp, Homo sapiens
ttttttttagtttaaaatggaatctttgggtattaggatttataaaagttaaattccattggaatgtcagtttatactcttccagtacctctctctctcatttgcttggatgattctagtttttttttaaaatgtgttttaataatgcatcctagcttttggggggattatactttagacatatccatgaatagagacatccaaaattcttatgcctacaattaggacttatattcaaggagaatttaatttcttgagcttattcaagaaataatttttattccaaaaaggaattgaaattatttgcaacatacatgcataatacagtagaagtagaaaatcaggaccacggaaaaggcagaatcaaatttgttttgatttcatgggtttcaaaaccttgcttggttttgagcttcctcagagctgagcacaaggggaaactacatcactgtcgttatcagcagtgatgaaaattgtaagttcaacagaggtctttttctttgcaccaaattgtagaacttccttgctataaattttggtaaagcatttcttttttcttgtgcttggtacaagagatgctgaatggtgaagtggcaaatgcagaaatggatttcatattcttgtgtcttaaagcaaacgttcatcaaagtgtagagtataacatttaaccagctgggcgcggtggctcacgtctgtaatcccagcactttgggaggccgagatgggctgatcacgaggtcaagagatcaagaccatcctggccaacatggtgaaaccctgtctgtactaagaatacaaaaactggctgggcacggtggctcatgcctgtaatcccagcactttgggaggccgagtcgggcggatcacgaggtcaggagattgagaccatcctggctaacacggtgaaaccccgtctctactaaaagtacaaaaaattagccaggcgtgttggtgggcgcctgtagtcccagctagtggggaggctgaggcaggagattggcgtgaacccgggaggcagagctttcagt

SEQ ID NO: 10990 - DNA, 1026 bp, Homo sapiens
cagttgatcagttttctgggtgctctcttaccttaaatggtagatgctcaaaggttatggatgtgagtaatcatagctcactgcagctttgaccccctgggttcaggtgatcctcccgcctcagcctcctcagtagcttggactacaggagtgagccaccatgctcagctaattccttttttactttttaatttgtagagatggggtcttgccttgttactcaggcctgtcttgaattcctggcttcaagtaatattcctgcattggtctattcctgcctttttagcggagtgagatgtgactaaggcatttcaaagcactctatcttcagaactacctgctacctatctcaattgcaggttcattattttctatttttggcttatatcctgtagtaatcaaagattggcttgaaaacaatattggcacagaccatcattatgagcacgaatactattctaaaaataaatgaaaaaggcgtctgtacctctaactacagaaaagctatgatgaaggcattttgactgttcggccagtggaactcagtgacatagcaggtattaagaaataacttttctgtaagatactttcttttgggcatctaatttgctcatttttagttgagaatttcaaatacttattttttcagagcttttgtatgtattttaatgttaccagagaattagcttattcaagaatggaagatcataaatcattacatgacatattgtacaggaagacattgagcataatttgttgataatgcccactcacaaaggtatttttgaatctttccatcttccagttatgacagttaagataatagtgtgctttcccactctaccatcaagtagtgtgtcgtgccttgtggtacaaagaaattgtcatgaaataaaattcaaccagtctttgaattcttaataccttaatagcaatatgaaatttctgtaaaatccacagattatagctttcttttttcccctcttgattcttattttgtggcaaagagagaaagataaaaaatga

SEQ ID NO: 10991 - DNA, 1032 bp, Homo sapiens
atttgttgagtgcataccatgtgttaggtattcttcaaggtgcatggaatatgccagtgaacaaaacacacagaagtacctgtcctcattgagcttacagtcttaacttttccagattctgtttctgttcttaaggcatcttctaacatttcttttgggaaatacctcttgaatttttttttttttttttttttttgagatggagtctcaccctgtcacccaggctggagtgcagtggcgtgatctcagctcactgcaagctccgcctcccaggttcatgccattctcctgcctcagcctccccagtagctgggactacaggcacccaccaccatgcccggctaattttttttagtagagacagggtttcaccatgtcagtcaggatggtctcgatcccctgacctcatgatccacccgccttggcctcccaaagtgctgggattacaggcatgagccactgcgcccagccagaaatacctcttgaatttttaagctttctaactgctttctagaaaacactcatatcctcttattttatataattttctccttatcaggctaccctaaaactaccatactcatatttttttcctctattgttttaaagtagtctgcacttactctcagcttccttagttctctattattccttaacctcttgtgatccaatgtctttcattagaagtttgcaaaactgtcccgtggaaaatatactttaaaaaaatccattttttttgcctccactgctacactgtcaatatctctctcttggaccattgcaatagcctttttccaaactggcctctttgtcaataattagtcatcaaatctaccttataagctgctgtcaaaatactcctggtatcaggaggtcaagactacccctagttttaatgactcatgaggagaattcacaggcctcagcatatattaggactcatggctgggatttattatggagaaagaatctaaaagaaagtcaactaagggaaaaggtgcgtggggcaaaatcctggggaaattaggcaca

SEQ ID NO: 10992 - DNA, 1027 bp, Homo sapiens
atttttttatgtcttgtttctttatgtgcctaatttaaaaaattgaatattagagataatatctaaagaattgtagaggttcatgatgatacaatcttccctagagaaaattttattttcttctggtctgtagatactgggttcaggctttctttggtttgatctgtttctgatttgtccttactcctatgatattgcctttcatatatcacatcctaaagcctgaactctgcccataattcttctactttgatgttccctgaattctaatttttgtttactcagcatcatgagactaaaatttatgcttagttttttttgcttatcagcagttctatgcttgatcttacctcacctacatagtttagtaggtgtcagcaaatgatctatgggaaattgtgttagaatttcgggtcatttcctgagtttccttattttttctggtattttgttccctcatgtcctgattgcatttgtggacatgaatttcaatttttatctctggcccagtgacactgcctcaagctctaagccacagttttccatatggtccctatgacactgaaaatcagcaaatctcccaaggggaaaaagatgcaataaatttggctcatctaagtgcattttctttccttagtgatcttggcctttcaagtcttgcctgccttgcttgctttttgatgccttcaaacagtggccttcattatgataaatacacttgctaggtacacagctatagattgatagttatttcctcttagcagtttgaggcactgtcttatgacatccgttgttgctgttgggaagaaatcagtataattattgttcctttcaaataatctgcctttattattgtctgattttaagatcttttttgtcttttaagataaataagccctgcagttactacagcttacttcctggagagttttttggcctcattgcaggaaggaggaaatcaggcagaggccagggtcttcctgaatggaagagatagagctgggtgtgtggggaggccaaaacagct

SEQ ID NO: 10993 - DNA, 1115 bp, Homo sapiens
acattaaaagattcattaaaataaagcaaagatccatgaattttgagttacagtgtacattaatttttaataatatttgtatttcaggtcagttgctccgattaaaaatgtttcgagaagatcatgggtcgtggatgacaatgttcttcagcacaattctctttctcttcatattttctcacatatacaacacgattcttctaatggatgggaacatggggtaggttttctttcccctttctactgtggtgagtgttatgtttgaaacttgtaagaatttaagagttttttagcttgtagtagtctaagtctgctttacaaatattctaccctaagaagaaggagtattttatgtatttttcttacctaagacattaacattttttttttccaggaagcatatagtacattacaatatttagattttgttctttatcctttaggacttttatatagggtggtgggagggcaggtactaatttcattatactgacaagggggtatgagaatcaggaaatcttattgatttgcatatattcaaatgattcatagagtggggctaagatgaaggtttccaggtttgcaatttcattggtctgcaatgcctggctaaataaaagtggtacaggaggcattttctttaactctcttgacagtcctgagagagagagacctttgttataaataggttgttttaaaagtgggccacagctgggcatggtggctcatgcttgtaatcccagcactttgggaggctgaggcagcggatcacaaggtcaggagatggagaccatcctagccaacatggtgaaactccatctttactaaaaatataaaaattaggtaggcgtggtggtgtaggcctgtggtcccagctacttgggaggctgaggcaggagaattgcttgaacccaggaagcggaggttgcagtgagccaagatcgtgccactgcactctagcctggcaacaaagcaagactccgtctctaaataaataaataaataaataaataaataaagtgggccaccctgtattaactcctagcttgtgatatatacttatcaaatcactaagacatgaaatatgtgccaacaagtagttgtataatttttct

SEQ ID NO: 10994 - DNA, 1042 bp, Homo sapiens
actaaactcatcattttataaatgttgagggttctgctgaggagaaggtgctgattctgggcatagttttgcatgtagccattttatgagtaacttctttttttttacaaggtggcagactaggtaacctgaagccttgcctactacaaaatctttagaacagctggaggagataatgcagcttggtatactcctttaaaatgcatagctgagtttacccaaaggtcaggaaaaatcccagaggacaaaaatgcagaaggatctgaaaactcgggcggtaagactaacaactgattgatactgagatgctcagtggaggtgacttaggcacttgaattttaacccttatgtagggaccagaaacaaggatttggctcatattaattgaaaaattgaaaatagaaatttccacacagatgatcccgcaatgggctacagtgggagggggaggtgaaatggaaaacatgtaactgttagcagcactgaatccatcggatctgcagcaaactggatttttgccttgttagaggaaagaattcagctaagggacataaggcagagtgagagactgagacaagtttcagagcaagagtgagagtttattaaaaattctagagcaagaatgaaaggaagtacagtacacttggaagagggccaagcggacaacttgagagatccaagtgccccatctaacctttgacttgggtttttatacattggaatggttctgaggtttgcatttcttctccgctgattcttcccttggagtggactgtttgcatgctcagtagcctgccagcacttgggaggtgctgcatgtgcagtgtgtttactgaagttgtgtgcatactcattcaaggcatttttcccttagcagtcaagtgttcccagaggaaggtcatatactagttaaactccgccattttgtcagttactgcacatgcttgagcccactagcccaacttctgagatcttgtcgggaagctgctgatcaccaagagtttgctatctgttgggagactgcctttccctggcactggct

SEQ ID NO: 10995 - DNA, 1047 bp, Homo sapiens
tctcactctgtcgccctggctggagtgcagtggcgggatctcggctcactgcaagctccgcctcccgggttcacgccattctcctgcctcagcctcccgagtagctgggactgcaggcgcccaccaccacgcccggctaatttttttgtatttttaatagagacggggtttcaccatgttcgccaggatggtcttgatctcctgacctcgtgatccgcccgccttggcctcccaaagtgctggcattacaggcgtgagccaccgcgcccggccaaaatgcatggtttctatgtgctgagggggcagcaaaagcaagcaaggataaataggaaaaataaatgagggagagactggcatagacttcgaaggctgaaagaaattgttcaagatccaattaaagtccatgcaccaagctgacttaggccttagcctctggagctcttacatttatcccgatttttgaaagaatcactaatacagtggttcataagtatgaaaagactctctggtttgtagcttcagtttctgtcgtcacagttgtaggcttcagcacataatttttctcaaggctgatttatcatttagtggaaaaaaatcagggtgaacttttactttaagcagtagtttatttttaattaaatttttgttaagttcaccattttcaacaccttcagtaatgctttctgatcccttacacaaacttttttccttttctagtcaatattgattgagtagtagaagcccaggtgcacatttttactgataagaacagtgattttcacttcttattgctcttcaagtaataaggtggtcagcctgcttccattgtttacaccggtagcttccttccaaggaaggagtgtttgtgtgtttgcttctttgttttatttattttgggaggtgatatttgtttgttttgggaggtggtatttgtttaatttattttgggaggtggtaagaaaaaaattaaatttaataaaatataagtgacctaaactgatgaaactattgaagtacaaagctaccaactgtagcaaattaaaaaaa

SEQ ID NO: 10996 - DNA, 1064 bp, Homo sapiens
agtgatttgactttaagccacagttggaagagaacagtttcctgcctttgtcaggttctggaaagatttatttgtttcactacctatttcttcacttgacacagagtagtggcacgttattgttttttcttggagactgcagtgtctagagaaactctaattgtacttctctagttgaatcccaatattaaagtcttttaagtattttataaaggcttttaagtattataaaggctttagcattttaaaatctgactttattcagaaaacttttccttttataggagaatattaatattatttatttaaaatgaagggatatatagctgggaattatcctttagaaagtatgttttgtaaaggacttgttctatttctgagttcttgtttctttcacatgttttaagaaagtgctgaatgattgattaaataaactttagatcggttaacacctgatagtgagaagactgctccttggaatttctgttttaatttctctttatcctcttgtctaataactatgataggcaaaatttatgatctgtctctctatctcaacttaccttgttccagatgtacatttttgatgtctgttattccagttatcatgtatttaatataatttcctcatttgctacaacatggaaataggcttttttactaaaaattataaagtaattatgtcttctatgtttatattcttaataatattgacatatctgttaataatatgtaatgctaatgaataatttagtttccttagtgatagtttccatgatgttataactaacatccctacctatgaaaatgtagggagctgtctgaagcccaggaaggtcaggaaggtgttaagaaccaggacaatgtatttaacctatcacaatcaaaatgccattcagcctttgccctcaatatttgacagcaaatgaatttgtcattttctcacaaatatcctgccttgagctaccacttgtctgccttgtaactcatcttttccatgacctagttcttaacctggtttttgtctttaagttgtcactataaaatctctaactgggagatat

SEQ ID NO: 10997 - DNA, 1096 bp, Homo sapiens
gcttgcaaaaaataattgtggatgattatttcttactgattttattttcaaatgtttgtgtatggaacattgttttggaaggaaagatttagcagcatcactcagcttataattagtgtcagatatgttaataaaaactaatcaagatgttggtaagcaaatgctagaaactgaaaatgaaggtgattaaaagaaagtaatttctgaaacaagctaggattaactgaggatggaatcccaacaggatttctgcttttgttcattggccttgcccgtcactgctaacataatatgtcatgctgaaagaacaaaccttcactgaggggtccagaggacatacttcaagttgaaagttctatgtttgttggttcaacaatgctgagttaattacattttataattctgctatacttgaattctaaattgcagtcccacgtcttgtcttaaattgttattattatttttttggtcacacattttattgggaaagaatcaaagtctgaatgaatgatatttattctagtgggctctgagatgtaatacaccaggaaagaaaaattactgattaaagtgaagaaaatgactatgaagttattctgttcagttgtcttaacaaagatgaatgtgttttaattaatttttttgtgtaaatgtaaattgttaatgttaaaatgatagaggttaaaaaaatcaactgattacagaaatttttgaaaatacagaaaaatataaagaagaaataaaaatcatctacagttaatgtacttagaagtactcatgattaagtttttgatataaagtatttttcttttccttttgcattctcttttaaatgatagtataactggatataggattagaatttgactattattttccatcagcactttgaagacattactttgttgtcctatggcatctattattgctgatgtctttatgatttttttccttccattactgcttttaagatctccttgtatttgaagttctgcacttcactacagtacatctaaatgtggatttcttttcatttgtcttccttagaacttcgtggtattcctaaattttagaatcaatatctttcagactattg

SEQ ID NO: 10998 - DNA, 1047 bp, Homo sapiens
tacccagtacatgggatatttcttatggcacactcaccaagtcatgcacatgctagagtgattttttaatgtgacttttatcattttttgatgtctttaattctgtttaacatattttaatctattttctagctttttatttctgttatcttgtccctatgatactcacattgtcttgtttagaatgtacattttactgtgaattaacctctcaatgaagcttttagttagttttttttttttcccttgggagtcttatgtgccctgagtcagttgaaaacatattaatctaatggacaaaaaattgagtattattttaatttgtgttattttaggtactaatgagttagaactttttcatgtgcttgttagcatatgcatttcttctttcgtaaagttaggagcagtgttcatatttatccctataaaataaaaacatgtacattaatcatggactacattttgttctgatgattcagtgttattgatttctgagctctgtaatatctgcaagttataagtctttcttggcttcctccaggaagttgaaaattaatatttatttctatatttgtcaggaaaacacatgaatgtttgaagatggggtgggatcttgtttttaactctatataatatctgcagttaatcatggcaaaccaccagtttcaatttgtcagggtattgttatcatattctaattttgtatcaactaaaataatatatttctttttggttgaaatgcctttagaatcttagaacaagccttaggaaagacattactacctatggaaaacatgaaaatttgaaatattgtaatagaaaggtttcatttaaatatctttttataatagagtaaaataagatactgtgtggtaataagccttcacagaattgggcacgttggattcacctatatattaaaaaatgtgtgtatgtattagatgcctggcagcatctagtaaaatgagatctacatgtgtgaatttgtgttatttaacccttggcttaaaagtaccactcacagaagtagaagtgtgagtgttaagg

SEQ ID NO: 10999 - DNA, 1067 bp, Homo sapiens
gtttgctagattggatgttcagaatagcagagcttctttgtttttgagacggagtctcattctgtcacccaggctggagtgcagtggcacaatcttggctcactgcaacctctgcctcctgggcttaagtgatcctcctgccccagcctcccaagtagctgggattacaagcgtgtaccaccacgcctggctaatttttgcatttttagaagtgacggggtttcaccatgctggccaggctggtctcgaacgcctgacctcacgtgatccgcctgcctcagcctcccaaagtgctgggattacagacatgagacactgtacccggctagaatagcagagattcttaagcaggtcagaactttaagggtgatgagcaacttctaggcactgagaagttgatatggagatgaatctctttcctcatcagctctctcgactctgcctcagtctctttctctgccttgcctttaaaaataaaatctaacattgatgaaacaaacatatgttgtggcattgtgcttgttaggtacatgatcttaaggaactttcaatctggtagaagaacccttaggagatctatcgctaatatagttctaaagagtgatttcttaaaccatttttgtctgtcaacttttgtttcacaaagaatgtcttatattcccttaagttaggaatttacatcagtaaagactgaagatttaatcttactgacagccccaaggacatgcaagggcaatatcgcccatgtcctaggaagtttaggagtaagactgatggcaggtattaaggatattcagattgcagctccttctaaatgaaaatttattatttcattattcctaagacttcatttattacgatccttgggatttgagataattgaagacaacaataataatctctttatgtgttacatagtatggagtcattcattttgaaacatttccaagtgtgttgccaactgcatataaaattcagagtgggaagctcaggaatggtgaaggaaatgtgtatagacatacacatggatgcccttgaagtcctgagaggaccttgtggcctcaaaa

SEQ ID NO: 11000 - DNA, 1935 bp, Homo sapiens
caatataacatactatcgataaaaaggtacttaaatatcattatactaattattttaattatttaaaatacaactttaaaatccaattgtgtcctaaagtgatatttcacagtaagaggcaaatgtattatatgaagcatgagctttccctgttgtgtctttcattctttccctcatctgtatcagaaaaggtcacaatctggggataattattcacttcaccttttctacctggtgaggtggcttgaattcccaagatctgtccttttcagggcttcatactgggatctcaggcccccatgctaagcctaatttacttatcgacttcatatatttatagtggcataacaatgaccatatggattctctgctaaatatactcttacgttgttgcttcctatataaaaaagcactcaatcctactggtaccatcagaccagtgctccccaggtgatgtgaaagtttatctgaaatccagtttctgaagaataagtaaactttatatgagaggacttccctgaaacgcttgcttctctgtaccatctaatataagcagaatttctgaaaactacattcagctagggttgctgtgaagattcaataacagcacctgatatataggaagttttcattaaatgttaccagtgaggaaaatgatgtgattttgtattgttagaaatcttgacacatttggcatcatccatgttttgctattaattcgtaagactacctcattaaacctttattttgaatgtacaaacatttctcatttgtagtctttggaggcctacttttacacgtgttttgtttccataattacctaaagctaatttgacaggtactttgtctcattttttttttctactacagtgtctagaaatgtgctttacatagtgctcaataaatgtttgattaaattaaaacaatgttaccagggcatctgcatattataaccacagattaagaaatgtagatacagaacatgtattcatttgaacttcaaagtacgaatccaaataataaagctggtatcaaggtggctagtggttctggggctctggtataatcactctgtctggtttgctatcactaaattaccaatagggagcttgatctgagaacacatgcaaaagcagatcaccttcagctcccctctacaggggttcaagagtccattttcagcaatgcagaaaatacattgagaaacatatgtttaggggaaagcaaaatggtgttttctcacctgcgaaaggtagttgctaataatgcattttaactcttgtatgccatctcactaaatctgtactactttgaaattatagaacatgttttcttcctggaagacagaaattatcttctttatccccatgcctgatcattactgaacataacaattacaaaatgtataaaaacactgtctctttgggctccttctttagctatttttttttctagagaagaataagaataaataaagcagagcttctttcaaaattacaatttcttctggaatcacggtttcagaaaaaagagaagaggatgaagagtatgagaaaggagagagagagggaaggatacagagaatagcacagggttttaaataaatttaagtattctcctttaccaaggtttcttgctataagtcatctaaggtcaatttactcccaacatcagttttaacaaagaaaagtgaacaagaaagctaacaacaatggaaaatgatgctagactttgccagagcttttatttcaacaggatattgagtattaaaatgctttggcttggagtatcttggatgttgcttccaagtcttttttttttttttttttgagatggagtcttgctttgttgccaggctggagtgtagtggcatgatctcagctcactgcaacctgcgcctcccaggttccagcgattcccccgcctcagcttcct

SEQ ID NO: 11001 - DNA, 1068 bp, Homo sapiens
caaaaatcatccaaaatatttattttcctttaaaaatattttattgtatctttcatttttatttatctttatgaaaaggcatcatagtggcattttcttttccacgtgatattatattgccaaattttatcacattagtgtctttgtctataattcattgattttgactgctgaataaaattctattaggtgaatatatgcaagttattcgttctcattttgaagagcatgtagtatgctttcaagtttttgtgattattaacagtgcatttatgaacattcttgtatgttaatttcctaatattaaaataacctacataatctggtataaacagaatttagtaatcttgcatcttactctccatatattgctagattcaattgccaatatttcttaagagtttttgcctctaggttcatatatgatattggcctctatttttcttttcttgcactatccttgtgtctctatcccgattatgctggcatcataaaatcagttggggattgtatactcttttccttctcaggaagggtttgtataaaaatagttattgatttcttgaatatttggtataactcaatgaaggcatttgggacaagagctttttctatgagaaattttctttattaattattcattttctttagttgttagaggatgatatatagtcatattctatttctgtcttcagtttgttttgatgaattatacctttttcagcatttgtccagttttttctacattttcaaatttattgcatgaagttgttcttaattttctcttagtatctttagagtctgcaggatttgtagtgatggcttttttatcattcattcctaatattggttatgtgtgcttcttttcttcattattattttctatagtttttcaaattaattattcatttaaataaactaatcttggtctttgttgattcattttattgcatgtttctttattttcttaatttctgctcttttttaattctccttatttcctacattttttttgctgtttcttttcattataccttgaagtgaatactgaaataattacttcacagg

SEQ ID NO: 11002 - DNA, 1063 bp, Homo sapiens
actaccattgaaattcttcacagaattagaaaaaactacgttaaatttcatatggaaccaaaaaagagcctgtgtagccaacacaatcctaagcaaaaagaacaaagctggaggcatcacactacctggcttcaaactatactacaaggctatagtaactaaaacaccgtggtactggtaccaaaagaaacatatagatcaatggaactgaacagagacctcagaagtaacactacacatctacaaccatctgatcttcaacaaaccatgtaaaaacaagcaatggggaaaggattctctatttaataaatggtgctgggtaaactggctagccatatgcagaaaacagaaactggacccattccttacaccttatacaaaaattaactcaagatggattaaagacttaattgtaggacttaaaaccataaaaaccctagaagaaaacctaggcaatacgattcaggacatgggcatgggcaaagacttcatgactaaaataccaaaagcaattgcaataaaatccaaaattcacaaatgggatctaattaaactaaagaacttctgcacagcaaatgaaactatcatcagagtgaacagacaacctacagaatgggagaaaatttttgcagtctacccatctgacaaaggttcaatattcagaaactacaaggaacttaaacaaatttacaggaaaaaaataaacccatcaaaaagtgggcaaaggatatgaacagacacttctcaaaagaagacatttatgtggccaacaaacatatgaaaaaagctcagcatcactaatcattagagaaatgcgaatcaaaaccacagtgaaataccagttcgcaccagtcacaatggctattataaaaaagtcaggaaacggtagatactggcgaggctgtggagaaataggaacgcttttacactgctgatgggaatgtaaattagttcaaccattgtggaatacaatgtggcaattcctcaaggatctagaaccagaaataccatttgacccagcaatcccattactgggtatatacccagaggaatataaatcatt

SEQ ID NO: 11003 - DNA, 1044 bp, Homo sapiens
attcctttttgtcttttgtgtgtctactagaggttttttctttgtggttacaatgaggcttgcgtaaaagatcttataacattccattttaagttgataagaacttgacttcagttgcatacaaacactctacacttttactccccagtcaacgttttatgctattgatgtcacaccgtgcatctctttatattgtatatctttaacaaactagtgtatctatagttatttttaatacttttgtttcttaacttttactctaaagttaacaagtggtttatatacaactattacaatattctgaacttgactatatttttaactttactagggaatcttatacattcagatatttttattttgttaattagcatcttttcagttcaatttagcattaagttctaccttcagcattcttttaaaagtcagatctagtggcaatgaattcccttagccttagcttctgtggaaaagtccttctctctcctacatttctgaaagacagccttgttggatatagcattcttttttaactcttcgtttcctgaacactttgaatatatcattccactctctcctggttttcaaggttttttatggagatgttcaccaatagttttatcagggtacccttctttgtgatgagtctcttttcccttgctgctttaaagtttccctctttattgaagactttagtcaatttgatcataaagtattccctctctatctgtgaggaataaattctaagattcccagtggatgcctgaaactgtggatagtactgaatccaattgccatcagttggaacctgtttctgttcatgtcttctacaaacaaatttaatgccttttccatctttgcttatcacacattgtgaccataacttctgcagtctgaagtgcaacagcaaatggaaactagtatgaatttccattttttcttcttaatttcatgggtagaagatttgttcttaccatggatcttgggaaactcagcataccattttttttctttctttactaagtcaagagctttcacctttcc

SEQ ID NO: 11004 - DNA, 1001 bp, Homo sapiens
gttcacacaaaaggctaaccttgggaagctcagtgttgcctttttaataagtatgccagctaactaaagaaataaaaccaagaactgtgttactagagataataaatggtcataggttgtcttaactagttggagcaaaacaatgactgtataagtactaaaaaagtaacagcggcgtttacctgaagatgtttcacatgaaatgggaatgaagaggtgacatttcagacaggtttttgaggctaatactaatgtctgcattgctgaaacaaacttggatcagaagttttattccatgctctccaaatagtaattctttcccaatttcatctaaagaaaatgtttaagataaagacagaagaaaatatgtcagaattattcttaactttattatttatttatcgagatggggtctagctctgtcacccaggctggagtacagtggcacgattacagctcactgcagcgtcgaactcctgggctcaagcattcctcttgcctcagcctcttgagtagctaggagtataggtatatgccaccatgcccagctaattaaatttttttgttgttgttgttgttgaggggtcgtcttgctgtgttgcctaggctggtctcaaatttctgacctcaagtgatcctcccacttctgcctctgaaagtactgggattgcaggcatgagccactgtgcccagccttaacttttaaaaatggagaagatacagtacagcctttatggacatgctctggttacttaaaaaaaaaaaaaaaaaaaaagagacagtgtctcactatgttgtccagactggtgtcaaactcctgggatcaagcaatccttggcctcctgagtagccggaactacaggcatgtgtcaccacacctggccctggtactttctgagttcatataataacaaaataggctgggcatgatggctcatgcctattatctcagaactttgggaggttgaggtgggaggatctcttgagcccagaaggtccag

SEQ ID NO: 11005 - DNA, 1033 bp, Homo sapiens
atataattatttttaactgtcaagacctcctatacaggtactgttattgctcatttgctaaagtttttattcagtatgaaatatggtaatgataagaagtactaacacttttaatcctcacataactataaaaggagttatcagaaaatgttttttttataatgtgggtagaaatctgttcatttagagtttgagggccctaaaataagatcattctaccatattttactactacatattccaaagcatcaccctaaaatattgactctgatggtgaagtataaacactttgtgcactcctaattaccttccttgactccagagcagcagctcttaaaggaggaaggtgggtgggtttcatcacccttcccaccccacccttaggtctttgctcaccatgctttggtcattggctgaagcagcctcatgccctgtatgtatcccagctgtgaggggacagaactcagttgtttacagcctgtattcattgattatgggccatctgaacagtgtcatttttatgtacaggcacacaggaagttctcaggcaatgcaattttcatgccagcccattagaggaccaccttcccaagaagtatcccaaaactagggccatttcctcccatatttcactgacagtctcactcccaggtgaacctccctaacaaagtgattccccagttttgttttcttaagccacatcttccctgagtccccagccaaaacaacagaagttggcagtgcctgtagtttaggctctggatgagggaagttactgagcactgtaggctctagagtcaggtagacccgaactccacttcccagcactgtagctctgagctgcatgatcttgagccaggccttaccactccagagccctattttattatttgtaaaattattaattccctaccacatatcataagaatagtacataccaaccacagtgttagggaattcattgagttaatgcatgaagcctcgtttctattgaatgttagctgctgttattttatcatcttcattactcatc

SEQ ID NO: 11006 - DNA, 1022 bp, Homo sapiens
tggggaacctgtggagaacttcagaacggaatgctgtaggcaagaatgtgatctttgtccctggtgaggactcatctgccttctctcctaagctctctcttctgatgtgctctttgagccctcgtcaccgtcaccgttaagattcaaggagtttgatagcagttctcacaatagggaggctgccttgcagcattcctgaggggagaaggagaactgaccccacccagagccttcggattccatggagcattcaagcataaatgaaggggaaatcctagaataacctgctgtggctgtgaccatttcattttatttggggagatgttttcctttggttatgaaacagattttacaaatgctcttaatagcatttccatttcccagcagaaaacaaagataagacaggtagccctttaaaccccttgcctcattcccgaaaacagttcagcacatgggatcctttacaatgctggaatgatttgatttttgtcactttaccaactggaagatacgcctgagatcggtcttgcccttcatttctcataatttcacctgttcttggccataatcaaacctagttcttctaattagaaccacttcgcacaggaactcaagcaagtagactgtgattcctaataccgttcagggtggataagcacatttatgttacaaaataccctgccattactttctttcttgtcattgtcgcttgaggtgagtcagagtgataaatcgctgtcagtcacctaagaggaagctgcaggtaagaggcctgctctgtggtacagaacatgctacagccctggaaacaagcgacagcactggctgcaacaaaattcacgggctgaccacaccgctgggctttttctcccctactttgtctttaaatcaaatcaaattttaccttcaagtattttggttcctttgggacaatcaatattcaccattgcagggctctagcttcaagatcaaaatcttacagcaacccttttcccaggactgggatagaagaggaaggaggg

SEQ ID NO: 11007 - DNA, 1048 bp, Homo sapiens
tttttatttaaaaaattctttaatgtatctttttgtaataacgtgtgtgttgctgtacagtttatagtttatttttacaaatatttatctcagtggatttttgcaacaactctaggaaataggtattatcctcttgtagatcagggaaaaagcctgtaagtaccattgctagtgcagaattagagtttagttttgtgagttatagtgtactgctcctagtttactatcagagtcttggggtcaaggattttttttttttaatggcaatgcactttttggcatctgatacattgtagctgaactgaattaggatctcctgtcacttggggagcttcttatgaactcaggtgggtatggtaggcctctcagcaagtgggaaatctaatttgggaaattctgaaagaattgaaaatttctaacttacagaattaatagtatagcatttcattcgtctgtccctaaagcttaacatttttttgtgtggttttattaaacaagcatcaagagtcagttgtagttgtagaatattaattaacattgtggtaaatgtgtcattttgtgcaattctatgcagtacttgaagttgtttttaagtaaaatagacactaatgtctccctatctgtcttcacaagctacaatatgagactagagagtcttgtgtagggtaagatttgagagagtaatacagacatgcctgagagatgctgtgggtttgattccagaccaccacattaatatatatgatagtaaaatgagagtgaattttttggtttcccagtgcacagacaagttatgtttatattatactgtagtatattaattgttcagtagcattatgtctcaaataacaatgtacggccaggtgtggtggctcaacgcctgtaggcccagcactttgtgaggctgaggcaggaggattgcttgaggccaggagtttgagacaacctaggcagtctcaagctgcctagtgagtttgagacgtagtgagaccctgtctctacaaaagaaaatgttttaagtagctggttatgatggtgcatatctgtg

SEQ ID NO: 11008 - DNA, 1035 bp, Homo sapiens
aatctttttactggtgaaaggtcttgccttgatattgatggctgctgactgatcagggtggtggttactgaagattggggtggatgtggaaatttcttaagacaacaatgaagtttgctgcatcgatcaactctttctttcacgagaggtttctctgtagcatgtaatgctgtttggtagcaaattacccacagtagaacataatttgagtcagtcctcacaaaccctgccactgctttatcaactaaatttatatactgttctaaatcctttgttgtcatttcagcaatgttcacagcatcttcaccgagaatacattctatctcaataaaccattttctttgctcatccctgagaaggaactcctcattaattcaggttttatcatgagattgcagcagttcagtcacatcttcaggctccacttctaattctagttcttttgccatttgcacatctgcaatgacctcctccactgtaatcttgaagccctcaaagttatctacgaggattggaaacaatgtcttcaaaactgttaatgttcatattttaacctcctatgaatcacagatgttctcaatggcatctagaatggtgaatccttttcagaaggttttcagactactttgctcacttccatccagggaatcactgtggcagctataactgtacaaaatgtatttcttaagtaatagactagaaagtcaaaatgactccttgttccatgggctgtagaatggatgttgtgtcagcagcatgaaaacaacattcatctccttgtacatctccatcagacctcttgggtgaccattgtcagtgagcagtaatattttgaaagtgatctttttttttgagcagctggtttcaacactgagctcaaaacattcagtaaaccatgctgttaacagatgtactgtcatccaggctttgttgtttcatttatagagtacagacagagtagatttagcataattcttaaggacccttggattttcagaatggtcattgagcattggctttgacttaaagtcacca

SEQ ID NO: 11009 - DNA, 1030 bp, Homo sapiens
tattgctaaagaagaaagtccaaatatattagtaggtcgtaaaaggcccttcattacttttccattcttaatctccttgccatacccttgcacatcttttgaagacagatactatgtctttttttctgttttaaagcttggttaatgaacagtcagtacacgttggtagaattagttagtagaattagatccagccatgctgatccatttatagttctccaagcatgccaagtttttctcacctttctgcctttgcatgtgccattttccctgtctggaattcctttccttttttcattgcctgacatactcctacctatctttgaaattgaacacaaatgtcaccttttctaaaaagccttttcttatctcatcaagcagcttgaagtagatccttctttataatcccactttcctcctcatttatatctctattacaaacactactataacaacttttttattgtctgtttcttctgtgaactgtgagcctgaggaggtagggacttagtattgtgtattttagtagccctaacatcataacacaatactaattagtgcataggagttacctaatgtgtggctaatagaatcaatgaatgaatgcttgcaaggataattggaaataagaaaagtaggaaatcacttttgtttgagatagagaggggcctatggaagagccctcaagcttgacattgaaagactggttggattcagatagaaacaataaaaaggaagatgggggactttttagatatgaggaaaatggaaaatgagagtctgtacagtgtattttaaacatgtaaatgaactctgctgcatcggaggcgttaacgcatgtgattggtggaatataagacctggaccaaaaattggttttagactgtggaggattttgaaaatcaaattaacatatttgagctttattctgcatatagtgaggatgtgagatttgggggaggttttgtagttgttatttgtttgttttttagcagaacactgttttgatgaaagtgatgttttgggaaca

SEQ ID NO: 11010 - DNA, 1045 bp, Homo sapiens
cttaaagtttctgtgagttctgaatctgggcacaatttagttctagcttagactctagctaagagtctgtcactgtcaatctgttgcaatcaagactgcagtcaatggttggcctgggtttcagtcatctcaaagtttgactagggaggagtctgctttcaaactcactcagtgattgttgacagaattaatttccttgtggcccattgaaatgagggcattggccaggcacatcaaattttatcaattgagtactcagtacttgcctagtataactaaacccttaaaatataacatgttgattatgttttggaataaaggtcagattatcattggtcattacttgctagccttccggtaagtaccaagtcttacaagagtaatggatatattttcgccaagttgaggaacctccacttttctgttataatttttcttggaagtactttacttggattggtttgaagggcttcaccataactctgcttttcaggcttttaaaaatggaagtgattgttgctgactgaatttcccagggctgtatttcaccaactgcctgtaagatatggataggtttgtaggtgggagtttaaggaaggatttgtgaatctgacaaaagctgcttattgtatcctatagattcacaatgcacattaacatactttaagtgctcttagctaaaggaacctgtttaaacccatatttctcagagttaattggtatggaatccttttatggtacagtatctattaagattttgaagaacaaatattttgtgggccagttgtgggagaacaattctagtacaagataaaacttgctgtttcctcagtaactgttaaatgaccagtaaaggggaggtataaaaagttaatataaaagttatagagaattaagggaaaaatttgaggatgaaggagggacactagtaagttttttttaaaaaagagagtagatttaaaaagatgacttgtgagaagggctataaattgaaattgtggaattggatttggcacatgctacaaaattttataaaaatagaata

SEQ ID NO: 11011 - DNA, 1044 bp, Homo sapiens
atgttaatcagttcattttagccattccacaatgtatacctatttcttttcttttttttttttttttaaagacagggtctccctctgtcacccaggctggagcacggtggcacaatcgcggctcactatagcctcgacctcccaggctcaagtgatcctcctgcctcagcctcctatgtagctgggactgcaagcatgcaccaatatgtctgggataatttttgtttattattattattgtctttttggtagagatggggtttcactgtgttgcccaggctggtctcgaactcctgggcttaagtgatcctcccaccttcgcctcccaaagtgctgggattataggctgagcccctgtacctggacagacgtgtacatatacatatttcaaaacatgttgtataccataaatatatacaacatttatttgttgattaaaaaatagaaaatatatcactgctataatgcctttactaatcttatttttaaaattatttaactacctaaaccttatcttttctttaaactgtaaactttttaaatgaatagacataaaactaggctgttagtatatattatcctaattaagcttcagaataattatattaatatagggatccttatcctcattttacctgtgtgtcaaagtcactttgaatggacaaagctagaatttaggcaagatttaaggattcaaaggtcttctcttgttttcctaccctgcctattagaatatattttcactccttttgcttttctaatctggcaagcattcatagggcacattaagcattcattcattcttttctatttaaattgacggatagcattgtatgtttttgtcgtttacaacatactgttttgaagtatgtgtacattgtggaatggttaaacctagctaacaaatgcattacctcacatagttatcatttttataatattcaacatttaaacgtagaactttagagagatcatttgtctttgattctatattactttgtattgagaacatgagcattactattaatgctattaattgataat

SEQ ID NO: 11012 - DNA, 1049 bp, Homo sapiens
aatgctagcaaaccaaatccaacaacatatcaaaaagacagtgcaccatcattaagctggatttatcccagggatgtaaggatgcaaatcaataaatgtgatacatcacatcaacagaatgaaggacaaaaatatgatcatctcagttgtagatttgtcatacgtggcttttattgttttgaggtatgtttcttctatgcctaatttcttgaaaatttttatcaagaagaaatgttaaattttatcaaatgctttttttgcatcttttgagataatcatcataccaaataggggaaaaactgaaagcttttccttgaaaaactgaaataagatgaggacactcacttgcaccactctcattcaacattgtattggaagtcctagccaaaggaatcaagcaagagaaaggaataaaacttcagtaaagttgcaggatacatttcttaaaaaaaagacttacaaatggccaaaatatatatgaaaaattgctcaacatcactaatcatcaggaaaatgtaaatgagaaccacaatgagatatcatctcaccccagttagaatggctgttgtcagaaaggcagcaaaataacaaatgctggtaataatgtggataaaagggaactcatacactgttgatgggaaagtaagtaatatagccattatggaaaacggtatcccactactgggtatttatccaaaggagaggaaatagtatatcaaaggaatacctgtgccgtcaatgtgcattgcagcattattcacaatagccaagatatgaaattgactgaagtatccagtaacaggtgaatgaataaagttatatatatacatatatatatatatatgtatatataaaatgaaatactattcagccctaaaaggaatgaaaatgtgctatttttgtagcaatgtggttggaactggaggtcattatgttcaatgaaaacctaggcacagagtgagaaatatttcatgttctcactcgtatgtgggagccaaacttgttgatattttggaggtagagtagattggtggttaccagaggctagg

SEQ ID NO: 11013 - DNA, 1066 bp, Homo sapiens
cttggatctgtggtttggtatcttacgtaaaatttggagagtttttcacaatcacttcttccaatatttttctttcccctcttgttttttttgttttgtttgttttagagacagggtcttgcttcgctacccaggctggagtgcagtggtacaattatagctcactgcaaccttgaacacgtgagttcaagcaatcctcctgcctcagcctcccaagtagctgggactataggcatccaccaccacacccagacccctcttcttttcctggtactacatttacagtctggtctctgaatccatgggttctgcatccatagatttaaccaatcacagattgaaaatatttggggaaaaaagcaatttaaaaaacagtaaaaagtaataaaactaaaaaattaaaagaagacagtgcaacaactatttacttcacgttacactgtattaggtatactgtatttaaagtacacaggaggatgtttgtaggttatatgcaaatactatactgctataccattttatatgaggaacttgagcatgtggaaaatttgatatctttggagagtcctagaaccagtccccacagatactgagggatgactgaatatgtatattagatcatgggggtgttccacaggtcactgaagctcttttcagtatttttagaccttttttgttttctgtgtacttaattgtggatattttctattgttatgcattcatcttttctagttaagcaaatcttgtatattttctttatttgcagatacagatggtccccaagttatgataaacttagtttttttgactttactatggttttattgggggtattaaatgcattacgatgttttagacttactatgggtttattgggacataaccccatcataagtcaaggaacatctgtattacattttccagctcaagaaattttatttgattgtcctatattatccatttatttgctaattatgttcatatttttatatcactgaacatacttaatagttttttaatgtcattgttaattttcttgttatctttgttatttcactatcttatt

SEQ ID NO: 11014 - DNA, 1078 bp, Homo sapiens
cgagtgtataagatttgatcctaagaataaatttcaatgtgcagtatagagaactgatattttacagtatagtaggccaaagtggaatttggatatgtactctaatttcttagatattatacattccaggagtagcaggatcaaggtgagctcataggaagaatagtataataggaaaattaagttcggcaggatttagagtaatgtgatgaattagatattcataattacgatagctataagtgccccaataggcatattatttgtgattttggtcatgggaaattgacatgccaggaatagattattcatatattaccttatgattttctcaggtgatcatcaggacgcgtaagtataatacttctaatgtccttaagtgttggaaccaacaccacagaatcaacagcctaggagaagacacatgcacatatgtatacacacacttacaagcatgtatacctgcatttatgcacctttcctagtgtctcttagctcaattctgtttagctcaactgtaattatagtacagacatgtctaataaccagacttcagtccttgaactccttccactggctcattatgagtcatcattttttatattttaccacccttaacctttttttggagtgctttctctaccttggtttatactaaaaatacatatttcatctcacctacccttccatttcctatcctctcacctcctgctgtccccaagacacttaatctttctttatattttttgaatggaggatgctcgtgttctcaattgatcttaattctcactttgcaattaatacagaggctgtgtagaatgaatttcttcaattttttactccttcagttacaaacttattagcatctggactcattttcctttagcttctgctcatttcagaaagagatgctaatttcttctgaaacttactctgaatatcagtctttcccatctccatgttcccatatcttaaatctctttttatttactcactttttcctttcagctagaaatgcgtttaggtctcttatcctccctcgctagccccaaaccaaaaatttcattatccttaatct

SEQ ID NO: 11015 - DNA, 1035 bp, Homo sapiens
ttatttacaaatatatgattcagacttataatttataatatgactttatacttttcatgttttccttagttcctttgtataacataggggagaagaaaaggtaacatacatcatttttctacagatctcttcaacatgttagaaaataataggtgatttactcatttattcattgaccttgaaacttttagaatatgtcatagatgcaactttagaaagtatgtgtcttaagattaatagctagtacatttgtatacaaccaggttgcctctttcaggaaaaaagtataattcaaatttattattacaacagatatcttctttttttcttccccagaaaaattatggaaatccttttttgaatatgggactttaaattagttcagcttttgttcactgtattccaaaaattttatatatgccacttacagagttattaatcttttaaattagggagtgaagccataatttcagctgcgttctgcttccgtagctaaacggaaagatgctcaacttacgtgttgaactgtatgaccctgggccagttttttaaatcactttgagtctcagttttcttatctgtacctacctcacagaagaattaagtaagcagatattgtaaagtatttagttcagtgtcttgcccatgggaataacagaggttatattaactaaatcatccatattaattgttattattttaatgattgtgaggttaaacaaaatagttcatatgaatcctctaagacagtgcctggtatgatatgtgctccattatatattaggtttgttctcaaatgtgtatactttcatatgtttatacaccttttaaaaaggtattcattgtgttaatgggttcaatatccataaaaaaaagtatggcaaatagtgactaacttttaagaaatgatgtagctaatgtatttttttctttagcttccagagcagttgtagcgcagcatgttgctccacctccaggaatagtggaaatagatagtgagaagtttgcttgtcagtggtaagtggtttatttcta

SEQ ID NO: 11016 - DNA, 1059 bp, Homo sapiens
actatttccagaagccctgccctgttccactgttcatgaattggtatctgttggaaacatatttgctaaatggcatactaaaaataaaaaagaatttataaaatgaaagaaacttagatacaaaaacttaacataagacttggttttttttcaggatcatacaaaatacatgttgaacataatctgttagttatctgttaatcccataatctgataacatgccaaattcttatacataaaaatagtttaaggatatacatatttaagatatttaacatatgcctcgcctcaattcagagtgtaaatcattcctaataatggtactgtgtaacatggaatattggtatcttactggtaaagagcttgagaaagttactcaacccatcagaaaatagattggtagcctcaggcgggggcagcatttagttgtagccataaaagaacagtttagcaagagccacaagaatatcacttttgtttttctaagagtactgccactcagatttgtagaccaatagcacattataaaactaagaaaagtattacataacttttttgtttatattttaatgtgttcttataaagtagtgttggcatgtattgatgatctaaatttatacttaataagaggaaaaaacttggtaatttaagaaaatgaggaaatgttagagctgaagggtctctgatattatatcttggccaaaactcctacttttaagagttgaagtgaattgtccacattcacaaaaatctcttttccagtgatttctattactgtcttaattctcttctctgaagacttatacatttagctaaatgcatctctctctctctccctctctctctctcttttttttaatacagagcctcgctctgttgcctaggctggagtgcagtggcacactcttggctcactgcaacctctgcctcttgggcttaagcaatcctccttcttcagcctcccgagtggctggcactacaggtgcacactaccacacctgtctgatttttgtattttctgtagagaccaggttttgccatgttgcccaggctgatctc

SEQ ID NO: 11017 - DNA, 1025 bp, Homo sapiens
taaattttactttgtcatggcatatatttcttttttatgcattgtttgatacaatttgctaatatttttcctgaggatgttctcctctatattcatgcaagattctgggatgtagttttcttgtaatgtctttgtctgattttggtaatagggttatgctgtcctcatagaataagttagaaagtgttccctctgcttctattgtctggtagggagtagggattgtagagaatttatatcattccttcctttaattatttgttgtgaattcagcagagaaacctgtggtcctggtactttctgttttgaaggttattaattattgattcaatttctttaatagttacaatgttattcagattatctgttgctccttgagtgagttttggcagattgtgtctttcagggaattggccgatttcatctaagttatcaaatatgtgagcatagagatatttctgtttctttattagcatccttttaatgtccatgggattggtagtaatggtccctttttcatttctgatattaatgatttgtatcttctgttattttttcttggttaggttagctacaggtttatgtattttattgaattttttttcccccaaagaaccagcttttggttttgttaaatttttttctttctgttgatttcctgttttcagtttcattaatttctgctcttttattattttttttcttctgcctgctttgggtttaatgtgctcttctttgtctagtttcctaaggtagaagcttgcattattattttagatctttcttcttttttagtatataagttcaatgctaaagccttccctctaagtactacttttactatatccagaaattatgattatgttgtattttcattttcctctagttcgaaatattgcaaaaatgtgttatttagactccaaatgtttttggtattttctagctatctttttgttattgatttctctattaatctgttctcacactgctttaaggacatacccgagactgggtaacttataaag

SEQ ID NO: 11018 - DNA, 1066 bp, Homo sapiens
tttaaaaacattttaaaacaaagtccctgataattcacttttatattttactatgtaaaataagtgactgcttcacagaccggcgggttaatagcacttgatgtgggaaggtcaaagagcaaatacagaaatcttttcctgtaataattattaggaggaaaggaaaggagtcagaactgagggcagttggtttggatcatcccccatatgaaccccttcctatatttgggatatttcctacaatttcagtcttactaggaggcagggcccatctttgtacaaaagccccccaagaaggccaaatacttgcttcctcccctattgcctttggcagctacactagtcaatcagttgttcccacctatgacttttaatctggattgacggtagcacagaagctgagactggagaattcattcttgtaggaacagcaatattttgtttccaagaataccagtactgattttcagttttccagtttgtatttataatgtttcatcatgtattaaggaaataaattaatttctctttaatagtgtagttagtactttttttctattttgaacttttgcaactagataaaataaagttgggttagcctctcaccaaggttgttggtatattttttccccagaattttagcagcttgttactaagtcttatttgaatatataataatgcttgcccttgatatttcttttgtcatagaatatatatatctaaaacagatgccaagggttgaggtacaagttcatggttctgcaaccaataatagagccttttttaaaactaaaatatgtttgcagtatgaattttttggatgtatagtctcacatatacatttatgtgcatttattaacatttatgtgccatctttttaactagaatattcctgcaaaaaaaaaaaatcccttgcattttaagtcaggtgagtttgtttgtttgtttgtttcagtaggaaggctataaagaaggatatggaatactctttggccaccaaagaaaaatagcctgccaagaccttgagtaaataagaaaactccaaatgaaactatctgtattgtcc

SEQ ID NO: 11019 - DNA, 1047 bp, Homo sapiens
cctctgcctcctgggttcaagcgattctcctgcctcagcctcctgagtagctgggattagtagcctcccaagtagctcctgccaccacgcccagctaattttttgtatttttagtagagatggggtttcaccatgttggccaggctggtctcgaactcctgacctcgtgatccgcctgcctcagcctcccaaagcgttttgtaaatttttaaatcaatttttgtacaactaatttttcttttccagaaagatcttagaaatttcatactttattttaaaagttgttaaataaaattttaaagaaaatcataaagattttataaaacagaagtgtaaagttcagtgaattatcacaaactgaaccactcatataactatctgtccaagttaagaaatagagcaatatcagttgaaatctttcatgttctctccaatctttactccatcctcctctctataagggaccactatcctgatctgtgacaccagaggttcattttgcctgattttgaactttctatatgtgaaatcatacaatattattttcagcattatatttttgagattgattcatgttgttgcatgatagtattttattcatattattgtatttttttctctgcttttgatgggcaaatgggttatttccaatttggggctattaagagtaatgctgctataaacattctaaaccatattctgttttttggccatatacggaacatatttctgttgagtgttttcaaaggattggtgactcataagatgttaaaagtttgctacatgatgccaaccaattccaaaatgattttatcaattgacactctatagaaatgtatgagagtctcagctactccatgtacttgccaacatttggtattgtaattaaaatgtttaattttatccactcttttgagtgtgtgatggtatgtatatatggaaactacataaaactgaaatggcccaaaaaacatgaaaagatgcccaactgtttattcttcagtctcattttttgctcatttcttttcctttgctttactatagtaa

SEQ ID NO: 11020 - DNA, 1050 bp, Homo sapiens
gtaagagctcagtaaatagatgttaaaagaaggaagaaaggatggaaggaagggagaaaggatgatagcaaggagagaaggaaggaaggagggaagtaaggaagaagggaggaaggaaggatagatataagaatatttgtgtcattgacttctttttgctttgttttgggtgttgtgggactgctgctttcttgtctgtatggtctcaaaccaccctaaaggtttgtcaactccagtggaactttgggaatctcagacgattcacctctacctctcagattttactatgaatggcagtaaggattttcataaccgataaatacattctgtaaatgcatttccttacagaattcacaatggtacttctttaaatggtaagctctgattgcatatttgaagtgaatctatgtaaggtgtaaaatgagatgtactagtatattatgggtagcataaaatattagttattactggatctttaaaattctattggcaaagaaagatgaggactgatgccctgaaaagataaaatattatgtttttttcaggcatatgagtaatcaaaaagcatttcactggtttgtgaagaaatgggtattctttttaaatagtaaatagtcatatgcactaagccaatttttaaaataacatatattccctagagcatagaaaacatggcagctcttcccatagctggaagaatgtgtggttaccctggcaacaccattttagttcctgcttccaagtaccacctggtgatttaaagtcttaacagctgtgcagcatctacatttccattgaggaaataaaacgcattcatgcatcatctaatgcagaatttaagaagaaacgagcttgcaaatttggggaaggagggaaagaaatagcacacatgccagcaaagccgactgaggtttaaaaaccctagctgcagtcttggaagtattcctgaagcagctaagtccactgcattaaggatatgggattataggccgatttcccatcagaactctaatgtacacatagtctcagtagcctatgaacattttgtta

SEQ ID NO: 11021 - DNA, 1027 bp, Homo sapiens
gcagtatgtaaataaacacagtccccacaccatttaaagtattcagcactgacctaaacaggcctagacataaaatgccagtccagacagacgtttgtgaatatacacacataacacattgcaggaagaacttggtgcctttttccaaatattttattatgtacacatttcagattagaaacactttcagtgttcatagtctgagcaatggaaaacatttttaatcagtcctagacagcaggaaaacttcctgcaggagttctacaaggtttattcttcatttaacagatgtttgtttatagtagaaggcaggaagctgtatggtatgtctctagcttcaaagagcttaaaatgtggtagagacctttaggggagtttggtcatcagggaattaaagataactttcatacagctatgtgagaaaagtataaaatcataaagaacaaagaggaggccacagttatgattccaaaatgacaaactaaagaagaacgcccaggcaagaaccaagaaccaacaataccatgcaataattattctggtgtctcctatgttacagaatgtgttccaatgaactttgagaatctaatgaaagtaatgggcccagaatatccatatatcctcaaacatttgcacaaaatgtcagggattttatgtccttgacaatgtctgagtccatgggctttgtattttaaatcttttatagttacatttaccatggttaatgtgttacaactatttatactcctgtctcctccactagagtacaagcacttctagcacagcagtacattatgttgtatattttatccacacccctttctgttttgcattgtgcctgatgcatagaaggtagtaaaaatgctgaccactcacttgcctacctacctcagtgttcaggtgttaggttaatgcagcatcttccaaatatcagtcatttgagtaacaccctcacaatttttgcagtagttgcttaccacctgtattattttacaagataatggtttttggtgatagacagcattaa

SEQ ID NO: 11022 - DNA, 1036 bp, Homo sapiens
agcaatagaggtgtagaagcaagtcctgacttttgaactttggcagttttgatggataatgatatcatttatcgggcagggaacagtacaggatgacactgtttggaagaaaaggtcatgaatttgatttgggcaggttgaagttgaggagccttgaaggtatccacgtgttttctagtaggtagttttatatatagcttaggagctcaggaagaggttagggcagcagacagacagacatttgtgggtaattccaggagaggcggtaattgtgcccataggcatgggtgacagggtctagggagagaatctttgtattttcactgccccttcctatgctttcttctttctaatttgcttctgaggagtatgtgtcctttttctttgtcaggttaacccctctaactgccagcctgattcccttgacctttccccatcaattcttcccttgtcatttccatcttcattctataatcctctatcaaactccctaaagtccatttctgtgctgtgtacctactcatttttcactatcttgaatgctgacttttctattctcagccccactaaagtgtctttttcagaggcaactgttgacctatgcactggatccaagtgctcatctcaggctatgcgtctctggcttcttcttagcatttgattgttgcttctctcatttaagcatccccctctctgcttccctggcattcttttctcagttctcctttctctttacatacttctctttctacttctctatacatgtacgtgtcctccggaatgttttcttcttcctgcttctagacctacacttgctacctcagctatcttgttcaatcctgtggccttaaccatcactcccatgaggatagtactcatatgtatctttcttgccaggacccgagtacctcagacccgaatatccaactgatggctagacaccaatggcatctcaaactcagcatggcccataccaaatattttcttttcctctgaaacaagtcagtgttctacactgtcaatttcagttgagttc

SEQ ID NO: 11023 - DNA, 1092 bp, Homo sapiens
aggctgagagacagcctgggcaaagggcactgactgagaggtagcccggttgtattagtctgttctcacaatgctataaagaaatacctgagactgggtaatttataaagaaaagaggtttaattggcttatgattctgcaggctgtacaggaagcaaggcagcatctgctcagcttctgaggaggtgttgagaaacttacaatcatagcagaaggcaaaggggaagtgaggcgtcttacatggcaggagcaggaccatgagcatggagggggtgctacatgcttttaaacaaccagatctcactggaactccctattgtgatgacagcaccaaggggggatggtgttaaaccatgagaaaccgcccccgtgatccaatcacctcccactaggccccacctccaacactggggattacaattgaacatgagatttgagtggagacacagagccaaaccatatccctgagcaaaggttgcgggcgtaacaaagagtttgcatgggggttgaggctgaaactcaggccgaaacactgtggaagaccctcttctttagggatttaggacttgattctgtaagcaatagggaggttctaaccaaggaaggggcctgaccacatttgtattattgagagatggccttggtcaccgtgaaatctatggattggtgggagggagtgcatagagagtgatcacaggggcaatggtgcacagttttgaccatctcgtgtctctggcatgtcctagtgcttgagagtaccctacaaagaggactgtgtagaagctgtgtctctatagcttgcaagaacctcaagcagatattttcttgtgtctgcatttcagatgtttgttttttaaactataactcaaagccaggaagacctattagcatcagggaatgcaatgatctaagtcttggataatttagataggattatgcataagtgctattatttgtatattcctattgaacattttcaggatattattaactcatttgaacagcccatcaacacaagaactaagaataaggtaaaattttgttaaactccagtcaaaagtaattgctatcctattactgaatcataatgtt

SEQ ID NO: 11024 - DNA, 1051 bp, Homo sapiens
tagaccacactccccactattacggcatatttatgatataattaactttcagaaagccatatggctttcattacaaagactaaaggaatgtgcttttcataacaaatggcatatggcctccaatagctctttgcttgcatgttttaacaaaatgaacatgtacatgaattagatgcctcaggtcagttaacaaactgaagttgattttcttttgctctccctaattacagctgcatttctgacaaatatcaaggagttttttggcagcctgtaggtgcaaaatacatagcacctttttctcttatggcattgctcctttaaagagtcaacatttttctcttattcacagtggagtgtgccgtttgtggaaatggagtatttttgatgaagctgcatgctttcagaatggtggaaaatttaattgacttaaatgatacaaaaggcaaaggaaaaaactaaatgaaaatcattgagacaaaagttgacatttatctttggtcacttacatgatgcagaggagagagtacatgatagatgctcacatgctgaactaatttaacagcagttaagcgtgagggctcactcttaatctcttagagttatttagaagcctttctattttaggtaacatgccttaaagttctgctcccttagttcgcactgtgcctcatcctattgtttatttagcaggttttttaatagagtctgagaatgagcttcttgcaactttcacattatcatattacaacattcaccactgattatctgtactcaaggtcaatgacattatctcattggaattccctggactctggatttataataagatagtccaaaatgctcttgtctgtgatggaaaaatacaacacaattactgtaagtcagttggttcttaaagtgtttgagtttcaaatttggctactcatcatattggcaaattgcttacttttcttttaaatgcttgtacttatatgacaccaataaaattttcttgattaatgaagtggaaatatatctactataaaaggaaatttaaaacatatatatttct

SEQ ID NO: 11025 - DNA, 1035 bp, Homo sapiens
aaaaaaagttctactatttaaaaaaactatttcttcccctttgtttactcctgaaacttttattaatcaggtattggacctcttgatccatattgctaagcttttctgtttatgttcgatctgttcatcttactgctcgatgttcaggaatatttcctcaatgtcacatccaaaataacaaatttcaccttcagctatatccgtttcatttttcaacttgtcagctatttttctcaatcatgctcttaatttctaataatttgctcttatcctctttctcttttttcatatcactttttttgttttatggatactatattttctcagatttttctaaggatattgatgtgaggttttcagaagttccttttgttccctaaattatacgtttcttctgaagttagttattctgtttgttccctttggtccttctcttccatgctgctcattttccttagtttcaagtgttcctaggttatctgttcatatttgtgaatgacagagcgcatcgattagcttggacagctggtactcagagcttctctgaaattgtgtgggcccatttcactgatgggctgctcccttgtaggttctgtgtaagtggctcttctgctgcttgtctgtgggaggagcatcccactcccagacacagctgccactctaggagcagttactccgggggtgaagcattttaatgtatcttctttttggtagagcttccattcctgtttgttatacctctttgtctgcagtagaggccctaatgcttatcctagcatcctcccttgaggtttctttacagattggatcacagctttatcttatagtcaaaaatggtatcccaaacagaccatgatgtctaaactgaggttccttggtggatacctgatcactggttgcccatgatctatgcctcctctttgtctttatcgacttaacttgaagctactgcagggctccctatgggaaaagcacacttatcttggttccttttctcttagattttccaaccctatcttctttctgccttctagg

SEQ ID NO: 11026 - DNA, 1027 bp, Homo sapiens
tttatgattaatgctttttcatttgcttattttctatttaacaaaggattgctgactccaaggtcatgaagatgttctactctagaagttttattgtttcatctttcaattatttctgcaatctgtctggtattgactcttgtgtgtaatgtgaaataaacattagaatacctttttttccacttgaatgttgaattgacacagcacaatttatctgaaagattatccttttccctactgcattgcaggatcacctttatcataaatcatgccaccatatatgtgcaggtctacttctggattccctgttgtgtttcattggacagttatctgttcttgcactagtaccacacagttttgattgtcataactttataataatagtttctgatatctcacagtgtaagtcctgtatatttattcttcaagaataacttgatgatttccaacttttacatttgatatgaattttaggaaaacttgtcaatttctggaaaaagaagaacctgtagcttagattttgaccaaaattgcatagatgaatgtattaatttggagagaactaacatctttacaatattgagtcttccaattataatgatgcatatacttccatttatttagctctcctttaatttttctcaataatattttagttttcagttagagatcttgcacatctttaattagatttatttctaggtgtttgagttttttgatgctattgtaaatatgttttattttctatttgtttattgccaatatatacaaatgcaactagtttttatatgttgactgtatatccggttcccttcctatattctcttattaattctaagaatttgtccttagattctctagaaattttgaatgtgcatgatcttattgtctggaaatgacaattttatttcttgctttccaatctccatgacatttatttctttctctgaccttttgcattggctagacctccttctacaatgttagactgaaatgatgacagtggtcattcttgacccagttccag

SEQ ID NO: 11027 - DNA, 1050 bp, Homo sapiens
caaaaacttagagacagttgatttcactcaaggaccagagaggatccgtgctcacttgagcctctggtaacaggcccaccaactgcagacctcacactggacccagcagcagtcacattgcccaactccaaccccactcaactgcaatcctggtggcaattccatcagcccatggacctaacaagaggtctttacctgctgaaatcaatctataaatactggaaaaggtgtttgctccttcaaatgcacagacaccaatgcaaagctacacaaatcatgaagaatcaggcaaacatgacaccaaaggaaactaataaagctccagtaaccaacccccaagaattggatatctatgaattgcctgacaaattattcaaaattattatcttaaaaaagctcaatgagatgcaagagaacacaaacaaatgcaatcatggaaacaatccataaacaaaatgagaagtgtaataaagaaataaaaaacatagaaaagaaccaaacaaaatcttagagctgaggaatataatgacagaatgaaaaaaaatcagtagagagcttcaacaacagacttgatcgcgcagaagaaaaaaatcagcaaatcaaaaacagattatttgaaattagccaattagaggaaccaaaacaaaagaagaaattaaaagaattaagaaagcataataaagaagccatgcgatactatcaagcaaatgaatttacaaattatggtaacagaagaagagagaaagaggcaaaaaactaattttaagaaattcatacacaaatcaatacatgtgatacatgatgttaacaaaaataaaaataaaaactgtatgatcatttcaatagaagcagaaatgcattgacaaaattcaacatcctttatgatgaaactctcaacttattaggtatagaaacaatttacctcaacataatagaggtcatatatgataagcccacagctaacatcatacccagctgtgaaacactgaaagctttacctctaagatcaggaacaaggcaaggatggacacccatccttgccaattctat

SEQ ID NO: 11028 - DNA, 1088 bp, Homo sapiens
gagcaagtaaatgagttggtggctttgatcccacacagtgatcagagattgcgccctcagcgaacgtgagttacctgcttctcacctgttaatacctacttctgtccctaatctctttctgtatgtatgaatgccagttaattctttgaaaactacacatgttcttataagttccccattttccttataactgtttgcccaagcaagatatctctgcccccatcacaatctggggaaagaaacttgaagctggaaatgctttgaaggtcaaggaatggaatcagaagaaactgggaaagtggagtgttctgggaggtgtgggactgtctctgtccacatagctcctttcttcagcttttcttcccagagtgcaaacagtgtttaaaggagttttaaaaggtttctcctgcttcactgcttcttaactggtttatggttcctggctcttggaacttccctttcagctcccttctctttcctggttttgtgtttaatcttgacacattgaaccttgatatctgactgcctgggtcggtcatgtgctgtgtcatttgcagtaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggtaagccttagggtttcattccctgggttgtgcacctgccaggctgggacccaggacacttacacttgtttcctgacttgccctgatgtaggccaccctgaaaatcaggaactccaacttctacacggtggcagtgaccagcctgtccagccagattcagtacatgaacacagtggtcagtacatatgtgactactaacgtctcccttattccacctcggagtgagcaactggtatgctgttcttttaggaatcttgccccacaggcctaagagaagagtagggggctgtaggaatgccatagctgtgtcactttcctttttgtctcctcatttctacttgtaggaactggtgatgaggaagacctgttgg

SEQ ID NO: 11029 - DNA, 1048 bp, Homo sapiens
gcagtctcggtctcctgggcttcagcgatcctctcacctcagcctcctgagtagctaggaccacaagtgtatgccaccacaccctgctaatttttaaattttttgtagagatgaggtcttgccacgttgttcaggctggtcttgagctcctgagctgaagtgattgtcccacttcagcctcccaacatgctgggattataggtatgcgccactgctcctggccttattcattttcaaatgttgaaccagccttgtatacctgggataaattccacttggtcttggtatataattctttttatccagtgttggatttgattttctgatatttaattaaggatttttgcatctatgtccatgcaaatattggtctgtagttttcttttttcttttttttttttttgtagtatctgtctggttttggtattacggtaacactgatctcatagaatgagttagggaataatccctctgcttctttcttcttaaagagatggtataaaattgggataatgtttcccctaaaagtttggtagaattcaaattagctaggcatggtggcatacgcctgtaatcccagctactcaggaggttgaggcaggagaatcacttgaacccagaaggcagaggttgcagtgagccaagattgcaccactgcactccgggctggggaacagagcaagactccatctcaaaataaataaataaatgtttggtagaattcatcagttaacccatctgggcctggtgctttctgtttgggaaggttattaattattgattcaattattattattattatttgagacggagtctcgctctgtcacccaggctggagtgcagtggcgcgatctcagctcactgcaacctctgcctcctgggttcaagcaattctcctgcctcagccacccgagtagctgggactacaggtgcgtgccaccatgcccagctaattttttgtatatttagtagagatggggtttcaccgtgttagccaggatggtctcgatctcctgacctcatgatctgcccacctcagcctcccaaa

SEQ ID NO: 11030 - DNA, 1072 bp, Homo sapiens
ctgaaccccagagcactctaacttataaaaattaggaacaggatctagtagtgtaaagtaaaaggagcagacagtgatgttggaagttaataatggcctgggtgcagtggttcacacctataataccagcacttggggaggccaaggtgggaggattgcttgagcccaggagttagagaccagctctggcaacacagggagatcccttctttacaacaaatacaaaaattagccaggcgtggtggtgtgcacctgtagtaccgattacttgggaggctgacataggagcccacgaggtgaaggctgcagtaagttgtgatcgcgccactgcattccagcctgggtaacagagcaagaccgtgtttccaaaaaaatagaagaaagaaaataatgaagagtttagtattctggaaaccaaatgaagaaagtgtttcaagcaggagcaggtgataactctgctttttgaactgtgctttctgggaggctgggtaacatggggtctgagaatcagctgttagatttcactggtgacctgggcaagagtggcttcagtggagcagtaaggatgaattaaggccttattggtgtaagttcaagagatgattcatgacaaggaagtggaggaaggagaatttaaaaacttttttgaggatttttgctttaaggggttagaaagaagagtaataaccaggagagctggatagggatgttcaataaaaggcggggttttctttttgtttttgtttctaaggtgggagctattttagaatatttgtttgctaatgagaaaaaaaaaacaaaaggtaaaatccatgttgtggggaaaaggagcaaagctttagagtagtgaaatggaaaggcacccagtgcaccatggaggggttcaccttggaaaggagcacagtattcacctgctgacacacaggaggaagccagaattcgaggagcgattaatcggttggcagttagatttagtggtggaatctgtggaatttctcttctgattatttctgtttttctcctctactgcagtgaactagaaaatgggtaatttcagccagggatggtggca

SEQ ID NO: 11031 - DNA, 1151 bp, Homo sapiens
agtactaaggagattgcccccttgggaactccgtgtagctcctggcttttgtgattgcaatagcatcagtaaaagcctgacactgtggaaagacacaaacatgcaaggacctgcttatctctaaccttgcaccactcactgaggcaggagaatagggactagaggcagggaacctaaggacttcctagaactaaatcaaatgaaaatgaaaacacttcagctatgacaaaaaatatcctcctcatttacatagggcgtacaccaagtaaccagtgggaacctctagaggggatgtaaaccccagaaaattcttttttcttcctttctttctttttttttttttttttttgagacagagtctcactctgacacccaggctggagtgcaatggtgcgatctcagttcactgcaccctccgcctcctgggttcaagagattctcctgcctcagcctcctgagtagccggggttacaggcacccaccacgggccatgcctggctaatttttgtattttttagtagagacagggtttctctgtgttggtgaggctggccttgaattcccaacctcaggtgatctgcccaccttggcctcccaaagtgctgggattacaggcatgagccaccacaccctaaacccaggaaaattctgtaactgagcccttgagcccctatgtttggcctgctcccaccctgtggagtgtactttcattttcaacaaatctctgcttttgttgcttcattctttccttactttgtacattttgtccaaatctttgtttaagacaccagggacctggacaccctccactggtaacatcatgacatgtatgcaaaaattgtccgcaaaatttacatataaacgattagaatttaagaattcccaaaaccccctttagacagggtttcaccacgttggcaaggctggtcttgaactcctgacctcaggtgatccgtccaccttggcttcccaaagtgctgggattacaggtgtgagccaccatacctggcagggaacttcattatttaaaggagaaagagcaagcaggagggggaaaacgggaggtagggtaggtagtgaggcgaattgttacattcttgtgaggctctgattagcctcagtaaattgacattttacatgtgaaaagggga

SEQ ID NO: 11032 - DNA, 1025 bp, Homo sapiens
ctctcaccatgttgtccaggatggtctcgatctcttgacctcgtgatctgccctccttggcctcccgaagttctgggattacaggcatgaaccgctgcacccagcctaatttttttttttaatagagatggggtcttcctatgttgcccaggctggtctcgaactcctagcctcaagcattccacccacctcagcctcccaaagtgctgggattacaggcgtgagccaccatgcccagccccaagttttttatattagacatgcaatgatcattcaatattaggaaatcttttaaaataactcattatagtatgttgagggggaaaagtcatatgttaatctccaaatattgctgaaaagacattccataaaattcaacatctattctgattaaaaattttaatagtatagaaataatgtaaatattctcatgttgagatactttccatatattgagaaaaaaatttatttatatatttatttagagacaaggtcttgctctgttgcccaggctggagtgcagtggtgcaatcatggctcactgcagcctcaacctccccggctcaagcgatcctcccacttcaacctcccgaagtgatgggattgtaggctcacacctgtaatcccatgcctggcccagaaaaaacttataaaacatgtgtctcaaggccaaaaactacgttccaattaaagatataataagggataggatgagcaccatagccagcattatttgttgttttatttttaaatatgaaggaaataatgtacacatgagaaataaaacttataatggtctcaggataaaataactttttgcagttaattttttttacattttagttattccaccattcttttttttttttttcttgagatggaggctcgctctgtcacccaggctggattgcagtggcgcgacctcggctcactgcaacctctgcctcccaggttccagcgattctcctgcctcagcctccagagtagctgggattacaggcacatgccaccatgcccggctaatt

SEQ ID NO: 11033 - DNA, 1067 bp, Homo sapiens
gctggtggtatagtatgagaatagaattctccaactgtaacccataatttcaagtcatgtcactgaatgggaacaagatagatttggggacttttagggatatttagcaggttgatttaccaggtttgggaacagatttaataaattaaaaacagggtcgtgcatggtggctcacgcctgtaatcccagcactttggaggccaaggtgggtggaccacctgaggtcaggggtttgagatcagcctggtcaacatggtgaaaccctgtctctactaaaaatacaaaaattagctgggcgtggtggcaagtgcctgtaaccccagctactcaagaggctgaggcaggagaattgcttgaacctgagaggtggaggttgcagtgagccaagatcacgctactgcactccagcctgggtgacagagcaagactctgtctcaaaaaaaaaaaaaataattaaaaacagtaggctgggtgaggtggctcatgcctgtaatctcagcactttgggaggctgagacaaaaggattgcttgagcccaggagttcgagaccaacctgggcagcatatcaagacccccatctctaccaaaaagaaaaaaattaactgggcgtggtggtgcacgcctattgtcccagctacttaggaggctgaggtgggaggatcgcttgagcccaggaggtctaggttgccatgagctgtgatggtgccactgcactccagcctgggtgacagagtgagactctgtctcaaaaataataataataggccaggcgctgtggctcatgcctgtaatcccagcactttgggaggccgaggcgggtggattgcctgagctcaggaattcaagaccaacctggacaacaaggtgaaatcccatctctactaaaatataaaaaactagccgggcgtggctgcgtgcgcctgtagtcccagctactcaggaggctgaggcaggagaattacttgaacccaggaggtggaggttgtagtgagccaagatcgcaccactgcactccagcatgggtgacagagcgagactccatctccaagaaaatataataataata

SEQ ID NO: 11034 - DNA, 1050 bp, Homo sapiens
ttggcgcccctggcggaggcggttagcagaggtgtctcccccgccggtggtggggctaaacgctactggcttcacggccacacctccgctgcctccgtctggttcagcgtctgctaactgaggaggcagattaggggcgcggagtctcttcccttgggtgcataggtcccggttggtagaggctttgagtcctcatcgccacagctgacggctgcgagggactaagagcaggatatatctttagaaatgagttgcacaattgagaaggcacttgctgatgctaaaactcttgttgaaagattaagagatcacgacgatgcagcagaaactctgattgagcaaaccacagctctcaataagcgagtagaagccacgaagcagtatcagaaagaaattcaagagcttaatgaagtcgcaagaacatcggccacggtccacgttagttatgggaatccagcaagaaaacagacaaatcagagaattgcaacaagaaagaaaagaattgcgtacatccctggaagaacatcagtcggccttggaacttacgatgagcaagtatcgagaacaaatggttagattgctaatggctagcaaaaaagatgatccgggaaaaataatgaagttaacaaaagcagcactccaaggatacaggcacatgttgaccagataaatgaaatatggcagcagtaatgaagaaagccattgaaattgacaagcaacaggattgcaaggaacaagaactaatatttcaacttgaacaagaaaacaaaggcgttagagagatcctataaataactcgagaatcacttttgaacctaaggaaagaagatgtgtcggaaagtacttctttgtcagcattagtgaccaacagtgacttgagtctgaggaagagctgaagagcttctgagtctgtgagcttcttacatggctcccagtggtcaaataagtgaatgaatgaatgaacagaaaattcaatccattatttttttctctttaaatatgtacagtgtactggctatgagatagcaacaaaaacgcatagttaatggt

SEQ ID NO: 11035 - DNA, 1021 bp, Homo sapiens
aaattcatccttgttgtatcatcagtagctcctttttcattgctgtatcatattcttttttttgagacagagtctcgctgtcacccaggctggagtgcagtggcgccatcttggctcactgcaagctccgcctcccgggtacacgccattctcctgcctcagcctcccgagtagctgggactacaggcgcccgccacctcgcccagctaattttttgtatttttagtacagacggggtttcactgtgttagccaggatggtctcgatctcctgacctcgtgatcctcccgcctcggcctcccaaagtgctgggattacaggcgtgagccaccgtgcccagcctgtatcatattctattctgtgaatgtgttacaatttatccattctgtagttgattgatgtttaggtttgtttctggtttttggacttacagataatgctgctgtaaacattcttgtacatgtcttttagtacacattataaatgcatttgtgttgggtattacttaggagtggactgctgggtcatagggtgtgcttatgttcagttttagtagattttgctaaacagatttttatactcccactagcaatatgtaagaatcagttacttcacatcctcctatggcaaacaataaagttttttaaaaggtgaggctggtctcattcctgggctcaagcaatctgcctgcctcagcctcccaaagtaaacttttcaaaaaatagttatcaaatatatatgtgtgtctaaataatatattgttttagcattagttgtattttttattaaaaaagaatcttatgttgtatgtaatctggaattttctacttaacattatattgctaagattaatccatatcattgcatatagttgacacatttttgcagcagtacagacatttagtgaatacatcacagtttattctcttgttaatggcatttgggttgtttccattttcttaactgttatgaatactacgtgttttctaatgtaccatgagcaagaatttctcttgtactt

SEQ ID NO: 11036 - DNA, 1051 bp, Homo sapiens
gagccaccgtgcccagctggtgttaacagatgtttaaattctagctcctttgtgggaggtattttataagggattttttgaaactagaaaagacttaaggaccatattaaaatgacaggaagacaagcagctagggtgatgttttgagacttagaacttgttcattatacttatttttagtaactgtctagatctgaaatatgacaggaagtgttcatgaaaagaacaaaccatacatgctttcttgctgcctgtagactgttccctcaggttatacctaactgtgtctctgttcacaaatttagtctagtcacttttgccacaacatataagagatagaggagagtgtaggtcccctcagtcctcctggtctctggaattgcagaggagtagttaatcaaaatgaaataatgcctccaaaaagttaaatcatcagaaccaaaacttactttggggctagataattcatcttagtctacccatgccttgtcctgaactctaagttttacttttcaggttttatggctaggaatttaatgtcatgtcttctgtttttctttgtttgtttgagacagggtctggctctgtcacccaggctggagtgcggtggcacggtcatggctcactgcaacctccacctcctgggctcaagccatcctcccaccctcagcctccctagtcccctagctgggactacaagcatgtgccaccacacctggctaattttttaattttttgtagagatgaggtttcaccatattgcccaggctggtctccaattcctgggcccaagcaatcctctcatctaggcctcccaaagtgctgggattacagccataagccactgcgcctggctgtcttctgtttttcttgacacatatttttgctcctgccagattactcattgtctcaaaacttaacattcacatttcctcttccatctactagttaatgccactttcccagcctgaaaatgttctcctattcctctgtatttatctaaatcccaccatttctccaaactttccttaaattaaggtctaacttctgg

SEQ ID NO: 11037 - DNA, 1029 bp, Homo sapiens
agtctgtttattaacatcatgcgtaacgattatcaaacctatgttctctggcacttccctataaaagatttgctccttgaggaaatgaccctgccttagacatttttgtatgtctcacactatagtctccacattaactactttgtgctaacataactatgtattgagctaaattgaattagagcgagagagaaagagtgtgtgtgtgtgtgtgtgtgtgtgtttgagtgtgattacaaccagaaacaagagtggaacttttatttaccctgtagttatattccccttcaaaaggagaaatcagaatgaactccaaatttgaagaaagttggaacattgcatgtttgtgcaagtattaacattctagatttttttttctttttgccaccacaaagcaaaaccgatatggtaaggaaaattattttcatccagaggttgaatactagggtactactgtctccttatacattgaaggctgtgggctcttttataacaacatggaaaagctttatgtgcctataaaccatttatatttgcagtggaaaaaattctaattgcctatttaatgttctttttctgtaaaaagcctaccagaaatctgtaattccatccttcctagttactattatgtgtttctcagaaactagcacactatatgtctatcttttgactactttgcattctaagtactaaaatgtaagtggacttggtgcaaccatggtcagctgttgaagacatacaagtcctaatcatggataaatttactatgccctagtggggatattgcttggtaaaaattaattagatgcaaggccatcaaattttatagaccaaaatataaatataaaaagtatgagtacaggccgggcgcggtggctcacacctgtaatcccagcactttgggaggccgaggcgggcggatcacgaggtcaggagatcgagaccattctggctgacacggtgaaaccccatctctactaaaaatacaaaaaaaatagacgagcgtggtggcgggcgcctgtagtccaa

SEQ ID NO: 11038 - DNA, 1030 bp, Homo sapiens
ggtctccatgcctttgcgcatgcgtaacacttcgagccagattctaacccggtccggcccacgcatgcgcagcttttcggggcgccactggggcggggccccaaacttggggggtggtcgtccccggcggcactctgcaaaactccatttcatccccaactcctctgagaaccctcagaggcgaaccgcgaggtctcaccattcctagactgccagatccaacaatttctccgcggcgacggtagcagccgcagggccaaagccggcttccgtgaggtacgtctacttccggttaacgaaccagggggctggcaatctcttccggttcgtcttggcaacgtgtgtgaagggggcgtggccatggtacggaaagtgtaaatattttaccaatagcggaaagtaaaggctttcctagttgggacagcatatagggaaacgttaaggattataggcaccggagaggtaacccggcttgaggggttggttaaagggaaaggcgagacttagggcgagaccgagcggggctaattgaggcgacccggggaggggcgggaccgcggactggatttcgacttccaaattcccacgaggtataggagtctgagggttgcacaggaccttatgcattgtttgactcctccagagcctttagagaaacttctatcaggcccgcctgctaggcactagtcggggagataatgtagccagggagatgtggcggacagaaagggcagagaggctctctgaggagcggatggaggatcgtgggccgctttactgagaaggaagagaccctgcgagaaggagtagtgtcgacttggtcccgtcagccggaccccacctggacggctggggccacttgtggtcgccgggaggtaagagagaaaaccaatggaagcaccttcagaggagagtgccttggaaggaatcttggggtgggagaacgaacctgtcggaaaaattgggaatttggggctgtgagagatgttccggaaaactagaaagactgttgtctaaaagaggaattctg

SEQ ID NO: 11039 - DNA, 1027 bp, Homo sapiens
taaaaagtaaaatccagaggacactagcacacgcataaacattttgatcaggagaacataataggctgggcgtggtggttcatgcctgtaatcccagcactttgggaggccaagttgggcagatcacctgaggccaagagttcgagactagcctggaaaacatggtgaaaccctgtccctactaaaaaaatacaaaaattagcctggcatggtggtgtgcacctgtaatcccagctactcagaaggctgaggcaggagaatcgcttgaacctgggaggcagaggttgcagtgagccgagatggcgccactgccctccaccctgggtgatagactgagactccatttcaaaaaaaaacaaagagaacataatagtccagaagtagacctgaggcattaaaaagttcagtaaatgataaagatggcattgtctgtcagtagggaaaagatggatgatatactaagtagcactgagacaattgtgtagtcacctggagaaaaataatgtagtgtctcttttcagttcttacactaaaataaatccatatgaaacaattatgtttaaataaatgtaagaggccaggcttggtggctcatgcctgtaaccccagcactttgggaggccgaggcaggcagatcactcgaggtcaggagtttgagaccagcctggtcaacatagtgaaatcccgtctctactaaacatacaataaattagccaggcgtgttggcaggcacctgtaatcccagctactcgggaggctgaggcaggagaattgcttgaacttgggagacagaggttgcagtgagctgagattgtgcaactgcactccagcctggatgacagagtgagactccatttccgaataaaaaaaaaaaatgtaaaagagtaaaaccacaaatttataatgtcacagtagagaaagtgttttctagaatggcacacattttctcatagctttaaaaaaagacaaattctgtcaacataaaaatctataatttctacagagtgaaaaacaccataaacaaaga

SEQ ID NO: 11040 - DNA, 1036 bp, Homo sapiens
catttagtgtgagggcattttaagatgttaagtatcattggggtgaggcctccagaaaagaaagagcctgggacccgagaggctggaaacagcccagggccagcacagctgtgctgtgcatgtgtcctgcatcatgatgccaactccccttcctcccacactaggcatcctcgcgatatcttaagctgcgactcagaaaacaaatcctactcctggcatcatccacagaaccagctgttcacaccccacatcctcctcagctttctggagtctcagccttaggctggaagcaaggatgggcgccattcctgaggaagagaaccgctggacatgggttctctgaggatggggtaatttcctatttgtatgcctgttccctaggccaagggtgctggtgagtggagaaggacagggtgggggagactcagcagggaccaggcaagcagctgtgtgtcaagaggagggtgtgtaggtgctcgtgagctgattgaactaaccgaattagtgtcttaactgaactgacagacgcttgccagagacggcctccttagcccacaccgtctatatttgaacctcatgtctccatgtcttccacctttgtcctcagagacacgctcacctttgcctcccaccttatgacacctggctctggtctgtatttggtatctccttttgttctcaccttctgagctttcatgcagatcactggcatgtcagtgacatatctgtccatattttgattaaatgaagagttacacctactaagtgccaggtgccaatcacagctatctcggcatgtttgctcccaaaggacacagacaacactcagagggttctaaaactgagttgaggaggtgtgggtttcagcaatgagacagaattttaaaataaaccaacctctattttattaaaatgtagagtttggggactgcaggagggaagcagtgtttctcaaagttctaggagtactcagcaacccccagagggtttctttaaaagcaccagctgggaacctgcattttgaccaagttctctg

SEQ ID NO: 11041 - DNA, 1057 bp, Homo sapiens
ctgagctggcacaagagagagcaaaagcacaagagagagcaaacctaccaagggctaagggcttggggtgggcaggaaatcgggcttgaagaccctcctgaattttgtgctcctttttcatcctcaccacttctgcttcccttctgcaaaaagcccatctctgtgcccatcctgggtcctatgacttttctctccctcaacagtcggttcccgattctggtccccggcccccagcagcgcctgcccccttcccaccggggccccccatgatgccaccacccttcgtaagttttatgtctttccctgggcttggcttttccagcctgcacccccaactccccagcccctagccactgctgcatcaccagcacagttttcctgtaatgccccttttgctgaccttggaagagggatggttttacttgagcattgggttggggagagctgttgtgaagccctcagtacataacattgacaattccccctttgtctttttgaccttaggacacactggggctagaggtaggagaagtggaagggaaaagaccccattaatgtgagggcagggtgggactatctatctctttcactactccttacctatgctctttaaatatgccacagaattcgggctggaatggcattggtggtcatgagttggagagaaagggatgggaggcaggggactggggtacttgggtacctggatacctgccttctgccccttcatctgagaggcctctttgggggagaattgctgaagaggtggagccttccagtctcagtctggtgctgttaaacctcccttattcctttcctttcccgttacaattaagaagctgtgtgcttgcctgttagaccccagttgtcagtctttctcagtggtgaggagggaggcagtttcatgccttgtgcttctcaaactaaagccttggaattgcctcagagcagggtggagggttggggagggaggtggtggatatttcctgacaggtcctctctacctctgacaaggcgatgtcttccctgctcagtatctcttcctttactcatttcc

SEQ ID NO: 11042 - DNA, 1050 bp, Homo sapiens
tcatgttatggcttctaataactgaattcacaagagctgaatacttgcttatttattcttatacaattaatgatcccctcttaagaactaccattgcagtggctgctcccacagagccccctccaggcccttcccccaccaccctgggtatccctagcacctgtaggacagcatcgttgaaacattaggggtgctggggtctgagagggtatcctgctgggacaatgcccgcggaacctcctgcctgtctttagacatggacaaggaagatgcactgatctgttttgaggagcacatccgagctttggagagggaagaggaggaggaacgggagcgggcccggcttcgggagcgacgccaacaacgcaagaatcgggaggccttccaggtatctttgctgtcctttctagatcagagctcagctctgccctagagcacaacctcttcacccattccctgcccccttctggatacgctgcctgttctttctgtgcctagccctgtccaagctctatgagacctctctctgcctgcagtctgtttctgctgtacctcctcaattctggactgtgctcttctagggagactagatgtatgcaccacccagaaactgccagtagagagcaccctacaggcatgacttggcagctaggccatgtttatttcccttggtggggcacccgacaggcagagtttattccctcagcttgggggtggcagtggtggtggtagtgctaggggttactgcaggcaggtttctgtttctttgcatcccgggactggcttgttctcacctttttgttctgtccctctctgtgtatttactttctctctttttgcattgttctcagccttccatctgcatctcttcatctctgcctctcttgcctgcatttcctcaatcttgattgtccctgcctcttcctctgccattccctctcttccccctcagtctgtggctctgcctccctgtctcactctccctataactggcctctccctgctcagaccttcctggacgagctgcatgagacagggcagctgcactct

SEQ ID NO: 11043 - DNA, 1044 bp, Homo sapiens
ctcctgacctcaggtgatccgcccacctcagcctctcagaagtgctgggattataggcctcagtgagccactatgcccagccaagggaattctttagcatcttgaaacaatgacataaaattgctttatgtgccaatgtctaggttcctttaactagattgttaattgagaatttcttttataaacttactgccttttaaagtggcaaatcacctgaaagaatagaaatcagatgatagtaacaaaatagtttgagggagaagaagatgcattcaattcctctgtcgtctttaagatggttgactatgattgcaaatatattgtaggacacataaaaataaaaatggttgtgttagggctgtagaattttaggcaagttttcatctttctgaacttacatgttgcttttttttttttttataagctgttcgtgtgattctgtatgacttaatgactctaacctttctttattctgcagagtggagactgctgcacggactctggaaccatgaacatatttgatcgaaagatcaactttgatgcgcttttaaaattttctcatatgtaagtgttttgaccttgactggttttgtactgcatttcttttcatatctctttgtcccttttctgcatttataacttttgtgtgtataagctaacaaattaacttggccagaatccagaggacctgatgaaaatgtccaaattctacacgttgctgtgtggttattggaaaggcatttattctagtttgggtactgattattcataattttgggcatttggtcttcctcagcatttaaggttctgttaacctattttcaaaatattattttttattgtaatatgctttcctaaaagtatttcaaactatttgtaacagaacttttacatattcccaggaagggaaagagagaaatgattcttcttagcttaaatatgagattgatctgggactgattgctcttattcacattcttttcttagaaccccgtcaacgcagcagcacctgaagaaggtctatgcaagttttgccctttgtat

SEQ ID NO: 11044 - DNA, 1053 bp, Homo sapiens
ccacctcggcctcccaaagtgctgggattacaggcgtgagccaccatgttttttttaaagtgaccaaagggggatcatttctatttgttctacagatggaatgtactttaagcacttgtcacgtttcattcatcctttctattttttgggcaagactcactcatagtttgacttgggtagttgtactgtagttgaaggactacgcaagccagaagagcctccagcatccaccatggtcctaactctgtgcttcaaggcttctgggttatctcctcagccccatccctgagaaaacactactttttctcctgcctccaggttataagcaaatgttaggaagttcagacgagtgtttgaacccaataaaggtctcttgcaaaataaatttgaaactttcaagtgtttaatgattgattgattctgactctaacaggctggcctgctgtctgccttgggctccctgatattgatgatttggctgatggcaacacctcatagccatgaaactgaacagaaaagactgggacttcttgctggatttgcattccttacaggtacgttaagggatttgtctaattttgaggggtgagctatattttcagtatctcttaattagttcccccccctttttttttcttttttttttttttgagacagagtctcgctctgttgcccaggccagagtgcagtggcttgatcttggctcactgcaagctccgcctcccaggttcacaccattcttctgctttagcctcccgtgtaggtgggaccacaggcacctgccaccacacccggctaatattttgcatttttagtagagacggggtttcatcgtgttagccaggatggtcttgatctcctgacctcatgatccgcccgtctcggcctcctaaaatgctaggattacaggcatgagccaccgtgcctggccctttttttcctttttttttgagacagtgtctccgtctgtcacccaggctagagagtgcagtggcgtgatcttggctcactgcaaactctgccttccgggttcaagcgattctcctgcctcag

SEQ ID NO: 11045 - DNA, 2261 bp, Homo sapiens
gcttgctctgtcacccaagctgcagtaggagagtggcactgtcatggcttactgtagactcaagctccctgggctcaggtgttcctcccatctcagcctcctcagtagctgggattacaggcacatgccacaatgccctgctaatttttgtagagacgggattttgctatgttacccaggttggtctcgaactcctgggctcaagcagtccacctgcctcagcctcccaaaatgttgggattacaggcatgagccactgtgcctggcccagtctcttttctctatgctgcatgacttcgatgagtctaaaggatctcagacaccagagttttacttccttagttgggggtaaagtgtgggagaagctggctcgtgggggtaggggtggggtttatattctgcatctttgtgggcttgtggataaaaaagtctgaagtacagatcctaatctggttcttgcctttcaggcactgcattgatctcttcttagatttcattactgtcttcagaaaactcatgatgatcctggccatgaatgaaaaggttagttagcctacaacccaaagatgagacaataatggctcctgagcttggcatgtgtgtatacttcagatttgaaaacttgctcacacactgtgttaggtccagggtaactgtaaggcaggccactgagtaagaggtaagccagaagtcttcagttgttagaaaaaaagcagcaagtgaaaaaaaaatttttttaactaattcctgcgtttagtatgaaagggaaaaaagcttcagtggcagtaaacacaacctgctacatgaataatttaaaggctatatagttgtgactcagagaaaggtattgtggaggacgttgtaaatttcagaagtagactaattttatccatttgttaatttttttttccaaggaagcattctatatagggctaatgagtatctaacgtagttgagtcaagcagtgggggaaacaaatgaaatgagcttttctttatagaccttatggagcttagagatagcatagtggtagcgggagtagttgaccagataggattgctggctctgtctgggctatgccatggttggactgagcactaggcagatgtacaagtttcagaacaagcaactgaattttcattccttaatacattgggcttccatccaagattgaatgaagaattctgctggaccaaattatttctgaatgtcagtttatgccagagtcatgctcactttgcagggtggagcacttctcgcgcctaatggttggttggtggtcttggcctctagtttcactctttgaggatagagtgccatctgcagccttcactgttgggatctgagctgtagtggctgtgaatagcctagagtggtcaggcagcccacctcggcactcctggggtgggggtggggacagctgcttaacctttattcttggtcggtctgtcggcaactttgggaaccaccagtaggatgtggttaagattcagttcttgctgagctaaggaagcatttctcatttctttttaattgtctggctcacttctagtccctaactaaatgctcactcaagagttttagcttgaatgtcaaatgtcaaaaaattaattgggtgatttttctccatttctaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaa

SEQ ID NO: 11046 - DNA, 1540 bp, Homo sapiens
tccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttcctggtgtttgtgttaaattcaagggtacagctggtcatggagcttgtgatactgccagggtttgctactgggggctgggagtgggacacgattgagttcgtgtcataagtat

SEQ ID NO: 11047 - DNA, 1026 bp, Homo sapiens
gccttcagagcagaggttcttcactgaggaaagaaggtagtcagggaagagaggctttgtggttagggctttgcttgctctttcagtagctcaggaagaagctgctgggccccatccaacaggattgctgtgggataccaccccccactgtccaagaccttgctcaatgcttttgcaaagtatagcgtgcgggggcacgtgtggactcttttgtagatttctaagggcaaccctcttctcaacaataagaaccctgtttctcaaggctggttgggggaggcataagaagacaattcagggaggctactctggtcactcaaagaccccagctcccctgatgaggatctgcagtaacaggcatttctccagatgtgctcctggatctagctcaaccccagggaatagttggtggtcacaaagcatttggccagggtccatcccccaggtgtggctgagtcagcttgggagggtgggggtgaatatggggagcctgagctgaatctgggagagactggtttggaaatccttcgggactgaagagggagaagggcagggcagggagtatccccacagcaacctggctgggaaggtttcaatagctgcctcctgagcaaccacagtgacccaaccacaaggccccctcttcccggccacctccttttcttcctggtagggtgtgttgttgccaagacaatggggtccatggctcctctctcctgccccaccttgaggccagccaggccaaggcagggcagggattccatggaggggggctggggtgcagctgtctgctggtgtctgggtgggggccagagaagtgagcacagtcgcagctggtgccatcctccagctgcaccttatctgtccctggcagtgggagcagctgatgtggccagaatgctgagcagcagcaaggggagggggctggcagatggtcacccagtctgccctatgccaccccctcctccgctgagacctagaccctttgcctagcggagagagaagcaggaattcatttctggggcc

SEQ ID NO: 11048 - DNA, 1119 bp, Homo sapiens
cggaaaatgccaggttcatagaatatgttggtgtctccccagctaactaaatcaaccggccaattctctccggccattcttccgccttggccaacccctgcccacccccacccccaagctttccctcacttgtatgtttggggtggccaatgcagaagcctctaccttctgacctataacgtcccagtcaggacccttaggtgtgcattctgggaggcaaagctggaaggagacagcgagaatgagaaggggtgcctagctgggtggaggataggactgggcattagggctcctggtctctattttgggcaaagttccacctggccccacttcttagcttctaagcccaatctcctgtaaggaggttgtaaaattattctttattgaggggcagtccttcctctgggactctttggccaagcccacggtgccccatgtgtaatggatgtgcagcgccaacctacctggacacaggaattggacatcttcctcatagaatatttaaaaatgatcatgaagctgctgtgtattcacttgaaagggaagttcccttaaggaactgtaaggacagacactgccaccccaggctctccaaggccactctccagggagagggagggtcaattgtgatctttctgagatcccatgagttcttggatagaaaatgctttcccacccttctgcatgccctctgtgtggctgacagttctgggggcccaggaggttgggctgtgcagcttagtgccatgtgtctctagttggtgtcacaccagcatgccaggctgagaacatccctgggggtgagactgtggcagtggccttggccatggacagcagccatctcagacttcctcacaacaccctcatcacatatgcgccccgagcatgcaagcacacatgtgcacctctgtgtgtgtctgcaggggagtgtgaatgtagagtgtgaagtggaagcatgtggaggtgtatgggggcccatgcagcttggtgtgtgtggctgtgagagaaagcttctgtgtaggcaaacctctggttgcatgcagagcacatactagcaaaattaatcatctctttcagttgtgctttgcaatttacaaattccctttactttagctcacg

SEQ ID NO: 11049 - DNA, 1033 bp, Homo sapiens
tttgtatttttagtagagacagggtttcactgtgttagccaggatggtctcgatctcctgacctcttgatctgtccacctcgacctcccaaagtgctgggattacaggcgtgagccaccacgcctggctgctttcagctttgtggggctacaagagaggactaaattttgccaggaggcagtggggagtgagagaaggtctttacttttttgagatggagccttgttctgtcgcccaggctggagtgcagtggtgcgatctcggctcactgcaacctccgcctcccgggttcaagcgattcttctgcctcaacctcccaagcagctggaactacaggtgcgtgccaccatacctggctagagaaggtctttaagcagaagaatggtcagagtcacacaactcgaactaaaggtggggagaaactgcagggaggcagggagaccagttgagaggctgttgtttaggcaaaagaggagggcagtggcagaaagaggaggacagtggctgttgtttaggccagtctgagggcagtggcagaaggatggagaggggctagagctcaagactctgcttctgaggcctctttgtccctggcagcaaagctgaggccaaaggttccacatcactcagttctgctagaacctgacaccctgcctcacatccccaacacactctagggtctctgcaaatggagaagggaagatggtgggagcagggagggagaagagaggaggaggaaggggaacatggcctggggctaggggatgcttaaggaatggggaggcccaagcagacccacctagccccggtctagccccactgctcctcctctggccctgcagagaaagcattaatctgctatacctccctcccccgcttcccctcctcccctcgggtcaccttcttggccctggagacttggctgatggctcaagttcctcaaccagtggccctgagtaatcagaacacacagaggggccaggggcctgggggcagggaatggtaaattagcggtaggggagcctcagagact

SEQ ID NO: 11050 - DNA, 1067 bp, Homo sapiens
ggctgagggttttggtgggaaccccaagttggttcccaatactctctacctgacccaggtccccctgccccacccccagcactgatctcaatttcttccacccaccagagaattcctcgaacaaactaaactgttcggggggcggggggcaggccaaaaagggtagtggtgatctgccaggaagctttcccactgcaggagacagggtccctccccctagtgccgggaactggtcagaaatgagtctgtggtcagtgagagactgctgctaatggaacctgggctggcccacaagccacaggaggggtaggggagaggaaaggaaccaaaatacatctcagcataggtgggtaggacgagggctggtaatgctgtcctgaaatagagctggggccagggagggaggggaagagaaacagggtcggggactggaattggaggtctgagagagtacctggtggtggggcacggaggggctcaggtatcccagaggaataactggacgagggagaataagggagaggacccagaattgggatggggacactgagggatatgctgaggaacagattggaggatgacagagagcatgagtgtgtgttgtgtgtgtcctgggggggtagggactgtggtcgctgtgatcatcatggcagtgggtgcaaaggatggtgctaggtcccgtctcacctgggaggggtgggttccaggaatcccagccctaggcttttccagggtttccactctgtcctaaaccctctctgtgctgccggagctggtgacaggaaaggggctccagccccctgctctccatcagcctccctttcccactgccatcaattattcatcagcccagacacccgccctccctggcagggcaggctggtcctcctcccatgccccgccccagccacactgccacagaggccctggtgaggaaggacggccagctgggctgagatacctggctgacgggctgggtggctggctctgccggactctgcctggagtcacatcgccttcccctctggcaccttcccccttcctcctgcaaatccctggcaccagga

SEQ ID NO: 11051 - DNA, 1038 bp, Homo sapiens
tttctgggaacattacgacaagctaagagtccatcaaacccagtttctccttttgcagtctcagggaagataatacatcgtaatggcagtcatggaagctgctagaaaggaggatgtaataagttggggaattgagggagccaacgtccttacctttcttttaatgtctgtaaactgagaaaacataagggaccaatagaaggccaattccatgatataatagtgataaagcccacttgaaagaggctggaagagagaaagaagtagttagattaccggctagtcaaaggtgcattccatctctccaactttctctgccttggaggaccaataccccaaattattagacatctctcctccccattatctgccaagatatgcaatagctaacagactttggattggtgtagagacttaagcctcttcccttgctcctctgcacacacatcttcagctctcatcttgcagagatgagatacagttaacacatactgtaacacaatcaaatcagtatgtctaggattctgggcaattagtgcttttcacaggattaaatacacataggccttctcttccacccctttagcagttcctagacatatttccagtataggttacaaccaagatgctctactgggattccaagttacccttgatacaaaaaagacacctgaaccagaaagtacctcattaaataccagaaacttgcttttcttttagcccaattagggggaattaaatggggaaaatcagaacaaaaaactcattggatttcattgctatgggggcctcaggaatagatacctcatatgactcttagcagtgggggggaaaaaaaaatagataccctgaatatgacttaaagggactcagtccctaatccctcaatcccaaggaaacgcaccatctgtcctggggactggcaaaggaccctcactcactccaccttatacacattcaagacccctatcctgaaacgactcagatcctacctgaaatggatagttatgccagcactgtcggatgtcccagaaccaa

SEQ ID NO: 11052 - DNA, 1090 bp, Homo sapiens
ggctcatgcctataagcccagcactttggaaggctgaggtgggcagatcacttgaggccaggtatttgagaccagcctggccaacatggtgaaacctcatctctactaaaaatacaaaaaaaatagctgggtgtggtggcacgtgcctgtaatcccagctactcgggaggctgaggcaagagaatcgctgggacctgggaggcggaagttgcggtgagccgggatcgctccagtgcactccagcctgggtgatggagggagaccgtctcaaaagaaaagaacagaaatatttgtctaacccaaggccccagagattttctcctatgttttatagatttagaagttttatagttttagctctaacctatagttaagggtcagagtttttccatgtgaatatccagttgttccagcactattattgaaaagtctatcttttcccccattgaattacattggctgctttgttgaaagttaaataaatatatttgtgtgggtccatttttggaaattctgttctattccattttactatatgtctatgataatctttttaataaagaaaactattttactttggtgaaaagaactctgaagttatttttaggtattatgaaaaaaggctgaatctttttttttttttttttttttgagatggggtctcattttgtcacccaggctggagtgcagtggcacaatcttggctcactgcagcctctgcctcctgggttcaaggaattttcctgtctcagcctcctgcgtagctggtattacaggcatgtgccaccatgcctggctcattttttatttttagcaaaggtgaggtttcaccatgttggccaggctggtcttgaactcctgacctcaggtgatctgcccgcctcagcctcccaaagtactagggtgacaagctagagacactgcgcccggccaggctgaatgttatacgtgtgaacaattggcattcttcccaaacatctcttactctaaccggaaatatatgtgtatattaaaggtattttctgtaactaatttctaggatagtaagttatcattgtattgaatgtgcatttttatgcgtaagaagtaa

SEQ ID NO: 11053 - DNA, 1076 bp, Homo sapiens
tcagactggatttaaaaattgaggtctagcaatacactatctctatactatgagatacgcttaaaatgaaagtatatgggcaagttgtaagtaaaaagaagtaaataataccagcactttgggaggccgatgcgggcggatcacgaggtcaggagttcgagaccagcctgaccaacatggtgaaaccccgtttctaccaaaaatacaaaaattagccaggcatggtggtgtgcacctgtaaaccccgctactcaggaggctgaggcagaagaatcacttgaacccaggaggcggaggttgcagtgagcccagattgtgccactgcactccagcttgggtgacagagcaagactccgtctcaaaaaaaaaaaaaagatataaatagacatttcatcctaatatgaacacacactcacataccaggaacaaaccaggtagctatttcctatcagatgaattcaaactagaaatcaaggcaaaaagtatatcagggacaaagcataagaaataggcttggtgctgaccatcaggagctcagccaagtggagatatcaagtagatagttggatatatagcactagaattcaggggcaaagctcagaggcaaagtcagagctgagatatacatttggagtcatcagcatgtatatggtatttaaagccataagactgggtgagatgccgggcgtggtgactcacacccagcactttgggaggctgagatgggaaataaatcagactaaaactcagggaccttctacctccgtaaaatttctaggggtccagtggtgtggggtctgtcaagatattccttctaaagtgaaggataagttgttgcatttgcccctcctacaaccaagaaagagtcacaatgcctagtgggcctatttggattttgggggcaacacattcctcatttgggtgtgttactccggcccatttattgactgacctgaaaggctgccagttttgagtgggttccagaacaggagaaggctctgcaacaggtccattttgctgtgcaagctactctgccatttgggccatatgacccagcagatccaatggtgcttgag

SEQ ID NO: 11054 - DNA, 1047 bp, Homo sapiens
taacctttttctgtgaggcagatgggaaattggctgccctcaatgaatcagactgattgcaggccagtctttgtttgcataaaagtgtaactttgagacctggcgtggtggctcatgcctgtaatcccagcactttgggacggcaaggcaggtggatcacctcaggctgggagttcgaaaccgcctgaccaacatggagaaacactgtctctactaaaaatacaaaattagccaggcatggtggtgcatgcctgtaaacccagctactcgggaagctgaggcaggagaatcgcttgaacctgggaggcagaatttcaagaaccgagatcgcaccatggcactccagcctgggcaacaagagcgaaactctgtctcaaaaaaaaaaaaaaataggagtataagtttgtaacttcaccctagcctctgattggttgctttttgctgcaaccaatcagactgattgcaggctaccgctttatttacatgaggtgagcatgaagtgatcaataggcaacttctagagggtatttggacccaagaagattctgtatccaggtccttgagcagctgctcgggccactcctgcactgtggagtgtacttttgttctcaataaatccctgctttcgttcttctgttgcttcattctttatttgctttgctgggcattttgcccaattctttgttcaaaatgccaagaacctggacaacttgcagtcacaaccctctactggtaacattatgatttcccttcattaccaatcataaccaccttctaattcttcaggggtgtctgctggtttttagtttccttcattatactcatttatttcttccttctgaggcatcttcgggtttagactgggaaaggcagactgtgccactttgccatcatgttaggggcccataatgatgtccctttcatgactcagcctaccccagggttgttgaacctttgtgtttccagtaatgtagagcagaagatactctttcttgagtggtcatagtagtagcccagaaatgaagatgttcaacctgaagaactgca

SEQ ID NO: 11055 - DNA, 1029 bp, Homo sapiens
tcacttgaacctgggaggtggaggttgcagtgagccgagaccacaccattgcactccagcctgggtgacagagtgagactccatctcaaaaaaaaaaaaaagagtaataaagaaggctttataggaaggtgtcaagcagaattttgagggacagtcataaaaagattctccctttctctctctctccctactgccctcctataatgtattccaccacattttggtggtcctaaacagagttttgccatcctcattctacagaagaggaaaagaaatctcagcaaagttaagtgttttttctaatgtcccataattgataaatggtagatttgggaagcaagcccagaacttctttcttccacaatgccaatatttctcaaggtgcggactctgatcacctagactgaaccatatggggtagacgggtggggtgcttgttgaaaatgcaggttccaaggtccttctccataccttttgaatcaaaatcttagtggtaggcttcaggaatctgcattttaaaatctcaggtaactcttactttactaaagtttgaaaaccattgtgcttacggacagaacagggaagaaggggatgaggaagtccaggtggagaaatcccataaacaaaggtaagaaaacgaaagttatattttgagagtgatgagtagtctggggtttttgaccacagatatgtgaaaggatatagtgggggatgagactggaatggttggatagtgaaagatgaaaggctttcaaaggtatgttaaggagtttggatcttctcttatttttttttttggtagatgatggggacccatcaaagacatttttctaaatatatgtattttatatacatgcgtatatatatatattgcctcaggtgaatcagtgagatttacctgagattttatttatccatctctatctatattgagagagaagagagaaagaataattcttagctcttaggtttcttttgtgggttataatgaatactttagaacctactatatatatggatcatttaata

SEQ ID NO: 11056 - DNA, 1734 bp, Homo sapiens
tagcaattggggcgcgggcctgtgagccagttggagttgcggcggcgggaacgattgggctgagcagaggacgacatgttgcttttcgtggaggtgagtgcattatgctagtctcgtcctgctcttaggagagcaggagtgtagaggcgccggccggtcccaccgccatgtgactttccgggccgtacacgccgcggaaccggcagataggctgacacagcacctgggccgagcaggcctgcagcttccctctgcgcgctcacaacactctaggaagctatgggaggtgaggcccgtagtggagaagaattgaaggagaaaaacggagggctgttctggtgtggcggtgaggttcagaggaaggggaaagtgtcccatatggacctcctaaaggaggcagcattggggggttggggggcggagtctgagggaggagagggtaatcaggtgggcgcgttccgggggccgagcgcggcctcgcggggcccctctgggagggaggcgagcaacatgtggggccacggatggagaaaggtgaaatgcggtaagtattttgaaaagaaaattgaaaagttcttttgagcaacttccaccaaattctgcccgggccccgtccctaggtctctggaacgttctgtgggtgaaagcgagttactttgaatcgaggagaagccagtagggtttggaagccttgaaaggcaccgctttgaccttttgtaaaagttactcaagcagcagctgcgtgatgaagggttggttctatgaaccgattaaaagccctttacaaggaaaattccaagaatgagggaaacttattccgggaaaagccgttttttgtaatgttatttgaacaatgagacacttttattacttaaactagaacgtctgctgttggcctattttagttttcaagatagagttggatacctgccttacagaaatacgaaatttaatttcccttaattctgtcctcttgtgtgcagtgagcgtcagctgactgcctggctaatgctttgagtagattccagatcatattgttcttacattgtgaaaacgtcaaaccagcaaagctgcaacttcgcaacttggcatttgttaactatgcccataagaagaatcttttcaatgagggaaggaatttacgggttgtataatgaatctaggagccggggccagcctatggcagatttttttttccgggttgtgggaaaatcttactccgtaatattccagcataaagtaaataaatgattttacggtttttttttctctttaaactaactgatattgtgtcgccgataagcttgatatctttaaattagttttttaaaagactgctacattagagtgtatctaacattcataataaacattcattggaacattccggggaaatcatgaaaagacttaaaattactgaactcattctgtttactgttttctgtcctcattgttgttttccttaggcagaataagaaatcagataagattttaagccagtgccagccagtttttttaaggaatgttatgctatgtaaataccacaggttttaagtgtgtgttttgctgggcagaagaaagattgtgaagtttatattgacaggaactccacaatatacttttgacttccaaattgattcctttggctttattaaaatgtaagttttaataacagctccatttattgtttaaactaggtcttctcctgtctctaaagcgatacttaatatgttt

SEQ ID NO: 11057 - DNA, 1029 bp, Homo sapiens
ccccatctctactaaaaatacaaaaattagccagaggtggtggcacacacctgtaatcctagctactcgggaggctaaggtaggagaatcgcttgaacctgggaggcagaggttgcagtgagctgagatggcaccactacactccagcctggacaacagagtgagactctgtctcaaaaaaaagaaactaaggcacatataatttaaacttgcctaagtttatacagctagtgaacatggaagcttgtattagaactcatcaaccacctacttgtattggagtagaatatattgcagacaaggaatcaatcctatgtaaataatacttagatgcaactttttaaaacctggccttgggcccaatgtggtggcatgtacctgtagtcccagctactagggaggcagaggcaggagtttcgcttgagtatgggaggtcaaggctggaatgagccgtgattgtgccactgcattccaggccgggtgacagagcaagaccaactatattgacttcagtagattattggtttgttttatttttttcctcttgagaccgagtctcgctctgagaccgaggctagagggtggcgcagtctcagctcactgcaacctccgcctcctgggttcaagcagttttttttttttttttttttttttgagacggagtttccactcttgttgcccaggctggagtgcagtggcgccatctcggctcactgcaacctccacctcctgggttcaagtgattctcctgcctcagcctcccgagtagctgggactgtaggcgcatgccaccacgcccaactaatttttgtatttttagtagagatggggtttcaccatgttggccaggatggtctcggtctcttgacctcatgattcgcccacctcgggctcccaaagtgttggaattacaggcgtgagccaccacacctggcgggttcaagcagttctgcctcagcctccctagtagctgggacttcaggcatgtgccaccatgcctggccttttttttttttttcctgattttta

SEQ ID NO: 11058 - DNA, 1023 bp, Homo sapiens
tgcaggcttgagccaccgcgcccagcccatcttaacagtttttttgtttgttttttgagatggaatcttgctctgtcgcccaggctggagtacagtggcatgatctcggctcactgcaacctccgcctcctgggttcaagcgattcttctgcctcagcctcctgagtagctgggactacaggcgcgtaccaccacgcctagctattttttgtatttttagtagagacggagtttcaccatattggtcaggctggtctcgaactcctgaccttgtgatccaccctcctcggcctcccaaagtgctgggattacgggcgtgagccactgcgtctggccgaagctttgttttctttaaggtttaaactaatttaagagaagtataacttctaagttttcatctcagccttgttactaacatactctgatttagggcaagtcaaacaatttataattatttaaagttttttttatagttggagagtatacttttggttgggcaaataaaagttttaaaagaggaatgaagatggcagtatgttaaaatacacatttacttgcagcatttaaaggagtacagctgggcggggtgactcatgcctgtaatcccagaattttgggaggccgaggcaagtggatcacttgaggccaggagtttgagaccagcctggccaacatggcgaaaccccatgtctactaaaaataaaaatattatctgggcatgtgcctgtagtcctagctacttgggaggctgaggcacaccttgaagcagaggttgcagtgagccgagatcatgtcactgcactccagcctgggtgacagtgagactgtctcaaaaaaaggaaaattaattaaaggaatacaaatgttaaaatgcaaataggcactttgcacttactcttttgaaaaaaattataatgtaaaagtgtaagtaaatgtaagaaaaagaaacatctaagtatgtactcatctttcctgtcttacctgtgtccttgtcccaccacttgaaccaatctttggttcaca

SEQ ID NO: 11059 - DNA, 1072 bp, Homo sapiens
gggtttcaccatgttggccaggctggttttgaactcctaaactcgggtgattcgcctgcctcagcctcccaaagtactgggattacagatgtgaaccactgagcccagcctagggaccctagttgtaatctggcggctattttctatattcatttttgttttttcttttttcttttttttgagatggagtctcgctctgttgcccaagctggagtgcagtggcgtgatctcatctcactgtagcctctgccccccgagttcaagtgattctcctgcctcagcgtcccgagtagctggggctacaggcacacgccaccatgcccactgaattattgtatttttagtagataaacggggtttcaccttgtcggccaggctggtcttgaactcctgacctcaggtgatccacccgccttggcctcccaaagtgctgggattatagacctgagctactgtgcccagcccctagactccttaggtttaaatcctggttttgtattaatagctatgtaactttgggcagattactttaccttgaagtaaagtaactttttccttgtctgtaaaatgtggatgataataggacttaactgagattgttatgaagattaattagatgttccataaatgtaattactattctctgaatgagtgaagaattcccactttaattttcatttttactttttgtaaaatagccctaagcatcttctggtaggattctgaagttactttggaagaaatgacaggtgtttttttttccccccctaagtacttgtaacttagtagtagccctctcagtattggagatgtaaaaattgaacctggatgattgatggggcaaaatacatttaatcaatttatacattttatttctgttttacagcatttatggggttaagtggcatgggatttctgtttctgatagtaaataggtaagtaaaacaaaaggttatgtatgtccgaagagacggttttaccatatttatggtgattttcttcctaactcatggttctgttaccttaggtctgtaatttcttaggacaggaggataccattttcacaagaatt

SEQ ID NO: 11060 - DNA, 1042 bp, Homo sapiens
ctgaggcaggagactcccttgaccccgggagtcagaggttgcaatgagctgagatcatgccactgcactccagcctgggcgacagagtgagactgtgtctcaaaaaaaaaaaaaaattggctgtctagagtctaaatgaaaagatagattttattctagctaaactgacttaggggctgccagccatcagttaacttattagcatgcaaaaagacatcactttggagattgtaaggattttagttgtgtgtggatactatcatacacaactgaaatacactgtaaaatatatattttacagtatcacagatagtgaacatttcccatactttctaagattttttctccatttttcaaaactttttaaagataattcaatcttgccttgttcagggatacatcctgagggatgtgttacggatttcattatgtgaacatcagaaaatatttatacaaatctagatggtatacctacaacacacctaggctatatggtatggctattataatcttatgggaccactgttgtacatgcagtttgtgcttgatcaaaatgtcattaatgcagcacatgactgtaattatagattcatgaagttgcaaaacagtgtacaaagtggtcctgtgaagttgttgctcagtttctccttgtagtatcaccttgcgtaactatagtatggtataatgagcagcaaattaacattgatacagtccacagaccttactcagatttttacagttttccctaaatctggttttaaggatctggtatattctattttatagatgaactacagttcacctctatggtaggatgtttataaaattagtgtggcaaacatccttgtacttacatgtttttatatatctcagtttcttttgagtaaatctgacaagtagaatttttggatcaaaattgtgtatttaaggcttttaataaacattgccaactcttcagaagagttatataaattatagcaatgaactgatttttccttttcatgcttatcaaaatagtattgaatctgggccgttgaatagg

SEQ ID NO: 11061 - DNA, 1042 bp, Homo sapiens
ggcgtcccaaagtgctaggattacaggcatgagccaccgcacccagccaatgtgtgtatttatataagcatgtttgacttaaataatttaaaacacgtattttggacagggtgcgctggctcacgcctgtaatcccagcactttgggaggctgaggcggatggatcacgaggtcaggagatcgagaccatcctggctaacacggtgaaaccccgtctgtactaaaaaatacaaaaaaaaattagccgagcgtgatggcgggcgcctgtagtcccagctactcgggaggctgaggcaggagaattacttgaacccggaaggcagagcttgcagtgagtcgagtttgcgccactgcgctccagactgggcaacagagcaagactctgtctcaggaaaaaaagaaacagaaatggaaaatccttcttgagtcagttcacagttcagctacagtttttatcatgcatattctaatatcactgatgaagtatttataagatggaactctgctatatgtaatgttttgttaaagtgctacttgtaatattaaacctctttatgtatcagtataattgtccaatgttgtgctagatgtgtttgggaattgagatactgtaaaagttatattaactaatgtttatgtatatattacattagtatcttttgaattgaacttttaacaactttttagagttcactgaaaagtttaatgttatttctgatagaataatcttatttccatgcatttaaaaagtaggaaaagtgagtaagatacctcttgttagatgctttttaataattgcttgttttataggactattttgttttttcagagaaaatttgtcaaaggatctttacttgatatctcaaatggatagtgatcagttcatcccaatttggacagttgccaacatggaagaaataaaaaagttgactacagaccctgatctaattcttgaagtgttaagatgtatgtaaaaataccttttagctttttttttaatttttaaacgtaaaatgttatttcgacttctgatcatataggg

SEQ ID NO: 11062 - DNA, 1069 bp, Homo sapiens
tcaagttatctttacttataaggaagtatacctatggttttgaaaatacatggtgtgtttagtacatttttgcatgttacttaaaaccacttgtgtacagttcttttccatatatttgaccaatacaggttggtaatttttaattacagaaataattagtgaatactttttctaaaaatgcaaataaagaccttctggaccagcaacccaaatccttgtttccttcttgcttctaaaaagtgactacttctaaaaagtgactactgccaggcatttattattattattaatgttaacagctaaggacaaagtcttttttagagagccttttgcaatttttatattaacctgtgacagcccagtgatgatcactattcctacttagagagaataggactaactttcagaaatccaggcatttttctacctttcatactatctttctttcactttacttctcttttctgtcttttatcacttctttctttcttcattctttctctcttttgcctggatcgagattgttaagtccctctcagtgaagggtaagattatgagatctgagggctgtataaatgtagtaagttgtcccttaagcatattgaaatgtagtgtgaaagttggatgaaggacattttctaaacatatgcaaataccatatctatcatatcagttcattttcaagatgtaacaggtaatataaatttttttttttgagacggagtcgtgctctgtcaccgggctgtagtgtagtggtgcagtctctgcttactgcaacctctgcttcccgagttcaagcaattctctggcctcagccttctgagtagctgggactacaggcatgtgctagctaattgttgtatttttagtagagacggggtttcatcatgttggccaggatggtctcaatctcttgacctcgtgatccacccagcttggcctcccaaagtcctgggattacaggcatgagccaccatacccggcctttttttttttttttttttttaaagacggagttttgctcttgttgtccaggctggagtgcaatggcgggatctcggctcactgc

SEQ ID NO: 11063 - DNA, 1053 bp, Homo sapiens
acaaaaaattagctggacgtggtggctggcgcctgtagtcccagctacttgggaggctgaggcaggagaatggcgtgaacccggaaggcagagcttgcagtgagctgagatgtgccactgcgctccagcctgggcaacagagcgagactccatctcaaaaaagtttacgtcactttttaaaataacatctggaatgtaaaaggggcaacacttttacaacattattcttttgtgtttaacttaattttttgaaaaccccagtacaacaggagccaattttttacctaaggaaagatgtttttctgtctcgatttactgctttgtgtatatcattttgtatttcctatagtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaagaaaataaagtacctgaaaacctttgataataatgtgatcatcctgaataattgaagaacatgatcttcataataattaaatgagcatttaattattggtatatggttatattaaataaatacgttattttcagaacatgagttggttgctttttataattattaagaaatagagtgcccatacagaatatagctctgaatcagaggtttataaagttattctgaagttccttatagctcatataagaaagaatagcttagaaaattaacatatccatttgccttatggttttaatttcttccagcttttaaactatagaagtggctgggtgcggtggctcacacctgtaatcccaacactttgggaggccgtggtgggaggatcatctcaggtcaggagttcaagaccagcctggccaacatggtgaaaccctgtctctatgaaaaaatacaaaaattagctgggcatggtggcaggcgcctgtaa

SEQ ID NO: 11064 - DNA, 1028 bp, Homo sapiens
gcttgttgcccttttctggaagataatctgtggttttcttatggttaacacaatcatttttatactttataatttaaagaatgtgtaccataaatgtttttttttatcatcacttcaaaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaaaaaacaacaaaactattcaaaaacttcactctcttcccattaaacttgaactgtggctatattgaactgttttggaggggagggggtagccaggaaggaaacaagagaaagtacgtccatttcattatggattttggagttgtgagtgataggatcccaaaattcatctctaatgtggtttttaaatgctggaggattccaatcaatataaatatatatatatatatacacacacatatataaaaagtataatttttctatttttgtttttggttttaatttgcagagatttgctgccaggaatcaattttgagggttcagatttagcttggaagaaaaaaaagaaacatacatccttcagtataggagatgagggaatgagagaaaatattttttgaagaagcatttctgtaaaattagaaattactttttttaatctatttaaagtttggcttgaagaatgccatctctgactatatggccttgtattgcaaagcggatcagtggctggggtgcctgttgtgggtgtgagtgtgtacaagagcgattgaagccaaatctgttgtcat

SEQ ID NO: 11065 - DNA, 1708 bp, Homo sapiens
atcatttgagaagcacatattttgacatctggtgggcctgggttgaagttctgtctgtaccatttattagctctgtgactttggacaaactgtctaacctcccaggtatgagtttcatcaacatttaaaaaggaatgacggtggtgtgcagtggctcccgcctgtaatcccagcactttgggaggcggagccgggtggattgcctgagctcaggagttcgagaccagcctgggcaacatggtgaaaccccgtctctactaaaatacaaaaaaattagccgggcgtggcggcatgcacctgtagtcccagctactcgggaggctgaggcaggagaattgcttgaacccgggaggcggaggttgcagtgagctaggaccgcaccactgcactccagcctgggcgacagagcgagacaccatctcaacaacaacaacaaaaaggaatgacaccctccttggagttgtaaggaggtttaaagtaagataatagaaaagctgagtatagtatggcgtgcggtgagcactcagcacatgtaatctttattgctgctgatagtgaatggatgcgtggagacttggcagtttttaatatcttgtgttacttagtagaataaggttatatatgaagtgatgaatggaatcaatttgtgataaattttttgaaagtaagccttcactccatcatcagttgttcctgttggcacctataccctatacccttagtccagtacatgttgggtcactgcaagcagttgactagagcagaagacttgctggtctgtttcatacagacatctcgcatatgtacatttctgagcctacagattcaggcaaatgcctgtgacatataagcttggtttctgagacttagcatctacaagctatgaaaagggacatatggatgtttagaaccttcagaaacgatggtttttactcttccgtttcatatccctcacttgtcctcagtgaacatatccttccttttagttcctctttcaaaagttttctggctgggtgtggtggctcacgcctgcaatcccaatactttgggaggctgaggtgggcagatcacctgaggacaggagtttgagaccagcctggctaacatggtgaaaccccgtctctactaaaaatacacaaactagccgggcatggtggcaggcgcctgtaatcccaactactcgggaggctgtggcaggagaattgcttgaacctgggaggcggaggttgcagtgagctgagatcatgccactgcactccagcctgggagatagagtgggactccgtctcaaaaaaaaaaaaaaaagtgttcttgatcttcttttccctagagtttatttaccaccagcctccgtgagtcctctcagacttaattggtctgattgtagtctctttttagctctagattgatctttcatcttttaaaaatactacttttatttaaaaccattgctaaatctaaagctctgtcactcagttgtctttttttttttttttttgagacggagtttcgctcttgttgctcaggctggagtgcaatggcatgatctcagctcaccataacctccgcctcccgggttcaagcgattctcctgcctcagccttctgagtagctgggattacaggcatgcaccattgggcccagctaattttgtagttttagtagagacggggtttctctatgttggtcaggctggtcgcgaactccc

SEQ ID NO: 11066 - DNA, 1051 bp, Homo sapiens
tccgcctcccgggttcacgccattctcctgccttagcctcctgagtagctgggactacaggtgcccgccaccacgcccggctaatttttttgtatttttttagtagagatggggtttcaccgtgttagccaggatggtctcgatcttctgacctcgtgatccacctgccttggcctcccaaagtgctgggattacaggcgtgagccaccgcacccgaccaaaaaatttgttttaattagatttttttttttaaattaaatagagatggggttttgcattgtttcccaggctgatctcactcctgggctaaggtgatccacccgtcttgacctcccaaagtgctgagattacaggtgtgagccaccttgcccagtgatccatattctaatggatcactgagtcttgttgtttctacttcctgttctccatatcattccagtgttagttcaggcacttatttcttgcttagactaatgaggtagtctcctaactcatcagcctgtctcggtctcttctcccttcagtaggtctttctctaccctgtcactgattgatcattctgaaacacaaacctaattgtgttctcttccctgtttaaaagttttccttggcttctctcagtcacaggataaactctaagcatctttctttgtataccaagacctgcctgcctttttaccctcatttcctgctctgtctatatttgttgtctgctctctagccatgccagatgacttgcacttccatgaatgcactgtgctttttttcacttgtatgcttttgtatacattgccattctctaaaatgtccactctggtatgttcttcccctttttttgcccggttaacttctgtttcagtttcctgtgagtttccagttaacttctgtttcgttccagtttccttttctaagctcttttaagaagttaaatctctgtataagtagtcatcagttattgagagcttatgatgtaataggtcctgtgcttagcacttcatataccttgcctggctagtaagtaggtgctgaatacatagctcctattagcata

SEQ ID NO: 11067 - DNA, 1081 bp, Homo sapiens
aatgcacttagttttatattctagaatttaaaaaaatcaacttacattaacactcttttcctttggagaatatagaaaaagctaagggtcacatgagagatttgcattaataaatgtagaaagaatcagtgtaacttgcatgtgttaattacaatttttggaagcttaatgattttgtagaatcattgacaaggccatatgtatcaaataagcctatttgtaagttcttccagtcttgaattgtagtgtttctgtgaagtttgtaactttttaagcttcttttatttatttattttttatctaatatcagtcactcaaatttcctttgtcagcattacataggataaaggagacctatcaaaaacttttggaatccaaggacaaagaacattctttttttttttttttttttaaatccatagtcaccatcaacttctgttgggagaacagagaaagatagactaagagaaacagagatagaaaatgtttaatcctgtattgtggcttactgtagctcttcatattcccttgaattttagactagatttcctccaaaattctgtgaacttggggatatatatgattgccagatgtctgacacctttctagatttggaactgtctggaatctaatttcttctgctaacccatagtatatgaaagaaagtaacacacacactattaagacaaactagaaaatatcataaagaggctggatgcagtggctcatgcctgtaatcccagcactttgggaggccgaggtgggtggatcacttgaggccgggaattggagaccagtctggcaaacatggcaaaacccagtctacactaaaaatacaaaaattagccagacgtgatggcgtatgcctgtagtcccagctgttggggaggctgaggcacgagaattgcttgaacccgggaggtggaggttgcagtgagccgaaattgcgccactgcactccagcctaggtgacagagactctgtctcaaaaaaaaaaagagaccgggcgcggtggctcacgcctgtaatcccagcactttgggaggctgaggtgggcggatcacgaggtcagggatggaga

SEQ ID NO: 11068 - DNA, 1072 bp, Homo sapiens
tggggggatattgcctgagggatctgctggagcccatggcaggcaaaagccagcaaaaatttgttactgttattgtgactacatctgtatgcatgaaccacttagctctagaggaattttggttacataagcttagtggtggcttagtaaatggattctgcagttcttgttgtttctcccagattgaacttgcctttctgccatatgattggcactactgattgttgaatcatttcttccagaacaaggaaaaatgccaggcgtggtggctcccacccataatctcagcactttgggaggctgaggtgagaggatcgcttgagcccaggagtttgagattagcctatgtaacagagagaccccatctctataaaaaacaaaaaataaggaaaatacatacataaatgttagtgttatagatggtaaaaagtgaacaaatgtcaacacaatgcaatataaattatcacgtttcagctgagcgcggtagcgtcctaagcctgtaattccagcactttgggaggccaaggtgggaggatcgcttgaacccaggaattcgagaccagcaacatagtgagaccccgtttctacaaaaaatattcacaaatttcaagatttatggagttttattatatgatctagttcagaaactttttagatatgacattgttttgatcagtctcctgtacccttaggggtagcacaagtaataggaaaaacaaaataggtctagatgcagcagtgctggttgaagatgtctgggtgatttaagtttctgtgttcctgccaggggtaataattgagaatcatatataagggaaccttaggaaccctctattctaacactgtttacagatgtggaaatggaggtactgagaggtgacttggttttcttgaggccacactgtttgcagcactgtatttctgaacttgtattctaacatctcaagtagcaaaaagtggaaatgaaaaacaattgagggagctatcagtcagagatggtagaatgaatatctctaatagcccctgttttttcctcatacctcattaaatgacagtaagaaaaagcattaac

SEQ ID NO: 11069 - DNA, 1081 bp, Homo sapiens
aagtagtactgccatctcagcctcccagagtgtgggggttataggtgtgagccaccacgcctggcctactatgagaaatctgtatggtcagcacattcttgccccatgggcaagcctataatgggaaccaaatcatttgcttagtgagcatgcatttgatgaatcagttgtttaattgcagtaggccaagagaatgtggcatatccctcccccagtagggatggccttgcaggtgacctcacaggggaaatagaaggcatacgatgacaactccttcaacttcctgatgccacacttccaacatctgtccccttccatgattacttccttccttctggttaaaaagattatctgttcctcctggccaaggacagtccttctacctatgctttagatcccaacccctcctccttttccccaaatcttatactatccaatggcaccaaggatagggcagtgagagcagtctacctggttgcagtcagtaaggcacacagtatctgtagagaacttaaaaagcaatgatgggccgagcgtggaggctcacgctgtaattccagtactttgggaggccgaggcgggtggatcacatgaagtcaggagttcaagaccagcctggccaacatggcgaaaccccatctctactaaaaatacaagaattagccgggcgtggtgctgcacacctgtaatgccagctactcgggatgctgagacaggaaaattgcttgaacccaggaggcaaaggttgcagtgaagcaagatcatgccactgtactccagcctaggccacagagcaagactccgtctcaaaaataaataaataaataaataaaaatataaaaagcaatgatgaaaacgacaaaaaattggtctgctttttactaaaaagtatcactgtgtgcagcaattctaaatgctgtaataaagacctctcctgctgaggcagacagctgcattgcccccttggtatgccgttgctgtcaggtcctcatctctatcgtacagtcattctctctgtctcgtacagtcactctctcagccatattcgtccctcagcagttcatcatgcttattactgtct

SEQ ID NO: 11070 - DNA, 1050 bp, Homo sapiens
tttttggcctaaactacttaatacgtctttggggagattcctaggttgccttatggttgactttgattcacagctgtcaagttgttgagctgttcatactgatcctattccctgatccagattaatattaatagttttcttctcggttttggctaacttctcagagcatttgggtatgctgtgggctcatttactgtgtgtgctttttttcttcacatctgtggtgtcaacatgtttgaaagagaaatagctctgtggcttcaagtgtttctcaaaatgtatcacagggtacctctagccggctatcacagtaagacagtttgtgtctataatggtgcatacctcaaacctactcattgaaaatcttggatggtttcccttccacattagtacagcacaagttgggtcctcatggacaaagggggctctcagtttagtagctattcctttttggcagattacactgcagtgtggctgagggttcagttgcagtaaatggcaaagggtagggagcagcatgacatgtagttcttggaaataatcccctccaaagctgtatcaaagacatgcagtttcagagtaaataggctgcccttatggctttgggtgaaatgtgagaatgcagcaaagaccttgagaatgctcagaaggagtggaaaccttttttatccgcttttacaaaagtcactgcctgaggggaattcacgaactctagaaacaaatcgcagctgttcattgctgaatgagactgtagtcctttgaaattaactataggcctctgtatttctagacactaatgttctcctctgtctgcagccttgacgttgtggcctaatgttcttgatcatattatatgttttatacataataatttcatgattccaaagatacaatcctttctcctaagacttgtattcagcagaacagagtaataaaaaggttctgtacccatttatctcctgttctggggatctctgggtagtatctgagaaggcttcatgtgctgtgagggacatctgtgttgtcaaatagaagaggaattctctcaca

SEQ ID NO: 11071 - DNA, 1052 bp, Homo sapiens
ggaagtgtaacagtgatttattcattcaataatttttaaattatggataaaaccatatatctaggatttaatagggaaggggaatgagtgtgagtatggataaaatgagaatggccatttgataattatagagtgatgacgatagatctagacaaatagatctacctaagaaaagcttttgttgaaagagctaagcgttggtagctttgtagtctgtttttatgtcctgagactaatagtaataggttttgatcacatcagcttgttaatagaattaggtacattggtagactagatctggtcttagcccaatttataccgcagaaagcaacctgacatatgaggttaagatgagtatctgtttttttaggaatcactaaactcattgaatggtggacgtctttcatgatgtactgatgttcaagatgtccacgccagcaatagcctttccagtgtttttagcattgggtattgaccaggcacatgaaggtcacggtttttaacaggaatcttacctgaaaaaattgcattggcagaatagaactaacaactttccattaattactaatataaataggcaatagttgcttgtttgagtaattgtcacctttggaaaagaaaaataccagtaggtctttggaaatctgaaagagcatgccccagaatctgcattgaagcctaatggataatggcgataatgtcagctttcatggcaggaaacaatgcctactatatacatagtctgtccaaacaaatacaatacttatttagaaacacccatgtttattttttttagttaatctggtggtttagcgtctgggaatgtacaaagcagaagggcagttgaaacatttattatttaccctaaggcagcaaattggggagtgaaactatttcatgaatgttacgttagtagaaaaatgaatcaaggcattttaagtacaatccccagatttgtcattgagctataaaacatttatttcatatttcatttgcccatctaagatttgttgctcattctgtcccttctcccttccgtgcctcttttctca

SEQ ID NO: 11072 - DNA, 1023 bp, Homo sapiens
tatttatgtttatttatttgtgtatgtatttcttggttacccttcttcagaatgcaggctctttgccctatttgctcctgggttcccagtgcctagaagagtgttcaggcagtattgttggatgaatatttgaaccagttttggtcagtctggaaatgctctggatacttagttggaatcgccatctccagtgagttgggttttgcatttatttacaggtgtaggccctgcttccgtgatggttgggaatctggttgctggaaaacgtatagcacaagctgctggaagggatctgggacaaatagaagagaatgatttggtgaggaaggtaagtgttcctgaagtgttaccttcttacagtcaagtcaaggacagaacttactgcaggtagcagctgggggatgcattatatgacttgttataagttgctgaccctgagtcctttttctggtttatgacttcagcaccagtttctggcagagatcctacagtggcgagcccaggcgactcctgaccatgtactcttcatgctgttaaatgccaaggtattaaaaattcaatggtatatctaatcagctgactactataggaccatcttaggcactcttgatctctttctttcatcagaaaatttctgttgccatctctgaagaaggagttaatggctttctccttgctttggcatatgagggtaaactgtgcaatcactttaagattggactgagacctcctggagtgctatgtaatactttcttttcttatggtacaatcacgtcttctttattcagttctgataggagaaatggagccaacaatgcaattacatagatacacagatgttcacaatgtgttatgtcatacagtttttttacccagtgggacttttaattatttgatttctgccaggaagaaaatgaccttagaccagcattttaaaaaccctaagttatttctggtacatagttaaatgatttattgctaacagataaaaagcaaattgaaaattactcaaagagcacattt

SEQ ID NO: 11073 - DNA, 1031 bp, Homo sapiens
gcggatcatctgaggtcgggcgtttgagaccagcctgaccaacatagagaagcaccgtctctactaaaaatacaaaatcagccaggtatagtggcacatgcctgtaatcccagctactagggaggctgaggcaggagaatctcttgaacctgggagacggaggttgtggtgagccaagatcgcaccattgcactccagcctgggcaacaacagtgaaactcccatctcaaaaaaaaaaagaaaagaaaaaaattagatgcaagaattttcataaaatgaaaatttaaaatgtaatcataaaaatatattgaactaaactactttaaaaagtgttccaggctgggcacggtggctcacgcctgtaatcctagcactttgggaggccaaggcgggcggatcatgaggtcaggagtttgagaccagcctggccaacatggtgaaacccagtctctattaaaaatacaaaaattagccaggtgtggtgatgggcacctataatcccagctactcggaaggctgaggcaggagaattgcttgaactcaggaggtggacgttgcagtgagccgagattgcgccactgcactccagcctgggcgacagagcaaaactccatctcaaaaacaaaaataagtgttccaggccgggcgcagtgactcatgcctgtaatcccagcactttgggaggccgaggcaggtggattgcttgaggtcaggagttaaagacgagcctgtccacatggtgaaaccccatctctactaaaaatgcaaaaattagccaggcatggtggcacacgcctgtaatcctagctacttgggattctgaggtgggagaattatataaacctgggaggtggaggttgcagtcagccgaaatcgcaccactgcactccagcctgggcaacaaagtgagattccatctcaaaaaaaagaaaaaaaaagttccagaaaggagattaaattaatatctggctggggaatacatagggttaatttagcaagactttctgaagttagggagcttgatttttaaa

SEQ ID NO: 11074 - DNA, 1051 bp, Homo sapiens
tgaggcaggagaatcgtttgaacccgggaggcagaggttgcagtgagccaaaatcatgccattgcactccagcctgggtgacagggcaagactccatctcaaaaaaaaataataataaaatgaaaatagaagtctgcaagggcagccaggcacagtggctctcgcctataatctcagcattttgggagactgaggtgggcggatcacctgaggtcaggagcttgagaccagcctggccaacatggtgaaaccccatctctactaaaaattcaaaaattagctgggcatgatggcaggcgcctgtagtcctagtcccagctactcgggaggctgaggcaggagaattgcttgaacctgggaggcggaggttgcagtgagtgaagatcgcgccactgcactccagcctgggtgataagagcaaaactctgtctcaaaaaaaaaaaagtctgcaaggatccaaagggcagcatgaaagtagtatttggtggtgacttgatgggtcgttttgaagctgagagtaagaatctaggacccattccgcagatcaggaagagttcactgaaggatttggtataatgtcaggctctgtactagacattatttgggatacaaaagtaaataagtcagaggttttgtcctcaaggaactaaccatccagaagtaaatagaaataaacttggggaccacatgcagtgctcatgcctgtaatcctagcactttgggaagccaaggcgggcagatcactggaggtcaggagattgataccagcttgtccaacatggtgaaaccctgtctcgactaaaaatacaaaagttagcctagagtggcggcttatgccaataatcccagctactcgggtggctgaggcaggaggatcacttgaacccaggaggcagaggttgcagtgagctaggattgcaccactgcactccagcctaggtgacagagcaagactccatctcaaaaagaaaaagaaagaaatttggtcctttttctgggctgtaatagaagtttactgtacagtggggtggatggattgtctattgtatta

SEQ ID NO: 11075 - DNA, 1045 bp, Homo sapiens
tagattgtcaacatcacatatagtgtcctggtcaggctgcaactctctccaaagcatgctcttcacatgctttagttcaaaatgagtcattatatctgattgctgcgtggcaggctattctgctagtccttcctttcacatcccatttcagtaatggtgcttgaaattgtgcttcagtgtgtcttataaactttggtctgagagtcacttaagagaaagggctgactgtagtggctctcaccagtaatcccagcacttggggagactgaagcaggaagattgcttgagaccaggagtttgagaccaccctgggcaatatagcaagacccgtctctgcaaaaaaattaaaaacttagccaggcatagtggcctgtgcctgtagtcccagctactcagtaggctgtggtgggaggattgcttgagcctaggaggtcgaggctgcagtgagctgtgatcttgccactgtactccagcctgggtgagagaggggaccctgtctcttaaaaaaaaaaaaaaaaaaaaaaaaactgaaaaagaaaaagaacactgaggtagggaaatagtgtctccatctcttcttcctagtattcatgtctaccaaatgctttctttggcttcctctgaaagaagccagtttcagcaagtgagtttgtgattctttctcctttcaggtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaaggtattcctgcagttaacccttcctacaaatgtggaatcttgttagattcagtgtgcactaaactaggtaagaggagtagtcaggactttcctaacatctacaaatctcttacctcttccaagatacagcgtggtacccacccagcaatacatgatatcttggctctgagagagtgtttctctaacca

SEQ ID NO: 11076 - DNA, 1030 bp, Homo sapiens
aaagttcaatatcaagatgctggctgatttgatttcttctgagggcctgcttcctagttcatagacagccatcttcacatggcagaagcaggctaggaagctctctggggttccttttataagggctctgatcccattcatgaaagctctaccctcatgacctaatcacctcccaaagggcccacataataccatcacattgggggccagaatttcaatatatgaattttgagggggacacaaacatttggtctcttgtaggctaggacaccgcaagaggtgggggagaattgtacaaaatgaggttggaaagggaggcagacaccaaatcaggtaggcttggccatatatacctctaatctttctaattgggacccttctagctttgcaaactcaagatttacctcctccaagaaggcttcctgtataatacataccacattgttctaattattattattttattttgtttgagatagggtctcactccttcacccagtctggatgtagtagtgtgatcttgtttcactgcagcctcaaccttctgggctcaagtgatcctcctgcctcagcctcccaagtagctgggactacaggtatgtgccaccatgcctggctaatttttgtatttttcgtagagatgaggttttgctatattttgcccaggctggtcttgaactcctgggctcaactgatctgccagcctcagcctgcctaagtgctgggattgcaggcttgaggcactgtgcccagccaatattacttttttttcttttttgagatggagtctcactttgtcacccacgctggagtgcagtggtgcgatctcagctcactgcaacctccacctcctggattgaagggattctcatgcctcagcctcccgaatagctacgattacaggcacgtgccaccacacctggctaacttttgtatttttagtagagatggtgtttcaccatgttggccaggctggtctcgaactcctgacctcaagtgaccagcccaccttggcctcccaaagtgctgg

SEQ ID NO: 11077 - DNA, 1084 bp, Homo sapiens
tgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacacctcactgcaaggattctttacttagcttgtttttagatttcttctatatatattttatttatatcccatctagaattcagctaggtgctgctgctgctctgtttcctttgatgacgctttgaaataaaggcaggagtacaagcctaagacttgatcatttcatgaattccattccagatgttcaacttttcatcattttactccaacctcttacaaattttggaatttcggacctaaacttagaaatgagggaactattgattctcctaacttgctctaaagtttggcttgaagaaaaggttctggtatagcaatttgtatacgttgaggatgacctttagtttctccaatgttctatgtggagaaatactgaaaactcatagaatctaggttgccaagatagattcctcagctcttttatttattttttgagacagggtctccctctgtcacccgggctg

SEQ ID NO: 11078 - DNA, 1059 bp, Homo sapiens
tttaggaaagagagagcatttcaagttggtatgattagagacaggttgatggaagaagcatgatttgagctgggctttacagaatggttgggtagaacagtgtgagccaaagtgagaaggcaagaatgtacaaagtgttttgggggagcagtgagaatctccttgtggcagataagcctgcaaagataggatagagttagccaaatattaaggactttttgaagtttcattcataacatggagaatgtagaatttagagagtatagaatgacagatgatcaaagctatactgtagtgttttaggaatattgggcagcagtgtctaattggatggaatagagcaaggaatggacatccacttagttggctctttgatttgtcccagctgtgtagtgatgaagggttggagtagtgtagtggttataaggatgggaaggaaggaaagtaaatataactttgtatatgtgtgttacatgaatgtgtgtgtttaacgtttttctaatgttagaaatagtttataggaagactcagtagaactcagtgaatgactttacatgggagaaaagggagagggaataaagattattttactgttttaaagattagagatagagagtctcctattttgaaaatctggggaagtatgttctgtaatccatggtagtctggtccatagcattttggttaacaagctgtctttatttctaattttctaattgtttctctgcagagggttttcttgagcttttaatgttatttcttgtaggaaaacttgaatcttctgaactttattatctaagctctcactgataaagattatttaatcttcgtttgtgggtctctacccttgttttggagttttacattctgtccattcatagacacttaacttgtcattttcgttggcattctcaactcaccttcagtttggaggataaaggaacaagaattctatacctttttatagacttggtaaatgactcttttgtccttaccgaaactcagtatatttgattttttgattgtttgtttatatcccatgtgcttcatgacagccat

SEQ ID NO: 11079 - DNA, 1031 bp, Homo sapiens
ctgctatcaattatttttcagagtcattaagtaatggatggagcagctctgtccaaggattttagttgaatacagtgggagatacagggtagagtgggcttacttcatcttatctggagtgagaaactttggttatttgagagaggaacaaggctggcaggtgtgagaaaggtggtggctttgaggcaggttctcaaccttgagagatcaagtgactagattgacaggcctcgaggtcctgggaggagacaccctgaggaatgacttcagtatttttgatgcaggatgccctctcctcctcctttttaatttttaaatttaagtaaaatgttttttaaaatatataatatctgcacttagcaccagattggaaagctgtaaagggaacaaagtaagagaggtaagtcttcctcagttacctacctcctagccacacagttcctttccctggaggcaaccacttcccagtttctcatgtgtctttacagagactttgtacttattaccaaactggaatatggataagtgtgcatatattaacaaaaatggcagtgtactgtacacactattatataccttactttttctcttaatatgtcctggaggcctttccatatcagtgtccagagaaggcctcgttctttttagcagctgtgcagaatgccattaaatggatatactatcatttatttaataagtcctttattgatgggcatttatttcattaatgaatattcagtaaataaatatttattccattaatttcaaactctccttattatgggaaagttgcattcaatatccttgtatacatattttgcatatgtgaggctatatagaataaatacctgggattagaattgctgggctaatgatgtgtgtccatttaaaactgttaatagcatattgttaacttatttcatatcactacaaataatccatcaacttttaagccttgatatggtaaggaatattagaataggtaatagaagccttcatataatcttaaatctttattcaaactcaggtta

SEQ ID NO: 11080 - DNA, 1033 bp, Homo sapiens
cacagatacaatttgcaaatattttctctcattctctgagttgccctttcactctcttgatagtatcctttgagcaacaaaagcttttcattttaataaagttccatttatctattttttcttttattgcctatgcttttggtgtcatgtctaagaaatcattgacagatccaatgttatgaagcttttcctctatattttcttctaagagttttatagttttagctctgacatttaggtctttgatccattttgagttaatttttgtgtatggtataaggtaaggatccaacttcgttcttttgcaagtgaatatccagttttgccagcaacatttgttaaaaagattgttttccccattgaatggtcttggttcccttgtcaaaaatcatttgaccatatatgtgagggtttatttctgggctctttaatctattccattagtctatatgtctgtctttatgccagtaccacattgttttgattactatagatttgcagtaagttttgatatcaggaaatgtgagtcctccaactttgttttttttcaagtatgagacaagatctttttaattttccccttaaatcttttgtagatatggggtctcactatagttgaccaggctggccttgaacacctggcctcaagcagtcttcctgctttggcctcccaaaatgctgagattgcaagtgtgagccactgcacccagcctgagacaagaccttagtgctacttgctaccttttatttgatcttccttccaacatatttttttgtgtgttctagcataaagtgtttgctttatttatgtatttattgagacagagactcactctgtcacccaggctggagtgcagtagcatgatctcagctcactgcaacctccacctcccaggttcaagcgattctggtgctttagctacccaagtagtttggattacaggcatgtacaccacgcccagctaatttttgtatttttagtacagatgggtttttgctgtgtcggccaggctggtttcgaactcctggcctc

SEQ ID NO: 11081 - DNA, 1027 bp, Homo sapiens
tatgaaagaagagattcatacattcaacaaacatgtatgaactgtctaccttgtgccagataggcatcacattatgtactgtgcttgctaagctgagaaaatcatagtagatggaagataaacccctccccttcacggatctcagggtccagtgagagatactggtatgtaaacctcaataacaatattctgtgttaactgctctaatagaagtaagtacaagtgttatagggacacacaggagggaaggacaattctattgaagagagttgaatggggctgtcttcatagaggatgtgatctttgacctggacctttaaatattaaagtatggttaaaaaaaaattcacctgtcagagaagagatgagagagtagttcaggtgtgaggaacagtgcatataaaggccgagagacatgacacaggtttaattgtttaaaatagtgagtgtagctgtaactgaagcatagagtgtggtttggtaagacaggagataaagcctagaggcaggttggagccaatgagtgcatcctaaggggttttgttttctctcacttccagagttcccaggttggaaataacctttgggacccattttgagctagtgcagccttgctctggattcttgctctaacttgtgcacaagtgtccttcctgcaggcttgtgccaagtatgtggatccaaattaacagaaatattagccccttcttgtcatcttcttttttttttgagagagagagtcttgttctgtcacccaggctggagtgcagtggcacagtctcggctcactgcaacctccgcctcccgggttcaaatgattctcctgcctcagcctccctagtagctgggattacaggtgcacgccaccacgcctggctaatttttttgtatttttagtagagacggggttttgccatgttgaccaggctggtcttgagctcctgacctcaggtaatccacccgcctcggcctcccaaaatgatgggaatacaggcgtgagccactgcacctggccagccccttcttg

SEQ ID NO: 11082 - DNA, 1086 bp, Homo sapiens
acaattatcagtccatgagtgctgtgaagaaaataaaacaggatgctgtgccatagtgtgcctggagctgccacttcacctctctatcagcttcattgttttatctgtaaaatggggctaatacagtcttgttatttgtggtagttccataaagttgaattgtagaactgaattaccaaatcttcaaccattgctcctaggggaaatacagggctaggttcctgcgagcctctggtcactttttcaacctgtcaatacataaccttattttatgtgtttctttttttttctttttttgagacagggtcttgctctgttgcccaggttagagtccagtgacatgatctcactcactgcagtttctgcctcccaggctcaagcaatcctcccacctcagcctcctgagtagctgagacctcaggtgtacaccaccacacctggctaatttttgtatttatttactttttggtagagacagggtttcgacatgttgcccaggctggtcttgaactcctgggctcaagcaatccactcacctgggcttcacctgctgagattacgggtatgagccactgaacctggcctgtttcatgtgtttctgtttatttttatttttaatttttatttttttgagacagtgtcctgctctgtcacccaggctgtatagtacgagagtgtatcataggccaggcacagtggctcacgcctgtaatgccagcactttgggaggccgaggcaggtggatcatgaggtcaggagttcgagaccagcctgacaaacatgctgaaaccccgtctctattaaaaatacaaaaattagccaggtgtggtggtgtgcctgtaatcccagctactcaggaggctgaggcaggagaatcacttgaacctgggaggcagaggttgcagtgagcggagactgcgccactgcactccagcctaggcaacggagtgagactccgtcaaaaaaaaaaaaaaaaaaagccaaaaacatcatagctcactgcagcctgaaactcctgggctcaaggaatcctcctttgtcagcctcccaagtggctaggatcacacgcacatgccaccatacccg

SEQ ID NO: 11083 - DNA, 1034 bp, Homo sapiens
ccatctctactgaaaataaaaaattagccgggcatggtagtggcagcgcatgcctgtaatctcagctactcaggaggctgaggcaggagaatagcttgaatccgggaggcggaggttgcagtcagccgagatcacgccactgcactccagcctggggaacagagtgagactcctcaaaaaaaaaaaaaaagaaaagaaagatcatcaggcacatcaagcatgttagattctcataaggtgcatgcaagctagatgcctcgcatgcgcggttcaccgtaggtttcccactcctatgagaatctaatgccgccgctgatgtgacaggaggcagagctcaggtacccgcctgccacttacctcctgctgtgtggcctggttcctaacaggccgtggaccagtaccggtctgtggccccaggggttggggacccctgatccaaagggtcccttgacacatatttattgagcacctgtcatatactaggcattgttgcaggtgttagggatacagtagtaaacgaaaggagacaaaattgccttctctcagaaagcttaccttctgccaggtgaggtggacaataaacaaaagtataaaatgtaaagcagttgtgcctactacagtccaccttctgctcctcacttccccaagattccccatgtttggtgtacacacacctgcttcaggtattcagtcaaatgctagtctttgtagatagaattaaggtctcaatcagttgacctttagccatctaaaggaggttatcatggtgggtctgtcttgattgaactagccctttcaaagcagagagatttctcagctgattgcacaagaggaaatcagatgttccagctggcttggaagcaagcagacgtccatgttgtgaactgccgatcccaacagccacatggcaaggaactgcaggcaaactctaggagctgagagtggttcccagctgacagctaggaggaacatggggacctcagtccttcatctgcaaggcagtggatcttgtcaacaaccagtaagcttggagg

SEQ ID NO: 11084 - DNA, 1068 bp, Homo sapiens
agctacttgggaggctgaggtgggaggatagcttgagaccaggagattgaggctacagcaaaccatgattgcaccactgcactccaccctgggtgacagagtgagatcctgtctcaaaaaaaaaagtttacacacaaatggactttttttctgcttgttggaactaccacaaactatgaggagttcaggtgacaattgtaataaaagcatctgatttgctgaatgtttactatatactaaagtattatgctaagcacctgtgttgtatcatttactctatgtagttattctttgaggggctaggggctcttattcccattttacagatgagaaaactagggcatagagaagttaagcagtgggtccaaagtctatccaagtccaaaacatgtgctctaaatattgtactgtgctataaactgtgagtactgtaaaagtgaccttctaaccaggctctctgccttcaatctcccatttgttttccatcctacggctagatctaactttggaaatgcaccctgtttgtctgacctagaggttgtgtggcttctaggatcaactctagaccccttagcttagcattgcaatcagtttcatctggtcttagtctccctgactcttcttgcctttggctggaaccttggcattgttcgaactgtcaatttactctgaacccagtgtagctaatattttttcacagccctttgctttcccttttccttttctctggaatgcttctccccacttctcttcctagccaaacccagcgtcctccagtgtggaccttcgtcctcttgtgttctcccggtcagtgattccatcctctctgcttttcccctcagcctgtattggtagttggagttgcactgtttatagttgtcttctcccactctccatgcccaaagaattggtgcggggagctggcttatttgttatatggcttcggcctgcacagagccttgcatgtttcaagtacttaataagtttgtttaattgaattaattcatttcttttccatcctctcagtaaaatcctaggtaaataattccaattctgttttgctctaat

SEQ ID NO: 11085 - DNA, 1063 bp, Homo sapiens
ctcacttaattctcacaataacttcatgagggaggctctcaagttctctttggaggatatcatttttgcccctcgtgaatgagaggggcacctgacttggacttctaaaggcaggaggacaataatggagtggtcagggaaagcttttcaaaagaagtgacatttgagttgaattttgaaggatatgtaagaagtaggcaggaaaaaagcattgcagcaaaagaatgtgtgagagcatgcatgctgcaggaagccgtgggtgtgcttggttcctgctgggggagatagggctggtgatagctccaggaaccctaggtggctctgcatgaagtggggggcagccccacattctccaaaaggaagatgctttcctcttgtcaggcatctcaatttgaagaaaaggtagttcctctgtctctcacaggcataaagtagagcacttagaggataatagtggagcttcaaaagccttgtttgtgagctaaataaacaggtgaagttgtgctcagttaaggatatctttttggccccatctctataaaaactgttttggaacatcaagtatgctaagggattatattctaagtttggaaaaggacctgcaaaagatctcaccattgatgtcaatgtctgctccccaatttcctgcagctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtgagtgcatgcccttgttgggctagtggctcagcttggagatagggtaccccgtcatttcatttttttctactcttgcccactcacttggtttgacgataaagatgccttttggatgttcccgaaggtgacaaaggctggggtttctcagcagttgcttttgtagattaga

SEQ ID NO: 11086 - DNA, 1034 bp, Homo sapiens
ggcacggtggctcacacctgtaatcccagcactttgggaggccgaggcgggtagatcacctcaggtcaggagttcgagaccagcctgaccaacatgatgaaacccccatctctactaaaaatacaaaaattatctgggtgtggtggcgggcacctgtaatcccagctactcagaaggctgaggcaggagaatcacatgaacctaggaggtggaggttgcagtgagccgaaatcataccattgcattccagcctgggtgacagagcgagacaccatctcaaaaaaaaaaaaaaaaaggagtcttgaagaatgagttggaatttttaagagaggcgagagggcaaagaacattccaggccaatgaaaataccttgagtaaaaagacaaaggcatgaaggtccactgtatgtttaaagaacttttatgatgaggagaccagcatgatgtgcttgtgctggggaagcagggggacgtcaggctgccccaggtgtacaggatcttgagggctgacctttatcttctaggtaaggggcttctactgaaagtttccatgtgggaaatgaatgttcattttttcctttggaaggaattctggcagtggtgtggaggatgaattcattcactaccagccttctgttgggaagggtggggtgaggcggggtgtgtgtgggtgcacagggcaagagcaggctgagatgggaggcaaaagacctgttggaagtcttttagagaaggtccaaaagtaggacaggcggacggagatggagaggcgggggctaatttgagaaacattttggtggttctatactgttgtcattaaaagcatagattatagagtcagacagtcctagattttaagccctgctttgccacttactgcttgtatgaatttgaatattacataacctcctctttgagccttagttttcttgtttataaaatggggatgataacagcgccttaccttccaggtggtttggggaagtgagataatttatgtaaagcccttagcatggagcctaatacatagtaagc

SEQ ID NO: 11087 - DNA, 1234 bp, Homo sapiens
tgccttggggaggtctatgagcacatgcagtgcctttgtgcgtgttaggagagctaccccctctggaaggactgaatgagaaaggaggtttaaaaaagaaagaaagaaaagcgactccctccagttcgacagatcaaagagaggatccccctctcggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtgagagccactgactgtctgcccagcccctttccctgatacacctgcctgtgaaccaccctgatcgctcttcgtgcccatctgcctgccaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccggtgagtgaccagcaccacaccaggtccaagggaatgggcgtcagggggttgactggttctcaggagggcactgtcccagggagtttggtgggccgggatctagcactttctgggcccctgcactgccccgggctcatgccagcagtaaagtagggaccataggaattgcagatgggctcagctgcatccagctctaaagcgcaagacagcctttggtcccagactgtcaggatccagactgcaggtgtcatgtatgtggcctagggtattggcttgtttttaaaaccttcctgtcaattatgctgcatatagaaaagtacacaaatggtaaattttcataaaccgcacttacccaaccagcgccttggt

SEQ ID NO: 11088 - DNA, 1931 bp, Homo sapiens
agtaataagccagttaccgcttgaatctcagtttctttatctggaaagtggtcattatttatctgctgtccccttacctagagggaatcaaatgcgtttgatacaggttaacatttaaaatgctttcaaattgggcagggtgcagtggctcatgcctgtaatcccagcactttgggaagctgaggtgggtgaaacacctgagaacaggagttcgagaccagcctggccaacatggtgaaacccagtctccactaaaaatacaaaaattagcggggttttgggctgggcgtggtggctcacgcctgtaatccaggaggcagaggttgcagtgaattgagattgcaccactgccctccggcctgggcgacagagcgagactccgtctcaaaaaaaaaaaacaaaaacaaactttaaaattggaaataacatatgtaagctcatgcacaggcctttcatttccataatgcttcaaaatgcagtcctgtgtgacatcttatttgattatttttatagggagaagatgctctgcagtggttgttttcatacactgctgactctcacagtgaaatggttttaaggggtgccattatatattgcttacagattccctagtgtcaagttccatcctctatcatgtatatgttattctgtgagtaagatacccagaaggccaaaattaaaactctttatgaaagtttaaatacaaatacagaatagtgtcaattaagataaagcagtgtttctaagtaatgtcattgaaaaaagaggtatatttcatctcaaaacattctggaattctcttttcgtgatggtagaggaaataactgaacttgagtacagtattttaagtaattatttgtaattaggtttgccttatgtacatttatgagccagtttcttaaatttgtagtagatactgctatggtcctgatagtgggaaagtaccaaatcaagaagtttaacttgaatttgtgtacctcctgtctcccattttgtgtaatggttagcatggcatgcattgggcacttattttgtttgattatgtatatgatcaaattgagtatccctggagggataaggaaaaggtagtatggcatcttctgtcaaaatgaagtaattgggcacagagaggtcatgtaactgaacccgtacgggggtcaagatggtggagcttatgagttttgactcagtctttactatgctaaacttacccaatccccaactaaatcaaaaggtggcttgcactgggatctttttgactttacaatgggtttatccggatagtaaatgcatttttttacttgagaagggtttatcctgacagtctcatcataagtcagggagcatctatatagtgcagtaaaggtgaaggtgaaatattgtattacattgcatgaaatgtcttttcatggctgggctgtaaacaccaatataattagtctaattctaggcactctgggtggatcgattgtgtttatgcaatgttgttggtttagggaaacatttgttattcattatttaaagtagcttttgttttgtttgtttttgtttttgttttgagacagagtctcactatggctcaggctggagtgcagtggcgtggtctcagctcactgcaatctccacctcctgggttcaagcggttctagagatggagtttcaccatgttggccaggctggtctcgagctcccgacctcaggtgatcttcccaccttggcctcccggagtactgggattacaggcatgagccaccacacctggcctaaagtagcttttaattatggagaatgtggcagaactcacttttagtaacagctttattcaatgtaatttgtataccataaaatttacacttttaaagtatacagtttggaccgtgtgcagtggctcactcctgtaatcccagcactttgggatgccaaggcaagag

SEQ ID NO: 11089 - DNA, 1033 bp, Homo sapiens
gccattatctcactactgtactccagcctgggtgacagagcaagaccctgtatgatttggtggggtttagtatattcagagatgttcaaccatcattattatctaatttcagaacctttttatcacccccaaagaaaagtcctttatataggactaacaattccttttcatttatctttttatttattgaagtgaaacatcacttagaacatggttctcagctaagggacagtcttttcatcccaaaccctcatcccaccccagagcatttggcagtgtccagagacgcttttggttgtcagagtggaatggggatcggggattactattggcatctaatgagcagaatcagagataactgctaaaatccccccatgacaaattacctaagctaaaatatcagcagtgctgagatagagaaactctgagttaagaagtaggctgtatttattttagtatctattataacaaatcctgtttattaagaaaaccatgaatgtgttgtctcttgtttaacggcttctggacttagcaatatttccgtttttaagatcttttattaaacctgtatgggtatataaagagctggaggtgtgttttccccactgtagaccatgtataaataattgggacaggttttgttttgtgaggtgattgatttgttaactttttaaccagttcacataagatttagagaaaattaaagaattggaccagttcattgttgaattgcaaaggattgataaacctggagcattaaacagtgctttacttataaagcagagggaacactgttgaaatctaaacatgtaatgggcctaggtattgagggagcaaagggcatggaggatttagataacatcttttctcagttaactggaatgaaacggagtggaacaaacacgggcacctactttaggtttattgattttgctttccaagggctaattcctttaaacctgctgcttatattttgactgagtcagtgctgctgctacagttaaataagttgaagatcttgtaaggaatttta

SEQ ID NO: 11090 - DNA, 1052 bp, Homo sapiens
gataaggcaatttctagtgccatttgtgccatatttctgtagtcctattttgccatatgacatgattgaaatcaacacctcttagaaatagttttgctgcctcataattgattaccatcatgataacctgtagtcagtgtgaaatagagataaaaattaatgtacttagttaaatgcatatgaaggtctaatcttgttccagagttactcttactggattatttttagatttttattaacattactggtctctaactttactcagtctggataagaaaaagaataccatgcaattgttaactatttgatgtttactagattaactattaatatattgttgtggtccatagttaagagttactttgttactagagatttcattatagtggtgtttaatatagttttgggtatttttaactaaaaatcattgttatccttcaactgtagattctactatgaaatgaggaaaaatcagcaatagaattaattgggttcaaagtatataaataatgatgtgggaaagggaagtcagagggtatctctggaagaactgatttatctgaaggtaatactgagtgaaagaacctaagattgtagacaaagcatgctttatgcaattttgctggtacatagtagtagtagaggctctataaatgtgttgggtgtttttgtttttaagagacagtgtctcgctatattgcccaggctggatttgaactcctgggcttaagtgatcctccagcctcagcctcccaaatagctgagactgtaggtacatgccactgcacctggcttctataaattttgataaataattgttgtggcaccaaatatgccttttattcagctagttatgtgagaattatttttaatttactacacttgacaaattaccttggatagttaaaaagttaattctattctgtgaaattaagctttgtaaaaatagtataattgacctaatattcaaggccagcttaaatttgtttaacttttaagtcttttaaaggactctttagcccacaaattggagtgttagctagattacagtg

SEQ ID NO: 11091 - DNA, 1007 bp, Homo sapiens
agtggtgggcctgcctgaatctacagtaacagttttcaatcagttttgccccacaggggacttctggcaatgtttgaagacattgtagttgtcacaattggagggagtgctgctgacataagtagaatccaggggttaattctatagggaataggacagtccccatcaacaaagaattatgcagcccaaaatgcatgtcaagattgagaagactgattgatctagatgaacattaaatagatgataaatagattagctgcctaacagcacgttggtcacaaaggggacctaatttgtatatgtttcagggactcctggcccatacagaatttgagatagctaagcattaaaccaataggaaaaaacgggaggaaaagagccacctggggttgaattggagcatgtacttatggggcctgaggtaactgggatgacagtgtgacgtgaaagtgaaaaatagggtaaaatgggggttttctatgtgtgagaaatattgggcaaagtttttatgagataacttacggtttttgttttaatgtatctgtagacagggatgatcgttcttttggccgtgatagaaatcgggattctgacaaaacagatacagactggagggctcgtcctgctacagacagctttgatgactacccacctagaagaggtgatgatagctttggagacagtaagtttgtttttatgaagttagcttcctctgtgctttgggaggctatttagtaataggacaaatgtgttacagatgatcagatcacattaacagatagaaggaggaaagcagattaagaaaaattttggatagtatctgaaagaactgatagatgcaggaaacgaatttgataaattaataattttttttgaaaacttaaccaaacaaagggacagacatttctctttttttggagacaattgtttataaagaaacccaaactgggcatggtggctataatcccaacgctttgggaggtcaaggcaggtggattgcttaaggc

SEQ ID NO: 11092 - DNA, 1034 bp, Homo sapiens
ttatattctctgtatcttttgtatatccaaaatatttaggacaaacaatcatttttagaaatttaacttccttgaaacacttaggtttctcttgaaagtgttctgacaacttgaattgaggaagaaatcagactgcctgccttaagagtttatttgttcagtgttacatgctttgccccatgaaccacctgccaaatttatattatacacagagacaagggtataagatctagagtcttcctggctgggcgtggtggctcacatctgtaacagcactttgggaagccaaggcaagcggatcacttgaggtcgggagttcaagaccagcctggccaacatggtgaagccccatctctactaaaaatacaaaaattagttgggcatggtgccacgtgcctatactcccagctactgaggaagctgaggcaggaaaatcagggaggcagaggttgcagtgagttgagatcacaccactgccctccagcctgggtgacagagcgagactgtctcaaaaaaaataaagaactagaatcttccctatcatattgtattagttcttaacatgcagatttcggagcaagatactttcatccagtagtttaatgatggtcaaaaatttcttcccatataaaagaagtcttgatagattattaatttattacttaaatgtttaccatttttagtctttcctgtggtcttgtactacatcatggatgtggtagaagagtaattgaacttgggtttttttgtttttttttttttttgagatggagtttggcacttgttgcccagtttggagtgcagtggtgtgttctcagctcactgcaacctccgcctccccggtgggttcaagcgattctcctgcctcagtctcctgagtagctgggactacaggcatgtgccaccactcctggctaattttgtatttttagtagagatggggtttctccatattggtcaggctggtctcgaactcctgatctcaggtgatccgcccgcctcagccccccaaagtgctgggattacaggcgtga

SEQ ID NO: 11093 - DNA, 1031 bp, Homo sapiens
gggggcctggggggtgggggaccaagaggccagaggggaggtgcccttaaatagcgcaacctcagctggagcctgtgcccatccactgaaggcccctccaccttcctcctgaagctgaggggctgccccatcctcaagcccacgagagcccttcaccaggagctcagttccttactcggtccccttccaggtgacttcagcctgtcaggccttgcctcccgtggagttggtgagtgcgctctgggatggggtggggagggcaaggaacctggccatggtgtccagaggtctggtggctccagagagggcccccaggagatgaccttgaacggagtgctgtgggtattgctcatcctatgaggaaagaaaaaactgtctgagtcctctgctgatcttgtgcccttgggcctgctgggggtaggactcctctccccttatccagtacagccttcaaaaggacactgacattcccttcccctgtccccaaggcccacattggtccttgcccctgctgtaactaaccactcccttttcctcccccatctccctctagcggcgaaacacggccccagtcaggcgcatagagcacctggtaaggtgatgctggagcaggagggggaagcaggtagctttgggagtaaggatctagatttcctgaagacaaaaagggcatggctctggagtgggcagtctagagtagggggtacccaaagagatgtctagacactgtctgttaaccaccagggatccaccaaatctctgaaccactcaaagcagcgcagcactctgcccaggtaagtgagggtgctggggtggtcccacgtgaccccctttccgccggccccacacctcagcccagggcactgccccgcaacagagctccccgggacagccccccacccccaaagcggtattctccctccagaccgatccacccaccctcaggacccagcaggcttcacctgctgcccaacagacagccttcccgtcacactagccacctccgggtgccccgcccctgcgttcatgcg

SEQ ID NO: 11094 - DNA, 1043 bp, Homo sapiens
ttccattcctgagatggcaaatccaagcaactttccttttggcagagttcctccataggaggccccaattacttttgctcctgttggcttccactccttgcccaggagaccagttcctcctattgacctagaaagaaaactcttcttgactcatgtcctcgttctgagcttcacagagagcgcccagcaaaaaaaaaattcatatcgcacgttgtaatggcctgaagatgttgcatttagcagcccccctcttcctttctggtttcaggtttctgaaacagatcgtgagcttcatcaagagaattcaactggaaaaccaagactggtagactctctttttcttcagacaataggcaggagccaggcagagtccagggattcttggaacacctatcttttcttcggaggacactaagttctatttgaagacaaagttcaatatggcaacaggactgatgggacacgaaggagtcgctaccgtgatttggtgacagttcttcaaaacgacagtgtctcaaggaaaggtggacctaggaactcctgaacttttgggttgccttaagtgagaaatcagcatggctcaggtaaaaagctctagagtcctcctccaagataactgggaagcctgtttgcagtttcactcttgaatgctgccttagtcaacatattgaccaaccccagtgatccaagctctgtattaagcaccagggggagatctagaggaaggaaaggagacaggccacagcccctgccttcagggagcttccagtcaaatgaaggaggtaggctatactgcatcacaggcactgatgggacatttgcaaagcaacgtgtactcagtttacatttggtacattaagtgctgaggggtgtaagggagtgaatagtacggtgaatgcttcttttgtttttttccaacaggaatttattgagttcctgttgcatgcaaggcattgtgctgggaatacaaagatgaatacgattgtccttgtccccagtgagcttccaggctagttggggtcgggagagggatggaaagccat

SEQ ID NO: 11095 - DNA, 1049 bp, Homo sapiens
atgggctatgagtttagatttgatttgtcttcaaagggtcaccgaaaagacagtgataagtcccggagccgcaaagatgatgacagcttgtctgaggcctctcattcaaaaaagactgttaaaaaggcaggtaatggggtgatcccccaaactcatacagtttggtaatggggtaatattcctccttcttccctctaccatgtaacctggagctttccctagatgctttgatctctgatagccagtgagtgagtcccccagatttcatccagagactaccttggtagttgatctcctgccttgctggaacagtaatggtacaggttggggagcatgagatcccagatcccgaggcatgggagcaggcaggctccagctcaagtcatactcagactgctgggtttgacaggatagacagcttacccactccacctccttccccaaagggtctcttacctccatggagtacaggagatggcagcacctttagacagcatcagagaggttcctttctccaacagctggaagtggacccagagtagaacagtgtctccaggaagagggcagtggtggcctcatgacatgcctgattattgcccccaggtggtggtagtggaacaaaatggttcttttcaagtaaagattcccaaaaattttgtttgtgaacactgctttggagcctttcggagcagttaccacctaaagaggcacatccttattcacactggtaagtctcttgtttatattcaaaagggggagaatagtctatcgcttgtattccatgtctgtttgtggctctagttgggtttattttaatgggtaagtattagaaatgaaggaagaagataagtcaatgaagcagagagattgcatggctttgtatctggtgtcactgagaccagcacctttggggacctctccccatttatgatcacttaggtgtctacacattactaagagttaaagtttctgagaaaactggaatgaggtccctactgtacatacctccccacattcacttctctgtccacctgggccaggtgagaagc

SEQ ID NO: 11096 - DNA, 1045 bp, Homo sapiens
acatcacggagctgaatctgccgcagctagaaatgctcaagaaccagctggaccaggtggggacgggccccagaggcacctctttcctgctctacatcccccttgcccacgcgtacttctcgcgcccggttccaagttggcagcctacctttcccaggcgaaacctctatccgatcccaggacctgccccctccccggccgcgctcctttctccccttagtcctctcattgacccgctatcccggtcctctgtaggaagtggagttcttgtccacgtccattgctcagctcaaagtggtacagaccaagtatgtggaagccaaggactgtctgaacgtgctgaacaagagcaacgagggtatggggtaggcgggtgagggtaacctaaagtggcgaacctgcttctctcgtcccacctcctaacccagtttttcttacctgaaacgagaaaatccattacatatcgtataccgcttcatgaaccctttgcatgttgcctgcctagaattgaaaagtacaggacattcctctgctcctattgcccctgtttccgttcttttcacactgtctgtgggtgctgtgccctgttggaactctctttaacgtcttacgttggagccgctaaccttccccaggtgtttgtcttcattgctttcacagggaaagaattactcgtcccactgacgagttctgtatcctttccacaggaacggctacctgctgccttctccctttctccttcactcccccaaaaagcggggagggggattgttttgattacttcagattaccctctcctcacaatgattttgaggataccctttttttttttctttcttttttgagacggaatttcgctctgtcgcccaggctggagcgcaatggtgagatcttggcttactgcaacctccgcctcccgagttcaagagattcttctgcctcagtctcccgagtagctgggactttaggtacgcgccaccacgaccggctaatttttgtattaatagtagagttgggggtttcaccatattggccaggctagtct

SEQ ID NO: 11097 - DNA, 1046 bp, Homo sapiens
atatgagaagacagtcttcagaccttttccattgctcctatttattcattccagtggctttctctttataaatgacgtcattgttaaatcacgttgccttgtgtaatggggccattttagttcttaattaaataacaagagtgccttctgtttcagaaacgtttagtatctgttctatctccctttccctttgtttcattttgtaaagtagcatgtaaacgtgcaactaataattctgctcatgacttgcttttttttaccctctttgaaaatgttttaaaatgtaagatgaacatctgtaggaaagttattatatcatgctttttaagttactttttgggtgtctgtcaactttagtagataataattagttgagttttttcattttactatttaatagaaaagcaagcacattatttttcatatttcttacagaaagtgttacaatagtattattatccttttctttaacatttagcagtatgcagggcctggtatgctaaaggattactttaaaatatatttgcccacactgtgatatgactatattgttaatactgtgttagactttaagaattatttcccttagaagactgagaactttttttttttaagtaatgtctttttttttttttttttttttgagacggagtctcgctctgttgccaggctggagtgcagtctccacctcctgggttcaagcgattctcctccttcagcctcccgagtagctgggactacaggcgtgtgccaccaggcctagctaatttttgtatttttagtagagacggggtttccccatgttggcaaggatggtatccatctcttgaccttggtttccacccgcctcggcctcccaaagtgctgggattacaggtgtgagccactgcgcccagcctttttttaagtaatttcaacttttattttgtttgttatatgatcttgagatttgggatacaaatgatcttgttacccgggtccggtcatgagcatagcaacccaacagtttttccaacattacccccgaccctcccctatctagtagt

SEQ ID NO: 11098 - DNA, 1043 bp, Homo sapiens
gtgtgtgtgtgtgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaattaagttttgggtaagtgtgttgtttaatctgaactatagtaacttaatactctaaacaatagttcactccatttggtcctttctccacagatgtaattatgttttcaactcaggaactatggcaaggaactttccccagatcaaattctattaacgctgagatacaagtcatccatgcacagccactatcataccctttattctcactgaaaggcagaactcagaacctgttattttatgtctgtaatcatgtactttggcatcttttggaggaaaggggcaggataactcactggaatgtacagtattttgctagtgcatttcaaggaatggaatcttctccagtatgaaattaccagatataaaataatgtaatgatgctgaggatataagcttttagaaggtaatttgatggtatttctttctcgaatgaaaagctgctggtttaccctcaaccctattcattagcattaccatgagtgaatttatatctaattatttccacttgccctgttctcttcacaccaaggaagctccagatccagtatcttgt

SEQ ID NO: 11099 - DNA, 1050 bp, Homo sapiens
tcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggacttttttttttttttttttggccttttgtacaaagattagtttcaatgtagtctgtagcctcctttgtaaaccaattaaaaagttttttaataaaaaaccatgtctctggtgtattgaagagggttgggaatggtgagagtgtacgtttgtaacttcatactctgaacctaacaaaggtttccagctacactgtgttgtgctccatacatgttaattagtgcaattgccctatatttaactcccgggtaaatggtttcatgaccagatcaatgtgccacaactacacggaaatgtggaggaccaagacaaacaggcaacactaactttattttttttctcatatgcttttttattttggaataattttagatttacagaaaagttgtaaagctagaacagagtttccatataatccttacccgtttccctcattgttaacatattaccatggtacattgtcaaaattaagaaactgacatcgtggccaggtgtggtggctcacgcttgtaatcccagcactttgggaggctgaggtgggtggatcacgaggtcaggagatcgagaccatcctgg

SEQ ID NO: 11100 - DNA, 1050 bp, Homo sapiens
ggcatggtggctcacgcctgtaatcccagcactttgggaggccaaggcaggcagatcacatgaggccaggagttggagaccagcctggccaacatggagaaacctcgtctctactaaaaatacagaatgagccaggcgtggtggcacatgcctgtaatcccagctactcaggaggctgaggcaggagaatggcttgaacctggcgggtggaggttatgattgcgccattacactccatctcaatctgtgaggcagacgttcagtcagaattggagctcagacagtccggcttctgagtctgtgctcttaacccagtggcttccaggcagaagcagcagtattacaaaggcaccaagttgtaaaaagtgtacgatgaaagttaggagctcctgaacctgagttcctgaaagcgggaaatgaggctgcagttggggacatggggctagaggaaggagtggacttaagagatgtttctgaggtggaacccatgggtttgggcactgagtgtaaggcttgaggaggaacagggaagaaggagtgttttgagttggctatactgcatctatagctttccctggaaagagttctatgaaataaatgcctgaggttttatattttacagctagcttctaatttaattagaaaatccatggccgggtgcagtggctcacacctgtaatcccagcactttaggaagccgaggtgggtgagttttgctcttgttgtccaggctggagtgcaatggcgtgatctcggctcaccacaacctccacctcctggattcaagcgattctgcctcagcctcccgagtagctgggactacaggcacgtgccaccacacccagctaatttttgtatttttagtagagatggggtttcgccatgttggccaggctggtcttgaactcctgacctcaatccgcctgcctcggtctcccaaagtgttgggattacaggagtgaaccactgtgcctggctctttctttctatttcacattgttcctaatacaatttggggggtgggaggaaaggaatttttgtcctcaagcc

SEQ ID NO: 11101 - DNA, 1043 bp, Homo sapiens
accccagcctgcgtggaaggcatctcagataatgccttttcagtgagggtgttgatctaaatcttttagaaatcatttggtgttagccatcaacggttgaaatttgtaatgtgggatacatctcaatttccttatctacaaattgctactacaaagaaaatttacatgtgttctctctagttttcaacttaaactgctccccagcagggaaacaaaaggtcatttgccctcgctgtagttggagatttgcactcatgatttccaggtgtttctgaattctttgaagctttttctgctgaaggacaagtggtgcacgttcagcagtttccttagaaccattgccaattgaaagaaccttgttcatcctgagagtcagcggaaaccctgtcattaatgagaggaactggaaagttgccttctatactgtgtaacagaacctgagctgtatattttgtcatgcagttgtgcttggtgtgtatataagtctgacatactgtcatttaaggaaaagtgtaaagtagaaaatattgataaggtgaaaataacttgggaaataataaccttgttgttttcctcctctgattttggtcatgtttgcattttagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggtatgctctagcttgggaaatggggtcatagtaactgctaggggaggggccaggaagagcagacatgcatcttggagctcatcagattagcactgtggggcatctggctttagcacatttccctaatggagtagaagtgagtgtagtgggaaaatggacagacttgactaggaagctccactgagcaggaaaggcataattagaggctggagccaaaaactctccatacctggatggtaaggtttttctcatggtgattgcttatagcaagtccactccccccaataaatcttc

SEQ ID NO: 11102 - DNA, 1317 bp, Homo sapiens
acagggtctcactcaggctgaagtgcagggcataatcgtgatcatggcttactgcaacctcgacttctgggctcatgtaaccctcctacctcaagcctcctgagtacctggtaccataggcgcgctccacaatgcccggctaatttttcttctttctgttgttgtagagacgagtctcactgttttgctcaggctggtctccaactcctgagcttccgatgattcgactgccttggtctcccaaagtgctcggattacagatgtgagccactgtgcctggcccctacttcctgtttaactatggaagttacgttgaattatggaagattttaattgtatctagatgttactgaatttggtgttggaatgaaactcgaatggctgcttgagtttttgggagcgtatcgtacatggcacgacagagatcttaattttgttaattgctatattcgaagcacttctcatggtacctggcacatagaatggccttgatgtaaatattttttcagtaacataatgaaaggtgggtgatacttgtggggcttttgcttcgcccagagaactatcattagttgaaaggcaactatttagaaggaccttttgcttgagagtaggttaaatttaggctgttattcacgcttattcttgtctttcagtggctaatttatttttaactctaattcactaaacagtcctatctggaataagggaagagtgggacaaagaacaaaaagggaagattggaaatggataaatatctactagagttttaggctctgaaattgctgctggaggaattggaagagcatgaactgtttttctctgattttgaatttctttttactccaaagagtacaggggctcaggtccaggtggcaggggatatgctacccaactcaactgagcgggccatcactattgctggcattccacaatccatcattgagtgtgtcaaacagatctgcgtggtcatgttggaggtaagccctcaggctcatgctgaaaatggggggagggccattctggggacagagggactgatctatatttagtaagactagaattaagtgaggctgttaaggcttccagtgggggtggggctaaaaggttccctgagttcatattttccttcccctagctttgacttttcttatggtctgtgagcaaaaatagaaactgctaagcagcagtgatcttttggttcacagcagttgtagcagagtcggggagaagatgcactgcatggactaaggaggccagagatttatttgagttcctgagtagctgagttaaattactttttgaattactgtattt

SEQ ID NO: 11103 - DNA, 1031 bp, Homo sapiens
tttgaccttgtcatccacctgcctcggcctcccaaagtgctgggattacaggcgtgagccactatgcccagcttgtttttcttatttgtaattaggattttggagggcaagaagttttcagttttcagtggcaagaatcaggtttttgaaagctggaatttgttttgttctttcgataggcttgcccttcatgtaatttaaattgtgactgtttaaatgtgacctgcttgcctagctcctgcaataggtcagtggctacattgtaaggaagcagaattctcttggtagagtggctcttttcaggatcattgttactgaatagcaattcggtatcttagccatggattagggtcaaaacttttcaaagcttcatctaacaccaaagcaaagattatgcatgcacaaagcttattctttctcaacttggtgcagtttaaatgcagaagtcaaagggtttttttttttttcctttctcattttttttaagtcaagaaggattttactggattctgagcattttctcctgtctcttgatttttcatggtggcagtctgtccttttatatagttagttgacttctgtatccctttcctttatggattgcagctgtccttggacataggtaaataaaatgaggttttaagaggagcctttctgctcttgaagacttagcgttgtgggctcaattgtccaggcacacttcccaaatatatgtagttctggcttagacacatacaggcatttgggagacatgtacccttactgttctgtggagcttattttgggagtggaagcagcagcattttcgcttaagtatgaatttttaggtgatacttgagtttctcttttccacttctgaaaggtccacattagaagtatgatcagtcagaaacaactttttataccacctcccaccagaaaagcttccctagttcttatctacacttctgttctcagcatttttctttgaaaacgctacattctttgaaatttgaaattagtcagtgacctactttggactcttgtctctt

SEQ ID NO: 11104 - DNA, 1168 bp, Homo sapiens
accccgactctactaaaaacataaaaaaattagctgggcatggtggtgggcgcctgtagtcccagcaactcgggaggctgaggcaggagaatggcgtgaacctgggaggcggagcttgcagtgagccgagaccgcgccactgtactccagcctgggtgacaaagcaagactctgtctcaaaaaaaaaaaaaaaaaaaaaaaaaaaaaccctaaatattcccttaatactgaggtggagaaaccatttctgactaaaagtaaatagtttgtagtcgaaggactttgcagttttttggcccttgcttttctacccagcttttggctttgcattgttgtggaagggatacagatggtgaattaccaatcatgttttcatgaccacatatcacaaatattttatgctaatcagtttaaaatcttatgaaataacttatcttatgaactgaaatgaagtcttatacatttggttctattcaaaatgagggcaaagtcttgctgcctacctacctaccagtgaagcatactgagtacttaaatacttttccctgaaagccctaaattggattccaggacctcaaatgactatctctttgaaacagaaaggcattgtagccaggtatgtttagatggaggatatggcttgacaagatctaggagcttgtagagtgagctacagagttgaaacaaattattttgtctgctacttttaagtcctgaaaactttttaaagaactttttaaggccgggtgtggtggctcatgcctaatcctagcactttgggaggccaagacaagtggatcacctgaggtcagaagtttgagaccagcctggccaacatggtgaaactctgtctctactgaaaatacaaaaattagctgggcatggtgacagctgcctggaattgcagctactcaggaggctgaggcaggagaatcgctagaacacgggaggcaggggttgcagtgagttgagattgcgccattgcactccagcctgggtgaaactcagtctcaaaaaaataaataaataaataaggccaggcgcggtggctcatgcctgtaatcccagcacattgggaggcagaggcaggcagatcacctgaggtcaggagtttaagacctgcctgggaaacctgttgaagccccgtctctactaataatagaaaaag

SEQ ID NO: 11105 - DNA, 1005 bp, Homo sapiens
taagaaaccttaaaatgtctcccttggtactccagcactggttatttactcttcacatttcatgaaccaggtagagatgaggtgcagctgagcactggggaaactaactgagttcttgtttctgtgttacaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcct

SEQ ID NO: 11106 - DNA, 1032 bp, Homo sapiens
cccgcggtgggctaggagaagggccgctgagcgctcagcgggctggggtcgcccgggtctcacgtgtctctctcccccctctcctcgcacttgccccctcccctccctccagacgccccccgcacccgcaagaagcgctgcccttattcgaaattccagatccgggaactggagcgagagtttttcttcaacgtgtatatcaacaaagagaagcggctgcagctgtcccggatgctgaacctgacggaccgacaagtgaaaatttggtttcagaacagaaggatgaaagaaaagaaactgagcagagaccggctgcagtatttctcgggaaatcctctgctgtaacctgcagaccgggcccttttgggggcggggggaggggaaaattattttattttatttttattttttattttctaactcgtcttctttccgccggtggaaaactggactgtggccagggctggcccccaccgctgtggccggcactccattccggaacctcctggaccctctatctgactctcgctgtgggacagggaccgggcctggaaagggggtgaagggaagtgtctgatgcacggcgagtgaacaccgttggcgccgaggccaagactttgatttaaaagaaaacacacctcggcgacaatgtcttgctgctcggattaggtgggggaggggcgacagtagtgagcgcctgagccgaacaatcctcgaactaaaagccttcccttgcccatgtgaaaagatccgctaagacagcatgtctgccagcggaaacttctcgagctcccccctctaccccgccccaccttgcagctaaatgtgatcctgccttgctgtgaaatttctgtaccttcaacctggtgttaggtgtgcaaagtccgtgtcctacctccgtcttcgccaaggccccgcccgagcctagttgttctccccctgaatgtgtagaaccttcctttgaaatttcttaatcggtgcattgaggtttccacatctttttccaagcagtgccccacttcatggatttat

SEQ ID NO: 11107 - DNA, 1034 bp, Homo sapiens
ctcctggtgctttgtatatggatgcgacgcacacgcatgcctacgggcgacctgtgccacactcacgcacatccatattgcatgatccttgcacactcacgcatgcccgctcacacatgcacaggcactcttttggcgggcaagggcagagcctcatccccttgggtctgcaaaggtggtcttggtaaatcatccccatagagacactgactggaagatgagcgctggtgtgttcatgaggataagggggagagtgaggcgcctacagcctcaaagcctttcgtttggcacgtgtgcagtgtgaaggtttaatcttataccctctctacagaccctgagcttggttagggagcagatttggggcaggaaaacctgcattctagcccccaccaaaagcaaagtcaaggttaacaagttcacctcttaactcgacctgcacccattcccataggctctccctttcctctagctgtccccacagcaacctaatccctcccaccccaaggaatccctcttaccctgtaccctctctgtgcccttctttcctctcctcctgttttgatgtctccaccaggccagaggcaagagagcttttgattaaacttccccatttataatttgtcttgtccccccaccccaccaaacctaacaactccagtaagaaaataaacaggacgtagttagatgtggagagcttgtaaacaatctggcaagaagctgcaggtgcagagacaggagagaaaattcgggacattcagatttttttagactgcaacctcaagtttgccttttttgtgtgttttctggttcctcttaggcccccgcctcaccccgcccccaacaagataagatccaggaacctggcagcctcattggaatagggaggagagagagctcagagccatcagcagagtcctttgctgggtgtcctctcaggtctttggactctgttttttgcccttaaaaagatggccaggttcccttctgctacttgagaagcaaggctggtccatttcagcaagaatgtgtgtcag

SEQ ID NO: 11108 - DNA, 1049 bp, Homo sapiens
gagaaccctgctttatgccgtcctctcaacctatcccaatccctgtgattaagggagaggagtctttcctgcagctattgtctcctgggcccagctgatggagacagacaaagagggtccagccaattccaaggaaattcaggagtttgagtaagaggtggcctggcgggccagctcagttgggcagcagggtggggcagaattattagcagaaagaggagcacagaaagagaagacggtctctggaatggttagcctctcccacctaccacctccagtcgactggggctcaagattctccttagaaaagtggggtacctggaggttccaagagttggggaactctgagcgccagcccagccctttccccttccccttctatagctccatctccaggggaaggacatgtttggggtgttggtaggttagaggaaagccatcaaagtccaagtagaacccctcacacacgcacacgcacgcaactgggaaacatcagggcaaaaacctgactctggtctctgtttagtcgtctgtggcctgaaggcctcagtttctgtggctgtgactgtcaggcagctgcctgtctttgcactatgtggaaacatctgggtgaacagaggctgcccgtgcccaccattgctatgttggtggaaaggttgttggctgatgccagggggaggaggggaggagaatggggtagaggaaaatctgagcagtgtgaaactttgcaaagcttcctctcatcctttcccccttggttcttcaattctggccctggttgctacagagaaagttctcaaaagaggtttctttgcctgcctgcgggcggagttgggggggggggaataaatgggggaggggttatggagactgaggagatacacccctgttctcagagatactggggaagagaagccaaaagaaggtcaggttcttggttctcttactttgaaattattatgattattaaaacattataaacgtctagacagggaaacaaaattatgtccctgtaacaaaatatatacagagttctatattctcacagt

SEQ ID NO: 11109 - DNA, 1049 bp, Homo sapiens
cgacacatacatcacacaaaagatcaggtaacaaggcgctcagggccactggggctccgggcagggcagggagcggctctagctctggggcggctccccctccagccactcccaggctggaaaaccagaccgcgttgggggagccggaaatagccccgcttgctgcggagcgtcagggcgggggcgccggcgggaatgcaggcccggcaggccgtggctttgagagagccacgttcacaggccctggggatttcactcctgctgggcctcgggacctgactcctggtgtgtagggatcccagatacccaccttgggtgggggcaggacgcgggtttcctcgcggcaggccaagagaactcagtttctgcttccagcgcaggccttagctaggaggagttgtgtgtgggtgtgtttttcccaacaaagagggatcaggagagagaaggggggaaagtagaggggaaccagggagggggcggggaggggaagagggcagtggagaggtgaaatgagcccatttcagggggagaaggaaaatgaaagcaaatggagtacggccttctccgcgcagggcgggtgctgacgagccgggagcgggctccctgcctgcggcagccgggatggcccgctggggacaccggagaaagcctgttttaaatttaatccgaacttgacggtgtggattgaaccggagggaatttaaatcactaaaaggaaggcgcggggcagggggaggggacgactctaacctgtctatctttctgtctgtccttcccacggtgctagtttggttgtggccgcagctgcccaggtttcaggtgatggagtaagggtgcccctccccctcaggggtctctcctgtgcccagtgaagtcttttgggggtgggagggaactctaagaaccagagtgaatgcacagctgcgagctaaagctggggtttccccctccccaacaagaactcccagtggcctccagtccctgggtttgccccagcggtgctgaggaaaattgaagggagtatgtgggtgaggggaagtctggagtat

SEQ ID NO: 11110 - DNA, 1021 bp, Homo sapiens
cgcgcccagctcggccctgggggtccgagaaccctggcttcggggactggcattttcaccccattaaaaaatcctcatggttggggggaggccatctgcttatgggtggacatgggcacaggggcttctcagatgagctaggagccgtcctgagggggtgaccggtgccttgggtccagagttccggacccccaggaaatcgcaggtcgcggggagcagcagagagaagggggtgggagagggggaaaagaaggcaaggaaaaaaaagcccctgcgcattgatccgcgccgtatttttgggtaaatacgatcacgtgggggccggggagccaatgagctgtggggaaaaggctggaaaaataattacctgacttgattgttctgtgagcagataaaaagtacatatacagttcatacaataatcttatgtatgtaaaaccccgttacgatgtcggcgacggggcccatcagtaactattacgtggactcgctcatctctcacgacaatgaagacctcctagcgtccaggtttccggccaccggggctcatcccgccgccgccagacccagcggtttggtgccggactgtagcgattttccgtcctgtagcttcgcgcccaagccggcagtgttcagcacgtcgtgggcgcccgtgccctctcagtcgtccgtggtatatcacccgtacggcccccagccccacctcggcgccgacacgcgctacatgcggacttggctcgagccgctgtccggcgccgtctccttccccagcttcccggccgggggccgtcactacgccctcaagccggacgcctaccccgggcgccgcgcggactgcggcccaggggagggccgcagctacccggactacatgtacggctcgcccggggagctgcgcgaccgcgccccgcagacactgccctcgcccgaggcggacgcgctcgccggcagcaagcacaaagaggagaaggccgacctggaccccagtaagttgggagcaattttcctttacaaccggcgc

SEQ ID NO: 11111 - DNA, 1047 bp, Homo sapiens
ttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcggtaagtgtttccttattggttcaaatatgtaactaatggtccgtggcggtttcaagaataggacagcagcggcttctcttggttagggagaagagggggctggcgagagggtgggcgcgtagttaattatggggaggaaaattggcggggggagagaaacggggttaaactggaataccggtaactggtagtggggcgattgtgttgtcctgatgtcactgtgtgccaagttgggggtggggaggcaagggaacagcacctgtggggctcaagccggcggtctagggcgccagctctctgctgcccactgtgtcagtacctgcttattatagatcttcggtctcttggctaatggaactgggtcggagcggaactggaagctcaagctccaggcaggagagagaacttagaggctgtgcccattgccccctaagcaaagttagccccccaacccccaaacaaactttccagcttcccctccctgtctggcagccccctccctcccagagagcgcgactgctagagctcacacatgcgcagtgtgggcccagggccgggccgccgagcaggaagccggcgcagctaggcggccggcggggcctgttaattggcaattaggggggaggctggtggctggtgcgcgtcagccgagaggagagcgtctgcccaccccctgctcccgcccccactcgggcggatggaagggtgggaggtgccctgcgttgggtggagggtggaggttgtagggtgggggtgggggatgctgtactcaaaagccatcttgtgctcagagaaaagaggcctaccggctttcccttccggggtccggcgcccctcacccccagccgcggccatcccagccgggatgcccactggaccgg

SEQ ID NO: 11112 - DNA, 1038 bp, Homo sapiens
cgtctcctcaccgagacagggccccctcttctgccccctcagctcgcctctcgctcgcttgcaggggcctggcccccttggcccctgacggattggagggccccaaggcgggctgagggggcaggaacagggcaggggatgaggggagggagcagaagataggggagccccccaaagtggagtcagtctgaggagaagggagggggagaggagaggcagataagtggggagaagtttccaaggaactaggatgcttggggagatgggggagcccagtccttgagaaagggggccctcatccccattatctgggatttttcaaaaatctgcttttagacttgcagctttctgtttgccttttgccccgcccccccgcccccccccccaccacacacctttctttgggacacacaggtcccaccttataggaggtctgaagttggggtcctcgctgtacccccagtgggggtggggcaaggcaaaagggagaaggctagagccctaaggaggctgtgagctgctggccaggttgggagggtcaggactttgctaggcgaaacagtctgcagaggacgctttgctgattgcttttagtgtgttttgtgcccggatctttaggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccc

SEQ ID NO: 11113 - DNA, 1045 bp, Homo sapiens
caagtaattctgtctctatttctaaggccatctccaaaatctagtcccactaagttatctgtccctcgaaaacctactctaggggtcatagactgcctccaggctgcctctgtgacctgagatccaagccgaagctccctacctctcaaggtagccactaaaaagaagggggagagaagaaaggggagagtcctccagcccagttcctgttggatccccagggcaagaggctgacaggggcttgtatatctccctacaccccccactgggcctttgaaatgtgggggaaaaagggatcaagtccccaactgtttttatagggtgcccaaatgatgccagggttactgcacaacccataggttcctcctccccagttgttctcggtgcccagggcccaattaagcggccgccttgcgcccagcagccccgctcttatcggctgggattgatgcctccgcgtctcctgtatatcatttccaagattttttctgtccaactcctcggctcctttggcttccgcggctttgactaatgattgctacagatgccaacgtctccagaatcctaatagccaggcaggcggactcttatttacccggcaacattgctgtgggggagggggcctgggggacaagtattggggtgtcgtaggtcaggggacagggagaaggttgtggccaactcaagtgtcactgaacttcttcccagtcagaaagacattcccaatccccttctctccttgagggaaatatatatatatatatacacagttaatggtaactcattgctgcctcgttagaaaagatcaaagaatgaacacaacgtggtagaataagcagagcaatgtttatttgttgtaaataaatgagagaataagtggaaaaccagcagtttggggaggaaaaagagaaagggaaagaagtcagccacagtgggagaaggggctccttttcttcatttcttgtcttcccctttctctccccaccctaagtctacccttctcatcaatttctcccctctttcccttccttcgcctcaccttcaa

SEQ ID NO: 11114 - DNA, 1388 bp, Homo sapiens
ccctccctcctctacggccctgtcacccccctccatcagagtattactgtgagtgggtggcagagagagagcagggggtgtgaatgggctggagaccccaaaggctggccgtgcctccccaacttggtgagcttagccttccgtttttggaaagcagcctggagctggcctttaggaattcgtgtttacatgtaaacacacgtgttacatggatacagctcctagccagaagcaagcaggctctacccacacaggcctccctcttagctaggtctgccctctgtggggacagagaaagaactctcaggatcttggctgggcaccatcacagggcactgactcctggcagaaagctctcctccttgccccagctccttggagataattgtcagaaaatagcaggccgggctgaatggggagtggaaacagaagccagcagtagaagagatcctctgctctggggctggggcagggagggtcagtgggtagcaggggaaggcgagacttctgaactctgcttttgccaaccacttcctgtctctcttcagcgggggctcaacccccagacctccagaaatgacgtcagaatcatttgcatcccgctgcctctacctgcctggtccagctgggaccctgcctcgccggccgcatggccagagggttgggtgagtgtgtatggggaagaggggctggactctggtatccttggatggggggcactccaggctctccagcctcctcggctcagcctgggcccctccccatccaacatccactccagtcctcattcaacttcctcttcctgcgaaagaggggcgctgccccgtgacctacacagactgagacacgatcgccatgaatggagacctctggaaaagctcaggagccgaggcccacggggcccagcagaggcctgaggggagaccctgggcgggggctgaatcactgcctcccgacagtcccccaatgcccgggctttggaggggagccgggagcttcccatctccttttgcaggggagggttgtcagtctggcgggatgtgcactgggggcactccaacctctgctagctaaccccacatcaccacccacccccgcctcccagcaccaccaccaccacacacacaaaaaaattggatacattttgaataaagcgattcggttccttatccggggactgggttgctccgtgtgattggccggaggagtcacatggtgaaagtaactttacagggtcgctagctagtaggagggctttatggagcagaaaaacgacaaagcgagaaaaattattttccactccagaaattaatgatcatgagctcgtatttgatggactctaactacatcgatccgaaatttcctccatgcgaagaatattcgcaaaa

SEQ ID NO: 11115 - DNA, 1091 bp, Homo sapiens
agctggaaacctcccctcaaggattcagtctttgataatttcaaaccttcctggaatgtgactgcctccagctctgtctgtcttttcttggccatttcagagtctctgcctagcatttctgctgctttccaagttccatatttcctcctgtcgtggccctggttccaatccttggactcccttccaactgtaaaagcagaggaagaaccaaaaggtggtgggtggcagtctgggagggacagctgaggttcaaaagttcctggctaagcctccaatctgggccacctcaggggctgatctgaccactccagagtgccccctgggccagcagcaaatagaacaaaattttatagccggggcagatgttggctcggccatctcacccggattccccttcatctctcttccactgaagaggctccaatctccactatacctttgttctctttcctttccccctcctccccctcctcttcctctgtttgatcctgccaaccccccaaattgtttctttagatctgaaagcatctgttcctgtctgaccctcccccaacaccctcctctttctccctccctccacctcaagcagtcaaaaagcccccaaatggaaggcctctggcctctgacctattctgatacaccaacgtccagatacctttgaggccaaacctttaggcccctccccagttacttttctttcattctaccagctggagagggtcctggaattgaatgagttgagtcttggcccctagggaccagtctcttctctgcctgggacaattaaccatttttcaggtaaaagcaaggagtccaaggttgaagggtttggtgatgaactatttagataactaccccagtcctctgttgggcttttgggggctctagattttgaacatatccatattctgaccatagacagatgtccttttctaacctctacctggccatttcttttatcaccctttctgacccttcccttaattgcaaagtcattttctgagcaataagaaagcccctccaatccctcccagaattcactaatctaaactaggaagatcaaggcagtttccatactgtgcacattggag

SEQ ID NO: 11116 - DNA, 1028 bp, Homo sapiens
agcctttgttgcgcgtgcgtcggaaggcgactagggacgcatgcgcttgcgatttcctagcactcccaactccagcatacggcctcccttgataggcagaagcacgtgtcttgttgcgacctgaacgaacaataagtgctaggtacacagttggtgtctagtttttcttttcctcgatggaaattgtttcgtgttgtagcccatttaacacttccccctccccccactctagtctcctaaagagcccgaacagctgaggaagctcttcattggagggttgagctttgaaacaactgatgagagcctgaggagccattttgagcaatggggaacgctcacggactgtgtggtaagatttggaagggacaaagcagtaaaacagccgatttccttggcttatcttggtgcagtcttctccgaatgcttatgaaagtagttaatagcattatagttagagctttgttggcaaaggaacgtcctgctttgattttaaaagctacctcttaaatctagggtagtgggaaactggacgactttttataaaaggctggtgtaaagtttcctattgccctattcaaagttaaaatgacaaaagcttttgcggtcagactttgtgttacataaattaacactgttctcaggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagtgagtgggttttttttcttcttcttcttaaacttacttggatatgtgctgctatggacttaagattcgggagttttctaaacttaccaaaattttttattcgagtataggctttgctaatctaaacctatggtttttctcctattaggattctcaaagaccaggtgcccacttaactgtgaaaaagatatttgttggtggcattaaagaagacactgaagaacatcacctaagagatta

SEQ ID NO: 11117 - DNA, 2004 bp, Homo sapiens
agtaagcacctttttgtgtgttgacataattttttaaattgctgatgaacccaataaccctaatgtagctgagcagtgcaacatagttaacattataattgcagtaattgtggatataaagttaatattcagatcagcaaaatttgtgggaaacaaacttgatattggattgtagccttgagtcttaatatgtttagattaacaactttattccatattgttcaacaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttactta

SEQ ID NO: 11118 - DNA, 1026 bp, Homo sapiens
tggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggtaagtttttacaaattagtgctcagcaaaagaatgccctgcgttcccaaagtaaaagaatgacaagctgtaccttaaaccaaaacacttcgtaatctcatccaattgcaaaaagagttattagccaaccaggtattcccagtagtgacagtggatataactgtgtagtcattcacctctgcttatatgaatactttacaacctcttttgccttttgcaggaacgtccttgtgaagacctttatctgagccactgtacttcgttatcactgccatgcagtttacatgagctgttctgcagctcaaattccattttgtgaatgggtttttttttttaataaactgtatttaacttagttctgcttgttttgtcctcctttgtgatatctatggttaataacatgttgaaattcaggttagagaggatatggttgattctaatgtgaatttctatatttagattcatcccattcagcttcatggtttaatgaaaatagaaatgggttctcactacaggagtaattcttggctcactataagtaaactttactattgatccaattgagcatgtcctttttctagctcccctggcaagggaaaatcaagttgtagcactgccattgagctcagtatgtctctattgggacttacgctcaccatctgttgcagaaggacataatggatttcatctttggcaaacaagttgggcttattggccagctgtctcatacttcagtagaattctcaagccaggagtaagaaagtgaactgaatgagaggcaagacttagcctctcaaagatagcctaaaaatgtaaggactattttggaagcaataattgtaccctctagcaaa

SEQ ID NO: 11119 - DNA, 1071 bp, Homo sapiens
ttttttttttttttgagatagagtctggctgtgttgcccaggctggggtgcagtggtgcaatcttggctcactgcaacctccgcctcccagaatcaagcaattctcatgcctcagcttcctgagtagctggggttacaggcacgcgccaccatgcccagctaatttttgtatttttagtagaaacagggtttctccatgtttgccaggctggtctagtcttgaactcctgacctcaagtgatctgcctgccttggcctcccaaagtgctgggattacaggtgtgagtcactgcaccccggccagttagcaagtttttttttttttttttggaaacagagtctcgctgtgtcacccaggctggagtgcagtggtgtgatctcacctcactgcaacctctgcctcctgggttgaagcaatttctcctgcctcagcctcacgagtagctgggactacaggcacgtgctgccacacctggctaacttttttgtattttagtagagacggtttcactgtgttgcccaggctggtcttgaactcttgagctcaggcaatccacctgcctcagcctcccaaagtgctaggattataggagtgagccaccgtgcccggcagcaagtattcttaatcaagaggttgagtgcagtggctcatgcctgtaatcccagcactgtaagaggctgaggcaggaggatcgcttgagcctgggagtttgaggctgcagtgagctatgattgtgccactgcactccagcatgggtgacaaagccagaccctgtctctaaaaaaataagaataaaaaacctccccctaaacccaattagcagactaggatagattctagggaattggtttttttggaagtttttagacttacctatatatgtttagaagggagcctgcttaaaggtaaaggaatgaggaagataataattggggagcccttttaacaatgggcctgtgtgtagtgggtaagctgggggagttatatgtgaaagtatctctgtcgggcgcagtgcagtggctcatgcctgtaatcctagcactttgggaggctgaggtgggcggatcact

SEQ ID NO: 11120 - DNA, 1054 bp, Homo sapiens
ggggaggatcgcttgagcctgggaggttgaggctgcagtgagctgtgatggcaccactgcactccagcctgggtgacaagaaataataataatattaataaatctgatataggctgggcgtggtggctcatgcctgtaatcctagcactttgggaggtcaaggtgggcagatcacctgaggtcaggagttcgagaccagcttggccaacatggcgaaaccccgtctctacaaaaaacacaaaaataagccaggctacaaaaaacacaaaaataagccgggcgtggtgggaagcgcctgtaatcccagctgcctgagaggctgaggcaggagaattgctggaacccgagaggcagaggctgcagtgagccaagatcacgccactgcacttcagcctgggcaacagagcaacactgtctcaaaaaaaaaaatctgatatgtaaaaactgctcttccctgtcaaagactttagctaattcttcttttcttttcatctgaagtctatcggattgtggctggcaaattggagcccttaaccccagaggagcttttaattttaaaaaagttggcacaggctgggcacggtggctcatgcctgtaatcccagcactttgggaggatgaggcgggtggatcatgaggtcaggatatctagaccatcctggctaacacggtgaaaccccgtctctactaaaaaaaatacaaaagaattagctggtcgtagtggtgggtgcctgtagtcccagccactcgggaggctgaggcaggagaatggcgtgaacccgggaggcagagcttgcagcgagccgagatcagaccactgcacttcagcctgggcgacagggtgagactccgtctcaaaaaaataaaaaaataaataaaagttggcacagaggccaggtgcagtggctcacacctgtaatattagcatgttgggaggccgagacaggcagattgcctgagttcaggagttcaggaccagcctgggcaagatggtgaaactccatctctactaaaataaaaaaaatcagctgggcatggtggcagtcacctgtaa

SEQ ID NO: 11121 - DNA, 1032 bp, Homo sapiens
ccttagagagcttcttcccatctctttacccttggggattttctattctccattcttctaaggacagggaagacaagtgaggggaaggagatccccagccctcatccttaccctgccctgtcagcaagctttcctcaatgctgctcttatctctgcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtt

SEQ ID NO: 11122 - DNA, 1030 bp, Homo sapiens
ggtgattaggctgccagctggtgttggcaccatttaggttgggaagggaacttggctggtggggggttgagggctgggggctgggggctgggggctggttgtagggagaggctgagtgattctctggcaggcaggacctggggaaagtttttccttttattcctatttgttggcttccctgctcccctgtttatcaactcctgcatatctgcttggcaccatgtccctagttctcttctctgtgcccaccttgtttggaaacttcttgtggcctggactgagtgaacacacaggccaacggaattgccaaacttcctaaaccatgagcatctctcttccaagcaattgctttagaaattccaatctggaagatgtataataaatcaaattgcactagacacctcaaagacttcttggtccctcctattctctccccttctgctcttctttgaaatgccaagaaaatttgctgttgttttttaaattgcagtgaaataaattgaagacagatatgcaggagaacttcctggaaagttcctggaggttagactgtggcctttctctgataaagaaaaaatctacccttctcctctaagcactgggttagagctgatttggggaagcagtgagccagtcagaaaggatgaactctggaactgggaaattgaggcccaagcatcctacttccccagtgtctccaacccagtccctgaatctgagaaccataaaggctacagaggaggaacagatccccagagatagttagtaaaatcggggcagtgctgggaccagacccaaatcctgctgatccataatctgatgctgccctcatcacacttgcagtcagactcttgctaagcttttaatttactttcccatcccagactaccttcaacatctgttaggccccatggaagcagggcatctgctgggaacagctgttaggatgtagtttggagggctggtggggtggtccatgtggaggtggttaatgagcaaaatcaaatggtgtagggagggagaagagggg

SEQ ID NO: 11123 - DNA, 1050 bp, Homo sapiens
tgctggtgcttttgtgtgtgttctgtgggactgagggcgcgggtactggtgcatgtagagggtaagtggtcagggagggcaacccacatctggctggaagagtcctctctaggtcatcttcttcattcccttacttccgagcccttcttcatggttttggatgtggggatggagtgggatgtttggaaggtaggagggaagctttctttcattttctttgaaatctccagggaaataataataattatagctattctttagagagcatttactaaatgccttgtacttatctcattaatttccaggtaggtggtattatctttcattctgcaattaagtatctgaggcacagagaggcatgtgacttacccaaggttgcacagccagcaggtggtagaggcaggatatgagccaggttcacctaactaggttctgtgctctctccctatgccacactgccttctaaagaaagttgttgatctcggtccgtaatcaccaccattcctgtggatccttgatatatctccatttcccctaactccccgcagattcccactgtgtttttgatgagtttcctggatgccttggagacaggctatgggaagtacaagaatccttaccacaaccagatccacgcagccgatgttacccagacagtccattgcttcttgctccgcacagggatggtggtaggtgccctggagatgattcttctgtgattcagggcctatggctacagaactgggaggtctagactgtactcccatttccatttctcctcgttggttcttcttgggcactccaaagccttgacagagccaaactggattaactcactctagagaattcccaggtagactaaaactcgttggacagtgctagggacatgtgctgggatgcagtgggagtgttgcaggttcggatggaggaaggtccttggccatttcaggagctgagaaacctggctgcattaaccaagagctggcctggaagcatggaagggatgggatgagtgatctagcctgtgtgtggaggttcctgggaagtgac

SEQ ID NO: 11124 - DNA, 1075 bp, Homo sapiens
caaaaagaatctatttcaaagttcccatttaaaagggaggcctctcagaggaaatcggtcacgtggagaagggaggattatccatgtaatagagcaacagccacgacatgggttcctacatcccctgacgttcttcagtttgcctcatgccatgctcccaggggagctgagggcccaaagcagggactgcagcagctgctgacattcccctgcaaagggtctccttggctctacctggggtttacctccacctccttacaatcaagccaaagacctcctaatctaagtccccaccacattctcactgcgagccccatcctagcagggaggggcacagagcatgtgcggatctgctcaataccttcacctaaacaacacaactctgcaaaacaagcagaaaaggggaaagcaaaactgctcaaaaggggtaaacttaataaatcacatataatatacggttgtcttaattattagaacttttagaatttagtgtttttgctgagcgcgtggctcaggcctataatcccagcactttgggaggccgaggcagacagatcgctcgaggttaggagttcgagaccagccagcctggccaacatggtgaaaccccgtctctactaaaaatacaaaaatcagccgggtgtggtggcatgcacctgtagtcccagctacttaggaggctgaggaaggagaatcgcttgaaccagaggcagaggttgcagtgagctgagatcgtgccactgcactctagccttggtgacagagcaagactccgtctcaacaacaacaaaaaagaacttaacatttttaatactgtaaaaatcaagcaagtgtccttacacaaattgacttttttatcttataagagttcaaaagaacgacaaacagacctcaaagtgtgaggatgggctaaccccatcccatcacgtataaaatgtaatgctttatataaacgtaatgtgaatcaattgcttggctaactaactggcttcaggtggagtgacctgttctagagtgagcaattgcaggggctgagcaggaagggggtctgcagtgtcagtagctgcctcccggg

SEQ ID NO: 11125 - DNA, 1081 bp, Homo sapiens
accaaggtgagccgatgcctggagcatgccctgactgctcgacacccccgaacccgctacagcccaggttgggatgccaagctgctctggctgcctgcctcctacctgccagccagcctggtggatgctgtgctcacctgggtccttcccaagcctgcccaagcagtctactgaatccagccttccagcaagagattgtttttcaaggacaaggactttgatttatttctgcccccaccctggtactgcctggtgcctgccacaaaataagcactaacaaaagtgtattgtttaaaaaataaaaagaaggtgggcagaaatgtgcccagtggaaggctgaccccatttaagtgccaactactccaaaccgacatgctcacggtctctggcctgttcagtccctgcaaaacagctagcacccacagtggggcgccagggaactgcctcacatctacagctgcacgtcggggagtggccatcaaagggcactttaatacatttcccttattttctgaaggggagtaaggttgcaattcagtgtctgtactgggaatggtcttcatatttcttgggggagaagagcaggtgatgagggttctgggccaggctgggtggcttccatggaagaaaaggcaatattcacataaattctcctgctaaggacactgaccacacaggtgtcaaggcaacttatcatacttcgaaaggagctggatcccttgaggattggccaggaagggaggtgctgggcccttagcggtgcacagaaggccaggaagatgtccaaggcagatgggggctgggctctcgcaggtgggacctttctggggagctgctttgacttatgcagcagatggcttcatgaatgttcatagtgagcctggcagcataagactagggggcagaaagcaccacagtctctggatcctcacttctcccactgcctgcccaaccaacaccttcgcaaagtcctcctttcccaaacaccccccaaaatagacctcgaagtacacatgcattaaggtcccagaggacagggaacatcagtaaggaaaggaaggaatcaagcatcactctaaga

SEQ ID NO: 11126 - DNA, 1028 bp, Homo sapiens
tcagctccctgccaatacctgcagccctgctgacagtctcgctccagtgagtgggggacttggggacaccctgggcagatggagcagaggacatatggggatggtcagggtgggaggggggctctgacccaggcccctccttactccctctctgccctgtgtccctccagagttacttccagagtcttcaagagtgccaactgggaccaggaccccagaccacagccccccacaccgtcctggacctggattctgactgtggttccactgtacccctcaccttaatctctggttctaaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctcca

SEQ ID NO: 11127 - DNA, 1021 bp, Homo sapiens
tcccatctcctttaatataacagtacagtggtgcagtaggctgtcttcaaatcagcaatatgttttattgtcttttatcttggttgtaaccaagagcttaaagaccattagcctatacatatgtaatgtgcatttatccccccagtgcattaccttacaattgtccgtattcctctctcaattcatcaaaaaatatttgttaagcacctagtgggtacccagcaccatgctaggtgctgtggggaacacagaagaaatggaagacagagtctctgcccgctgtgctcgtatctagaagtggctgcatcacaaggttgggggatgaccgcagtgtctaccccctaccccgtgagtggcttgggatacctttgctacatgtcagtggcaccccagacattcaccccctcccagacccacccagccttggggatctgcaaagccatggttgggggaaggaaggagggggcgaggagacagatgaaggaacttcattgtctcaggttctgtgtgactgaccccatgaaaggccctggggagggagtcatggggccctgctgaccttttactgtctgtgggaactcctttgtatagaggagagttttgactgacgtcaacgtgggtcttggtatttcctctttccccattttcaggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcggtgagagtgggcacctgttttccctcattcatttctcccagggaagggcttttccaggatgaaggaaggatgagaccctgaaatctgggcctcagtgtttcatttccctggttcctgctctccctgttggcacactgattcagctatgggaggatggaagtgagaat

SEQ ID NO: 11128 - DNA, 1110 bp, Homo sapiens
gtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagtttt

SEQ ID NO: 11129 - DNA, 1035 bp, Homo sapiens
ctttgtacagcgcccattggaaacctcggttttttcccccaaggaacttttctcacctgcaagccagtcctagagacagttgtgtaggagtatgtgtgtgtgtttttagacggagtttcacttttgtcacccaggctggagtgcagtggcatgatctcggctcactgcaacgtctgcctcctaggttcacgcgattctcctgcctcagcctccagagtagctgggattacaggcgtgcaccaccacgaccagctaatttttgtattattagtagagacgggatttgaccatgttggccaggctggactctaactcctgacctcaggtgatccacgtgcctcagcctcccaaagcactgggattacaggagtgagccaccgcgcctggccgtgtgtgcgtgtgtgtgtgtgtgttttaatcctatctaatttttccaacagttttttgcatcctaagagagtttaggagtagaattatcaataaggaatttcatacatagacctggagttgcaaaaatatatttggagaagagagctttcccattgcccttcaagtcatacctcatatcttttaaaatttttttcctggacaatccctactgcataacatacctcatatcttctaactcttactttacctgggagcaaatattgcttattggtatgaattttacttctgagaaggaggcatagggtagaagaagcaagcgtatagtttgctccctaatcctaaagcatttcagattggaaggtaaccaaagtgtgagacaatgaacttataataaggaaatgcagcagccctcttggaggaaggataccataaaaccctacatggtatactcccacttccgttttgggaaagatttagccattgactcaacagtaactgaactgaataaggagctacccaggtgaacaaagtatgtgtacatttctgggcaaggttgtagcttctgttcagggacagtgggtaccttttcagagtgtctcctggttctgtggtgttatggctcctttttttaaacttgtgtttctc

SEQ ID NO: 11130 - DNA, 1050 bp, Homo sapiens
gagtatagcatatatatgtcacctgaaggaaacttgatcagcttatcatctgtccttttttttttattatggtgtcacctgtcttctcttttatttattttttattttgagagacggagtcttgctctgttgcccaggctggagtacagtggcataatctcagctcactgcaacctccgccctctgggttcaagcgattctcctgcctcagcttcccaagtagctgggactacaggcatgtggcgctacacccagctaatttttgtattttttagtagagacggggtttcactatatgttggccaggctggtctcaaactcctgacctctcaaacaccagagtgagactctctctaaaaatggaaaataaattttaaaatgttataattaaagatactcatttaaattgaataaatttagctttatgaaaaatttgctgtatcatctttattttgatcctttcgtcataggccattgaaaacttaatcataaaatggtacatgtatatctgaatttttaagactgactgaccaaggggactacagaatacccagtagaatcaaagtaattgtcatgttcctctgtattaatctagtctactttgggaccttgagttctcacctctcattcttttgctaacttcctctttaccctttagttatgtctccttttttttttttttttttttccagagatagcgtcttgttctgtcgcccaggctggagtgcagtggtgtaatcagctcactacaaccttcaactcctgggctccagtgattctcccaccacagcctctggagtagctgggattacaggcacataccaccatgcccagctaatttttttaaatgttttctagagactcagtctcgctatgttgcctaggctggtctcaaactcctcacctcaagcaaggcttccccttttatctcccaaacccctgggattacaggcatgggccgctctgccaggcctgttttttctctttttctttctctgtaccactttcatattgtggcttcttccctgcccccgatctcccccctaccca

SEQ ID NO: 11131 - DNA, 1060 bp, Homo sapiens
attttctatattatttctgtgcctttaaaaaaaattatgactagtcctttctgggaacagtggagtgtttaatggaacgtggacctttcgatatgcttatgaaatattgtaccccaatccccatccaaggtcaagaagttacgaactctgcttccaggaaattttttttttttttttttttgagacggagtttcactcttgttgcccaggctggggtgcaatggcgcgacctcagctcactgcaacctccatctcccaggttcaagagattctcctgcctcagcctcccaagtagctgggattacaggcacccgccaccacccctggctaattttttgtatttttagtagagatgggggtctcaccatgttggccaggctggtcttgaactcctgacctcaggtgatccacccgcctcagcctcccaaagtgctgggattacaggcatgagccaccgtgcctggccagaaaattttttgcataccttatttcgccccattcccttctctcatgaacaaaactgtctattgttgttactcttgtcaaccctcgcttatatgtctaatagttcctactgtgcctgtctccccagcctgtgccctcgaagcatcaatggtgggcatggtatgttcctgacatgctcacatgtcagctttagatgttccaacgtcatggtcaaccagatgaccattgaagcctgtctccccttactgatacttgctcactttgcctgggtgaagatacatgttcatatccttaaggaagcatgaaaatgttatctgactacctagaatatttccacttaacgataactcagattctgaggacaaggccagataaaaggccaaatcagacaatctttgaaagcatagtgtttcgtttggttggggtgtatggtaatccctcacctccccatggacctgccagtaggtccgtgaatcttgctttatggtttgcaggaggacttcagctttccctactaacagcctaaagccagagaatccagacagacccttgggtcatgagaacagtcagatgagtagctcctgagataaaaata

SEQ ID NO: 11132 - DNA, 1064 bp, Homo sapiens
attaagaaattcgtcattcgaaacatagtggaggccgcagcagtcagggacatttctgaagcgagcgtcttcgatggtaagtgggtcaccggcgcgaactgtgtgaggatcccagtatcttaaagccttcgcccaacttcgcccttttggaggctctgttctttggagcctctcaggcaatttccacgtatttaaggttgttactggtagaagagaattctcttgtttgccgttttgattcttttctgggcagagggtgactttgtgatagagtgcacagcctttactctgaggtaaaggtttgcctgtttcggttatgagattgcaaaaactagaaacttggtaaatttgacaattcttgtgctattgattatttgaatatttgtgaaaatatacaggtgaggaagaatgtcttcaacgtttcgagaatggaggccgtctagtttggtgtgcaaggatgatgtttggagcaataagaacgtcgctttgtttttttccttttatagaaagagcaaggttcagggtaggcattagggcgggtgtaggtgtagaaggaactggattattggtttattgcatttagaatgtcagtctggtccttgcggtgtcaagatgaactcacgtgggatgttaattcacttgtaaaactgagggttatacatatgtgctcaggtattgggctgaacaggtgctttgggggtgcttttatgtgcccgacaggcatttaaataggtttagttttaattgacgtaaacatgtaaggtgctcttcattcatgtaacaaaaaagcaaggtaggtatataataccagtataactctattttctattccttagcctatgtgcttcccaagctgtatgtgaagctacattactgtgtgagttgtgcaattcacagcaaagtagtcaggaatcgatctcgtgaagcccgcaaggaccgaacacccccaccccgatttagacctgcggtgagtattttaaaaggagaatggaagccaggggagtgatggttaaaatttcatcctggagggtcagggtgtcctatacctgtaacctcaacacttt

SEQ ID NO: 11133 - DNA, 1044 bp, Homo sapiens
ccagttcctaatgcagtactctgatcttgcctttcagtgaccttggggtccatgtggatggcttcatcgctaatgtagctcacacttttgtggttgatgtagctcaggtaggtggcctgcttttgatctctgtttagccttggggtagagggaatgcactgccatttgcttcttatccccacccccaatcaccacgtaagttgagagagtctctagagaagcaaaaggagaaaggtttttgttgttgttgttgtttttaccctcctgttcattggctggtcttcgcatatgggctcacagatattaaccagatagccagctgagttaacagactttccaggaagatactgattgcatgtccttatctacaggggacccaagtaacagggaggaaagcagatgttattaaggcagctcacctttgtgctgaagctgccctacgcctggtcaaacctggaaatcaggtaagctattttatccaattccaaagctcgtttgaaccaaagatgcattaggcacctatagctactctatatgaaactaccaacctcccctacagaccccttataaaacagctttttaaaattagctatatttagctgggcacagtgactcacatctgtaatcccatcactttggggggccaaggtaggaggatagcttgaggctgggagttcaagaccagcctgggaaacatggtgaaaccccatttctacaaaaaatacaaaaattagctgggcgtggtaacatgtgcctgtattcccagcttccagggaggctgaggtgggagaatcacctgagcctgggagattgaggctgtgctgagctatgatcatgccactgcactccagcctgggcaacaatgaaaccctgtctcacaaaagaaaaaggaaaaataagcatttgctgtccccacaaaacagattagaatgccaggtaaaaaaggataaacactggacttaatattataggcatgtggtggcacatgcctgtaatcccagcactttgggaggccaaggtgggaggattgcttgaacccaggca

SEQ ID NO: 11134 - DNA, 1041 bp, Homo sapiens
gtttatgaccaagttctttcacttaacactcatttaacctggggcaaatcatttaacctgagactcagtttccttgtcttctagattgggatatacatctgccctgttcacatgcaaaatttattgagttagaccatctttgtgaaagcactgggtaaaatgatatgcagttacagctggtcctcagcttgatgctacattcagtagaagctatactttgagtacccatacaaccattctgtttttcattttccatatagtatttagtaaattacatgagatattcaacactaatataaaataggcatgtgttagataattctgcccaactgtaggataatgttttttaagtgctctgagcacatttaacataggctaggctgtgatgttaggtaggttaggggtattaaatgcatttttgacttagtgatattttcaacttatgagttttttggagatgtaaccccattgcaagttggggagcatctgtataaagtatttttagattgtagggataatcaagctatgaaatgaaaaaccagtgaatgacaatcattggggcttgatggaggatattagaacgctcagttctgccaggtgcaatggctcatgcctgtaatcccagcactttgggaggctgaggtgggcagatcacgaggtcaggagatcgagaccatcctggccaacatggtgaaaccccgtctcttctaaaaatacaaaaattagctgggcgtggtgttgcgtgcctgtaatcccagctactcaggaggctgaggcaggagaatagcttgaacccgggaggcagagattgcagtgagccaagatcacgccactgcactccagcctggtgacaaagccagactccatctcaaaaaaaaaaaaaaaaacgctcagttcttttatgcttcttattctcattgtagagaacttattagctcctgatatctcacctttcatttgatgttgtacttctagaacacacaagtgacagaagcctggaacaaagttgcccactcatttaactgcacgccaatagaaggt

SEQ ID NO: 11135 - DNA, 1044 bp, Homo sapiens
ctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgtttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataatgatgtgctttgta

SEQ ID NO: 11136 - DNA, 1022 bp, Homo sapiens
agttttaaaaatagtcccatctgtttctggtctctgtctgtatgtgctattcccaggttgcctcagtaaccagggctcctagggtcatttagcagggcaggcagtaaggagagtgtatttgctgaaatgcggatgggatgttacatagttgacagatccttattcaaacagagcaggacaggtggagttgatggccattgagttgatggcagttgccgctcagttgatggcagttaatgtccctcctaccccaccccttcagtggccagttcctgaagccttcaaggcttgggaggtctgggaaaagagagtccttctagggacacaagcctcagggtccatccctttcctctgtctccacataggaccagaagttttaaatctacttaagtcagtaaggccaggggccccaatagtcaaacctcagttcctcctcagctcacggctgatgtagggaaaacaactcaggtgtctagtctaatgggacagtagatttgggggtagagagtgatcctggattgtgttccccctcatcatgtctcctgctacctcttgctttcttgtctggttgatcactcaggtcacatctgggattggagatggtgggctaggtcaaggccagtcattaaaaaaaaaagcctaaagactaaaagtgggctaacattgtggattttagaaacaacacattgataagcttaatgttttttgggacacaatttttttttttttttttgagatggagtcttgcccagtcaccagaccggagtgcagtggcgcaatctcggttcactgtaacctgcgcctcctgggttcaagcgattctcttgcgtcagcctcccgagtagctgagactacaggcgcccgccaccacgcccggctaatttttttatttttagtagagacggggtttcatcgtgttggccagaatggtctctatctctcgtgatccgcccgcctcagcctcccaaagtgctgggattacaggcatgaaccaccgtgcccggcaattctagactattaaa

SEQ ID NO: 11137 - DNA, 1100 bp, Homo sapiens
agcttcccaggccctggactggaaaggggaggagaaagagggccaaatggctctaggggacctgtagcctaggcagcaagtgtttgtctcctcctcatcatcatggaaaccaatcttcctacccccaatacaaagcgcaggtgtcctttcccttaaaaggagtcacacagagaaagatagaggaaaacacacacacacaccccaaaaaacccacaaagccaggcctaattaggtcttctggcccctccctgactcaaggaaggacttgcttccctcttcaccttcctgctctagaagccccgtctgaggggagttgagaaggctggaaaaggggacttttttttttttcttttttgagacggagtctcgctctgttgccaagctggagtgcagtggcccgaacttggcacactgcaacctctgcctcttcaagcgattctcctgcctcagcctcctgggtagctgggattacagtcacgcgccaccacgcccggctaattttgtatttttagtagagacagggtttcaccatgctggtcaggctggtgtcgaactcctgacctcgtgatccgccggcctcggcctcccaaagtgctgggattacagatgcgagccaccgcggccagcctggaaccaggactttttaaatcccaggattccctcaaactccaatttgactggacctccccctccagaaagaatgcgcccttctcctcctcccgctcctctctctctcagcagctgtcatttcaccacgtccctgagctatccacagggcaacagcgtgacctctaccttgtcagctccccttattagagagacatcagcccccaaactctgtgaggaatgaacctttggggcatcctcgcccctcgcccaccctgagtgtgaggagtcacacacactccctctcctctgtggcacaccaccagcatcttagtaggaaaccagaggcgagggtgtgctgcacgtcactgtctctgccttccccacctccaggtcagcttcccagacgtggaaaaggctgaatggctcaataaggtgaggattgatttgatttttagtcttcatgaggggagaatgggaatttgtttcttctt

SEQ ID NO: 11138 - DNA, 1037 bp, Homo sapiens
ctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactcaaaccagctgtggttcttttccttaaggatagggaatcaatctacccatctgatgtttattcctactgtcaaaagcctttatccaattcgtgaatcatgtcagtttaattaatggtcaaagcctactaaggttgcagccaccaagaatgttgaggatggtcaagagacctgtgtaaagtagctgctgttgcatttcaggtgagactcatttccagtcacagtgatgaactctgttacccatccaacttgtctgctgaccactataggctttccagggaagggattcctaaacctggtaaacctgggagctctgtgccactgcacaggctcctggtgtctctgtgccactgcacaggctcctggtgtctctgtgctgtcagggcatgctcagctacattcaaaagggcttc

SEQ ID NO: 11139 - DNA, 1059 bp, Homo sapiens
accgcaccgacctgacagggttattctttaagtatagctagcatttcccaagtcagttagtctgagcttgtgtcagactcgtactccgtgctcagtcccaagttagggctcttacggggatccacgaactggatggggagggggagaaaaggcactgaggaacagtttccttgcatttggccagggactatccaacatggtctggaagtttctgactgtctcttacccattcccagatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtgaatttggc

SEQ ID NO: 11140 - DNA, 1073 bp, Homo sapiens
gggacgttgcaattgctctttaatctatttggtgcgtttggtataggaaactgagtatttaaaacctaaactgtaaattaacctaccagactttagataagcaatctgccaatataaatattgtgtaggttctcttgttagccataaggctatacatgttttggctctagctttctccttgcagactgcttgaaataaaggattggcagattcacattaaagcacaacattaagccttgttccttcataggaatttggatttgtgtgaagacaatgggaagccatggaagggttttttttttttttttcagagtgtcactctgtcacccaggctggagtgcagtgacgccatctcagctcaagcgatgacccttgggttcaagcgattctcatgcatcagcctccctagtagctggaattacagttatgtgccaccattcccagctaatttttttgtattggtagtagaggtggggttttgccatgttggccaggctggtctcgaactcctgacctcaactgattcacctgccttggcctcccaaagtgctgggattacagatgtgagctaccattcctggctcattgaagggttttaagcagagtagaaacataatcagagttgtgttttgtttgtttgtttgtttatttatgagacagggtctctgtcatccaagctggagtgcagtggcatgatcatggctcactgcagcttcaaccttcccaggctcaggtgatcctcccacctcggcctcccgagtagctgggattatgggcatgtgccaccacacccggctaatttttgtattttgtgtagagacggggttttgcaatattggccaagctggtctcgaactcctaggctcaagtgatcttcccacctcggccttccaaagtgctgggattacaggtgtgagccaccgcccccggcctcagagttgtgttttataaataaactctggagccctgtagagggcaaataggagggtagagagaaaccagaggtggagcaatcctagcagactgttgccggaaaccaggtgagaaatactgatggcctgagctaaggcagt

SEQ ID NO: 11141 - DNA, 1057 bp, Homo sapiens
cagcacaagagagggagagagagcacgagcaatcaagggagccagagggaggatcttattttattttattccatgttcccatttctcggctctcgtttcctcacagactctcacccctccctgtctgaactcccctacaaggtcgcttcagccgtgcccccccaactcttcctttttatcttggctgtctacagtagtgggtgggggcgggactgcccaaagccaggggattcgccaggatcagagaagcacagacggcactttgtctgagatcagagatgggggtgacaccctggaacctctccttaccctgctgaacctcctcccctccccctgccccttacttctaccccctgcccctgtctggtagaagtcactggcctgaatcaccccagccaggttctgactgggtacaagacataggggtgctctggtctgctgggaggagatggcttggaggcatttggggtcataacatctgatggcatggggataggggggacctggatgactgggcttctggaaagaacagcggttgggtgagattagggaccagagttcaaatggcccacccttcagctttcccaggaaacctaacctccctcccccaatgccctctctcagattcaggccctgccctctccaagcccacttctggggcctcttctccctcccactgtaccctgggacccctccctccaccctctctcaggcccaccctccaggtgttagctgctggcttaagcctgtctgtgggagtcaatcattcttgctgcccccgccccctcacctgggctgagaggagggatggatgggagggggaatgaggggggcgataaatatgtatgacgagcgggtggtggcagcattaataacccgggatcgcagcgtggcggggacggggaccaggcggtggagattctagcccagcagcttggctctgctgttcctgtccccagtgacactgtgtgtgtacacatgggtgtgggcaaacagaggggggcacccatgcttcctggcctccttacctacccacagcacagcctgtgggccagtg

SEQ ID NO: 11142 - DNA, 1084 bp, Homo sapiens
atgggctggctgatggtcttggcggcaggattggtgtgggaaaggagttatttattgaatacctactgtggaccatacagatggaacaggccttgccctgtcctgcatgtcacagtggatgaggaagataagatcccagttatagtgcctaccacagagtggacagagcagtgaggcggtgtgtcctaggactggtgttctggggacagagaactgtggagttgaagggagtggttaagtccgggggtccttccacccaggccttcttacttcctctcacttcgcagtctcacccacggctacatgtctgacgtcaagcggatatcagccacgtccatcttcttcgagtctatgccctataagctcaacgtgagtgctctagggtgtggggaggggctcttggccctggtggtggtcctcccctggagaagctgagggcctggagcgccgggccgtccttagggttaaggaggagagtgagctgccctgcttccttctcagggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggttggtggggggggctggagactgggcacctccccagggggtggtgaggaggtgtgggaggagggcagccttgggcaggcctctccgggccctccccaggctgaggccttgcctctgtacctgcccaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcaggctccctgaggtcgggccttgcctttccctgccttcaggcctattcctggggcactgttggcctggacctgagaggaattcattcccacctgcagcccttaagactcctgcccagtctgtgagagttctccttctcttgcccatggtggccatgccctg

SEQ ID NO: 11143 - DNA, 1024 bp, Homo sapiens
ccatgcttcagtccactctgtcccttcaacatttgaaagacgactctcatcccatgtaaacaacattgactgccttgcatcagaatgtctgcctgagagattgtggagtagcaccaacccagaggaccccaccccactaggcagtcaggttggccatggagcagcgactgagaaacaaagagcccctccctcttggcatgggggtcgggtgggagacatgagtataggaggtagggcaaggctcctgctttgttcattctgtgttatttcccttgtatacccagctggttgaagctcagacacaggcacccaaataagaagaggggtctgatggccctacagttgctggtggacacccttacctggtgcaccgtgtaagttgactggccatggagcaagggagggcagatggacagattgtactgtaatggctggcccaaaagggagtagcgcccatcacctagggagtaagagcaattggttttctgggagcttaagcttcatagtatgacttttataagacttcaaggggctttggagacagcaacaatgcatactattcctaattttctatgatggaaatgcccatgcgactggtataagagttgtttctcttcctaaatcctttggctctcaactgtgtctcacagataaatgggactactaggtcccatcatccttgaagaaaggctctatccactgtagacaacagtcctatgaaaatgaccagggaagaaacttacagacccttatgaatgtcttttatctctctttttttttttttttgagacagagtttcactcgccacccaggctggagtgcaatggcatgatctcggctcactgcaacctctgcctcctgggaagcgattctcctgcttcagcctcccgagtagctgggattacaagcatgtgccaccacgcctggctaatttttttttgtatttttagtagagatggggtttcaccacgttggccaggcagtcttgaactcctgacctcaggtgatccgcctgccccgggct

SEQ ID NO: 11144 - DNA, 1030 bp, Homo sapiens
gatatatagcagcagctgggaagaagggttgaggttaatgtgagggaatcggggaggcagtgactgtaggctaagaatggttggaaagatgataggagccttagtgtagtgtcagtgctaaagaggggatgttgatacaggatgtgtacagctcagatgtcaaggatgatgaaacttgaaaaggaatactgcattgagtgccttcagacagcaggttgaatggcatgaccagcaacgatctagaaaagtgggaaggagagggtgacggtgaaggcaaaactggtgcctgctggtttgagttaggccatgaggaagtgacagacatgggttagagagtcggtacaaaaggacttgttacgggtcgtatctaggctggtgagctctttggatttcagatagtggctagagattatagtaacatagcacctggaaagaaggggagaagccagcgctgggaaagtgttcttgggagtggtgagagggtaatgattggacagagcctagggagagtttgagcctgagaatgaggtaatagaaaacaagcagtcatgacagtaaaagggacagaaattggtgttgaacaaggctccttcatagcagtacaggagacttcctcactgtggcagtgccctgtatttgcatctctggggatcttagagtgcctcgggaagctgtggtcctgtgggtttgtgtgcagaaagacttcaagtgtacatgaacacatgacagtagaacaaatctgtgtccgggtgttctgtgcacttttcgtccctgttgaccctcacatccccccatgcactgttctcttcctctttccttactaggttgcctgtggctggagaaaggaatgtgctcatcaccagtgccctcccttacgtcaacaatgtcccccaccttgggaacatcattggttgtgtgctcagtgccgatgtctttgccaggtggagccagctgctcggggagagacctcctaagggaagggcgggtcccaggggaataggatgcttcaagggtggggctggggagatcc

SEQ ID NO: 11145 - DNA, 1050 bp, Homo sapiens
gatggtctcaatctcttgacctcatgatccgcctgcctcggcctcccaaaatgctggaattacaggcgtgagccaccgcgcccggcccacacttgtttcttatataagccatctctccctgacttgtagcttcctcaaagagaggggctatgtcttcacttcatcactccttcctcccctcacacagccaagtacagtgcagtgctctgtacctagcctatgttcagagaatgttttttttactctggtgtgatgggacagagatctgaaactctgagaacaaatggagttatactgagaagatttgagtctccatgtttagagtaggccacatagtagagttattggagtgtgagcctgaagctaaactagatggcagactgaggagctaatccttctctgctcctccccttgcctggacccctcccctggcctgcaggcctgatctgtcctctggaattttccttcgcagaagcctcagtgtaaagtctgccgatcatgccctgtggtgcagtcgagccagcacctgtttctggacctgcctaaggtaagtgagcttttctctcaacctagttttcaggaggcctcttctgtcccctctgccttagccacaaatactgagagcagattactcttaaaagttttaaatttccattaagaattgtacatactattgtcaagagatgaaatagattaaagggcacaaagtgaaagccccaggcccacttgcgagaggtatttactactttttcctttgtgtctattcagaaatgtcatatgcatataaaagtatttttatgtctctctttttttttaagggatagcttctcactctgtcacctaagctggaatgcagtggcatgatcatagctcactgcagccttgatatcctaggaccaagcaatcctctcacctcagcctcccaagtaccatgcctgactgatttttttttttttttttttttttttgagacagagtttcgctcttgtcgcccaggctggtgtgcaatggcgcactcttggctcactgcaaccttcgcctcctgggttc

SEQ ID NO: 11146 - DNA, 1046 bp, Homo sapiens
ggctgcagtgagccatgattgaaccattgcactgcagcttgggtgacagactgagactctgtatcaaaaagaaaaaaagaaaaaattagccaaatgtggtggtgcacatctctggccccagctacttgggaggctaaggtaggagggttgctttgagcccaggagctggaagctatagtgagccatgattgtaccactgcattccagtctgggcagcaaagtgagaccctgtctcaaaaataaataaatacataaaatataatagtcctcaggttgggtttgttgggtgtttcctcatgatttcaggctatgcattcttggttggaatactacataaatgacattgtgtccttttcagagccacgtgatggccatccccttcactgggaatcttaattttgtttggtcaggtgttattcaatttgttcactgtgtgattaatattttccccattgcaacttatgagcagtctgggaatacactttatttttttcttttcttgagatggagtcccgctctgttgcccagactgtagtgcagtgttgtgatttcagctcactgcaacctccacctcccaggttcaagtgattctcctgtctcagccttcgagtagctgggattacaggcacataccaccatgcctggctaatttttgtctttttttttttttttttttaattgaccattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggttatagatcaacagcatcccaaggcagaagaatttttcttagtacagaacaaaatgaaaagtctcc

SEQ ID NO: 11147 - DNA, 1048 bp, Homo sapiens
taccttggtcagccacctcattgctacaggtaagtaccctggaagactactgatggggtgttcataggaaatgaggggtgaggcagtacttggaaaaagatcttggagagctgctatcttgagttaggagttgagctgaaataggaaataattaaaatgagaactcaacctagagaaacgaacaagaacctgaagaaagcaaaagtctaaagctaaaactctttagtagatataagcaaagagaaaaaagggccagaatggataggaagggactcccaaaatctgagcataccagccccttaaggagaaatgttgctagacacccatagttgaggttagaaagaggaaagaaggaagagttagtgggctagagaggggaaggatgtgatgtgagcagatggttctcactcattctcctctgtccagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacaggtaggacttggtaaggggtcagagttagcagtgagctggggtggggctcattttccctcaggagatgggaatgtggagagaactagaaaatgggcaggaggctgtgaggacactgtggaaagttgatttctattaattgggatctgttcctagcacatactaggctatgtgtgcttgatggaacagttagctgtagagatgtgatttagcaaagttggttataaagtgggtttttgtaaattgtttccttattactgttctttgtagaattgaagatgtattctctcccagcaaaatagttcacctgcagatcattgaaaagtttggctgaagaaaggggttattttggtgtgggggtaggaggcttctgtgggctgggcatggtggcttacatttgtaatcccagca

SEQ ID NO: 11148 - DNA, 1027 bp, Homo sapiens
gctagcagatagtgggcagggaaaatacaggaaagccatttcctctttgacacaaaatgaaaaagtaagtacattgctaaacttctggatcagcctagcatccttagagagcttaaagaatctttgaccctacaaattatttggggtttcacagggaaagctacagctaatttcctaaaatcagcagatattagctcagtgttaagctcgttctttctaaaacacatcagagattggggttggagaggtcatctgtatagtctatggtagagtctgtatccaatcagtagatgattctggaactctttttttacaggtcagtcccttgttccaaaaattggaaaatgaccagattgaaagtttaaggcagcgctttggagggggccaggtgagaaagctaaaggctgtgccctcgctccacaacagccacagcatcacttccctaatttccctaagtagtcctcacccatcactctttccatcttttggccctgccgcttcctcacttacagtttttctttcctgtcttaactagaagagaccttcgacttaaaggtaaccactttccctctgagatgctgtataaaactggaggttaggggatatttatggttgctggtgataactttgttgttctccaggcaaaaacgtccccgaagccagcagttgtagagactgttacaacagccaagccacagcagatacaagcgctgatggatgaagtgacaaaacaagtatgaagcttaagccctgtgggagactggacaagctgaatcctaaatagatctttttcttgcctcactgttacctccccacccccctttatcttagggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataa

SEQ ID NO: 11149 - DNA, 1050 bp, Homo sapiens
tggaaaggatggttgtagactaagccagcagatccccgagatctttataggtgcttgcctcacattgttaaggatctttcttttgagagggtgctgggctgtgctgctctttagagttgggcagactcctgacagtcccatctctctacttgcgttgcaggtgtgggctaagctggtggccccggctttagactggaccccacaatgtttgcagagatgttcaggtagctgtggtgatacggcagaggactcctcagtctccctcccagctgaggggttccccttgctcctctggggcttcccctgagttttcttgggtctccccacaacctttgccttcctggagtcctctctcaggtacttcgctcagtttaatcctcctagtgcctacatggatgtctgtgttatcaggcacgcgggagctgattacacacaatgaatgggggcaatgagagcagtggagcagacagagctgggggccctgtggccacatctgtccccatcggctggcagcgctgtgtgcgagagggtgctgtgctctacatcaggtacggatcttcacaggtccccaagctctgccactccagttgcccaggttttctttcttccgtttcttctctcagctcagctctctggtacccgattgctctcctctcttccccttccttcctcagcctttttgctttctgtagctctgggcctttgaatccattctccctttttctgtgtcttcccacattccttatcctctgttcttctaggaggatctgtaacttaagcactgtgctttaggagtattgcctgattcgctgccagctaaccccatgtcctctgaccctgtcctctcgcagtccaagtggcacagagctgtcttccttggagcaaacccggagctacctcctcagcgatgggacctgcaagtgcggtctggagtgtccacttaatgtccccaaggtcagagtggtgaggggcgcctgagagtacagagataagctaaaagtcttaatgcaaatcactgactgaggtagcccttctcacaggttccagccc

SEQ ID NO: 11150 - DNA, 1043 bp, Homo sapiens
ggggtcagatgcacaccttcctcctcccccaaccctctcctcagggagccctccccagcccaggcaccccatccagccctccctgcctgggaccaccagtggcagcctcagcagtgtgccaggtatgtgagtattgtggagcccttcctcatcctggctggaaagaggcagccaaggcatttaggggaatgttcagagagctctttgagggttttctgggttgggggcagggaggttggcttctttggatgatgggagaaagggcctcccttgagctgaatttctctcctcttttacaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccaggtgaggatgggggtgagtaggtgggacagaacaagatgtagaataagagatgggagctgggaatcaaaagctttcagtttca

SEQ ID NO: 11151 - DNA, 1046 bp, Homo sapiens
ttccccagggtttgaagagggatttcgttgttctccctgatcccagcctttctttgcttccttgccccccgaccctcccttctttcccagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaaggtgaaagggactgggttagatagaatgagggcttggaaactagcagttcatccaagaactggagtccactgaatgaggcaggatctaggggacctgtagtggttaagaagaccactggaggagtagacagattacacggacaggaaagaagcaaagaatcctgcaaccactgatgacactttgctgaacgtaggagcaggttaggatagaagatctcagaaaagggctaaagcaagattgagggtctgcgtggggtaggaggagtacttccttaagcctacttgctaaagtcaccccctgccctatcactctgctccagtatcctgttttattttcatcgtagcacttttcatgatctgaaatcatatttactgaatcagtttgtttattttcggtctgattccccgcattagagtgtaaactccatgaggtcaaagaattaatcttgttcacagttgtattcccagtggccagaacagtgccaggaatgttcaagaagttcaattaatatttaattttgggttcttctatgtttccctaatataattgcttcagggataccataatttcttatctttatggagggcaaataaggatttaaaaaatcttttaaaagggaggaatggaaagaccacaagtggaaaacagactttagagatatctctccaagtcacagaaggaaagcagccctccctccttactgaaagtctggagaattgagagtggaagtgaagggaagagaattgagtgtgtaagtagatgagaggttatgtgtcttg

SEQ ID NO: 11152 - DNA, 1055 bp, Homo sapiens
aagacaaggctggggttccagtggctcagagtgctgccatgcaggaagagcccctcaggacatgggtgtcctcattccctgccttcccccagctgcctggcccaggacttccctgggctcaacggccagtagctccagcccacctctaccctctcccaccaggtgccgggagctgaagaggcccagaaggaacgccagcggcagaaagagctggagagcaattaccgccgggtgtggggctctccaggtggggagggcacaggggacctggacgaatttgacttctgagaccaacactacacttgacccttcacggaatccagactcttcctggactggcttgcctcctccccacctccccaccctggaacccctgagggccaaacagcagagtggagctgagctgtggacctctcgggcaactctgtgggtgtgggggccctgggtgaatgctgctgcccctgctggcagccaccttgagacctcaccgggcctgtgatatttgctctcctgaactctcactcaatcctcttcctctcctctgtggcttttcctgttattgtcccctaatgataggatattccctgctgcctacctggagattcagtaggatcttttgagtggaggtgggtagagagagcaaggagggcaggacacttagcaggcactgagcaagcaggcccccacctgcccttagtgatgtttggagtcgttttaccctcttctattgaattgccttgggatttccttctccctttccctgcccaccctgtcccctacaatttgtgcttctgagttgaggagccttcacctctgttgctgaggaaatggtagaatgctgcctatcacctccagcacaatcccagtgaaaaaggtgtgaagcacccaccatgttcttgaacaatcaggtttctaaataaacaactggaccatcaatccatcaaccttttttgtggggtgggggttccagcagggagaaggctcagtgttcttttcagatcatgctctgatcctgttctttgctccccattccccaggtactataaacgggggct

SEQ ID NO: 11153 - DNA, 1207 bp, Homo sapiens
ggatcttggacacgtctccttgccctgccctgtcccataatctacgaaacaagagctgattttattgctttcaatttgacatggtggtgtaagttctatgaacagatgagaccagacagttattatagatgaaacataaaggaatctaggacttttttccataacctttcctctcagtacatgatcatccttggtttggtcttcatcttccaatttgtaatctcttgctcatgtctggctattaaccgaagcaaacaggtaagacagtaccctttcaagtacttacttgctttttaaaattttcctcttaacctcgaactccttccttagtctggccccaactacccaaagatcatccttaggtgcactgcttctggcctcttgggctatttgcttcctctgggatgtctggttaattttccatgaggatgatctagagaacctcaaaaggtagatatttatcgtgtctataattgttgcacaccgttatgcttctgtttgacttcctttgctgggctagggaaattgaggcacttgaactgataacaggatgtagggagacttaatttccctctacccatatctttcagacagatgtcatcaatgcttcttggtgggtcatgagcaacaagactcgggatgaactggaaagaagttttgattgttgtggcttattcaacctcacaaccctgtatcaacaagattatgatttctgcactgcagtgagtgtgttgggggtggtgcagcagccaggggaggtaggaaactgggtaaggacaatgcccaagttggcaaatttagtttgaatgtcattgtttctctctctacaagccctcttgtattggggctgtgttggtgggaggtgggggtggatagaggctggggaattagccaagtaggattttagtttgtaggacactggtcagataacagtaaagtttctagggacattcggcataggtattagtcactagcaactttacattcacaactttgcattcttcacgttttatcctcagatctgcaagagccagagccccacatgccagatgtgtggagaaaagtttcttaagcattcagacgaagccctgaaaatcctagggggtgttggactcttctttagctttacagaggtaacattctccagttccctcacacacatcctttttgagactgagaattaattgatacttatctctctcccttt

SEQ ID NO: 11154 - DNA, 1052 bp, Homo sapiens
tgcacctccttgggcagctgcggccaccagatgcccgttccagctcccattctggccgagaggttgtcatgagggtcactacagtctgaactggactccaggagcagggatcttgagtcaatgcatcagtcagagaagaactctcatggctgctggaggtaccagctggacaaggtgtttggggcatgctgcccccgtcaccgaggatctgtgtgggtagcctcaagctggagacattgtctggcctcactgcccactgggtagagacacctggatgacatttcagtacccgctggcagctcctcccactcatccagagacggccggtgggcaggcggggagagcagctttccttccctggagagaaccgtctttacctcagctcctagggcctccagccccccagctccaccacggtgacttggtgaagggggaccaatgccagaagaaaggggctgtagacccctattccccaccccatggccacagggcatctggcaataagactagtatacattgacctcccgttccctgcatgagggcggggagttccccctgctccatcccccattgcatgggggaagggcataaagaatcatttatatgcacgtggagactcctttctcatctggggcttttctggagggttgggagatgtggggaggtttctctgcacaggttgcaaatcccaaatgcagcagtgggttctgagttgtaggtgtgactcccacttgctggtgaataattcatgttggctgctaggtggcagcactccgaggtatctaaagggtagacctggacctgccacctatgagttgtgtgatatagaaaaaaatctcttagctctggttttcctgtctacttcatagggttggaataaggataaatgagggacaggttggatgccgttgcagagaaaatcagcaatgacataaagagatttctagaatagttgatggtccatttatttcaaatagtagctggtgtaacaaattctaaaatgtgtttttcatctggagttgcacagaatcatggaattttgtgttgagtga

SEQ ID NO: 11155 - DNA, 1046 bp, Homo sapiens
tcccctccttttcttgtctacctcactcctgagcagcccatcacctcatgcctttaaatgtcctgttgaagccggacgcggtggcttacgcctgtaatccgagcactttgggaggctaaggtgggtggatcacctgaggtcaggagtttgagactagcctgaccaacatggtgaaaccccatctctactaaaaatacaaaattagccgggcgtggtggcaggcgcctgtaatcccagctacttgcgaggctgaggcaggagaattgcttaaacctgggaggcggaggttgcaatgagccgagatcatgccattgccctccagcctgggcaacaagtgcgagactccatctcaaaaaaaaaaaaaaaaaaatgccccgttggtgatcatgactctaagactatcccatttctatctccagacttgcttgcataacctagtgcctactcagtatcttcatgtggttgtctgatgtgatatagaagtccatgtcaaacttaacgtgctcagaaaatgaactcatgatcttcctgtccaaattgcgcctcctgcaacctttctcatctaaatgagtggcaatttggtcttctagttggtcaggccaaacacccagaaaccatcctgagctttttttttttttttgagacaggttctcactctgttgcccaggctggagtgaaagtagcacaatcatggctcactaaagccctgaactttcaacctcccgaggctcaagcaatcctctgacctcagcctcccgagtagctgggactacaggatgtgccaccacacccagctaatttttgtattttttatagagacgaggttttgctatgttgcccagactggtctcaaactcctggactcaagcagtcatcccgcattggcctcccaaagtgtaatccaaagggattacaggcgtgagccactgtgcctggcccatcccaagcttttctctctctctcatattttatatccaatctattggcaaatcctgttgactctaccttcaaaatatattcaggatctgaccatttcttagccattg

SEQ ID NO: 11156 - DNA, 1012 bp, Homo sapiens
ctggttttttttggtttgagttcctaggtagctcagatgtccattgagcggctacaatgtgccggagctgtcctaggccatttgctgagctgagttttttactcacggagagctccacttccaacagacacagttccttcagccactcacctcctttttggcagggtttacatcctcaggcagctcctgattctggtttttcaacagaactgctatagggtaatattttggctcactgtcattagaattcagggagagggttgcattcttcatgtcctaggtaagataagaatgtaggcacagggaaaagactcctcagtgtctgtgtggttacagttctgaatgtgtataatatttaacattttgacttatgccacttcaccctctgtaatcatctttgataacaatgctccccaaacctggctgcatgtcagaatcatctgggaatagaaaatattcagattttggggttgttcttgggaaagctgattcagtaagtccaaggcaagtcctgtatagctagtttggcatacatcttgtgtctggatctcatttgaatattgggatcacataccttctcttggtacttttatttagccctgcatttccagcctttaaatgactttaggttgtagtcctacttaaatacaatttaaagatactacatcaacattagctttggaatctgagtttgtagagcacaaaggacagaattgccagatggtttgaacacctggtgccatgcactcctcctgaggttaaagaactgctggattcctggctagaggctccacttcttttaaccattaaaataggtgtaaatggcctaagtttctgtggacttcactgtcagaaatgaataaaaatgtcatttgggttagaagcttatttctgaaaaatactgccaatgactttaatctctccttaaacggcagagttgaataataaaacaaatattcatttttttgttgttgtgtttttgagacggactctcgctctgttgcccaggctg

SEQ ID NO: 11157 - DNA, 1029 bp, Homo sapiens
cagtcctcccaataagatttaagaaagagcagttgaaggccaggcacagtggctcatgcctgtaatcccagcactttgggaggctgaggcgggtggatcacctgaggtcaggggttcaagactagcctgactaacatggtgaaaccccatctctactaaaaatagaaaaattagctgggcatggtggtgcatgcctataatcccagctacttgggaggctgaggcaggagaattgcttgaacccaggaggtagaggttgcagtgagccgagattgtgccattacactccagcctggacaacaagagcgaaattctgtctcaaaaaaagaaaaaaaaaagttgattaggagtcaggaaacctggctttctgttgattaactgtgactttagacaaatgacttatcctcttagcttccttatcaataaaatagggagcaatacttctactggctatcaggattgttgtaaagatcaaaaagatgatgtgtatggatatactttataaactgtttatacttcacactgcttattgctgacacctgctgtgaattgtccacctggacttactgctgtggcaggtgaaaaagaggagaaaagtaaaaggcagggagtgggatgggagtagggaaatgaggtcctggtttcactgagccgtgaatcagtactccaccttcctgcccactgagctgttctgagctacctggcaggaagttagagcttccctactctcttttcttacactccaaatgttagggtcccaggctaggaaccagcctgtgaagatgggaggctcaaacccctgcttaatgatcaggattggtgtgtcgggatctcggccgctggggtgagtgtgcaggtactgctgtgctgtggcaagggcactctccttctccgtggcattggcctcagccccaatccacaagaacacctgttaaggtggagatttaatatatgttactgtgttcataccaaggactaagtactagatcatacacattaccctatctttcccctttctttcgtgagcaa

SEQ ID NO: 11158 - DNA, 1048 bp, Homo sapiens
aaaatgcatgtgcacgcacacacacacacacacatatagcctcccaccatgggaaagtgaatatttaaaaatttttcttaatctatttagcaggtatgagtacatatttcttacatgcatatattgtgcagtggtaaaatctgggcttttagtgtgcccataaccgaagtggtgaacattgtatccaaaaggtaatttctcaaccctcatcctcctcctagcttcccacctttggtaccctccaatgtctattattccagcgagtgactatttgaggaaagagaagctgccttatttatcctggcatccctcctgtacataatataatgggttttgtagctagctactcactatatgttgcttaaattagttaattaattaaaaacaaggaaaaatatattcagctagcccctttgattcatctatttaattcttaaaattgatgctgaactggagaatattgcttgggtatatggtcaaatggggtttctcatttgaacttatcatcaaaacttaggctttcccttgtatgggaagaacctgctctagtaaaattatcatactgtgtagaccagatcagaatctgtctcctctgtaggaaggcatatctggaaaagggagagcccagaatatttctgcatcaagcttgcttaattttttcttgaaaattcagcaatcagatgtggaatggatcgaagtgttattttaacagcagtgtctgcattaggaaatactaggccagcatatagttgagaagcctgggggtaagagaggttagataatttgttcaagatgaaaagtaaaatataggtcttacccaactcttctaatactaaatcaaggtgttttgttgtcattgttgttttattttgtggtttttgtttttgcttttgcttcttcttcttcttttaaagagccctttaaataatccttttttaaaaagaatcctttagatttttttttaaaaaactctttttttaaaagaattttatgctacatcataatagtaataactggtgctcccaggggaatgaagcctagtgaacag

SEQ ID NO: 11159 - DNA, 1050 bp, Homo sapiens
tacatatagacataattacttcaatatgactctttttctcataaaaataatgacatatttgagtcaggcataatacattttttctgaggttggagttagcaggaaaatgttatcttttatgaataaataattcccagattggttgctacatatcatgattcaaaaagtaaaataattacctggatgtggtgatgtgcacctgtagtcccagctactcgggaggctgagacgagagggtcatttgagcccaggaagttgaggcttcagtgagctataatggccccacttgcagtccagcctaggcaatagagtgagaatctgtctctattaaaaaaaaaataaaatgttcttactagaaaacattatatttagaattttagtgattattccatttataatattatccgtagctaccaaaaaaaagattataagatacaaatgatttggtttacccatacagttacatattaattttcatcatttaatacaacttaccctacaccgtagcttatttttcaagtttctctgaacatctttgttgtcattcacctctttgtctatttgttctgtagagaaaacaagtgtcattgcttttgtcttctccatctagacttttgcagtccttagactatagttctccttagctctattcaaatagtgcacttgcaaggcgctgcattcttctcaaagtcagccatgatgcacatatttataattacatacacatataattgaatatgattttagagtcttgaaaaactgatcttctttggcactatcctgaatgtttctgattttcttaaagtgcctgacaatattgagtaacaaagcttaccatcaccacattgcaccattatgtattattctgtctccatcaatgcagtgacatcactgatacatcataccaacaagatttctaaccacaaccattcagagcactaattagcatctatattgagaatataagattaatattacaaacttgactttactcatctctctttaagattttgatttctgcacaaccatatgcagaactcatgtttgaga

SEQ ID NO: 11160 - DNA, 1049 bp, Homo sapiens
tgttggaacctgggttggcactggctcttgctagttgggggagcccagggatatgtactcactctggcagcagtggcctagtgggtacacatgcacaccagtggggaactggagacaaggtctgtctgtgtgcacacaagccaccaaagcagtgggagggtggctgtgggctactgtgtcctgacaaagttgtttggggaggctgcagtgggcggaagctgcagctgtactcgtgtacattggtggtggcttctctggtagagctctccaatggtcaggcacaatccgctggcaaaggagcaatgatgtgggctccagggaggaactccagttggggatctgaggctgcactgcaagtgtgcatggccagcagacagtggggtgctcatatctcactggccccatctcataggcaagaacattctactctgtttgggtctggcagattctctaaggctaaagtatcctaggggagcatggcaagtcttgagggttgggtatccttggccgtgcttcactagagaaattcttacaccaaatcctctgggctctgcataagctggtgtcctgcctccaccacctctttaagcagtatttatggggtcatgggttcccctactgctagggttccagaggtccatgtagagagtgggtctctccttgcctgttcacctcattccttccccgggaacaagtcttggtgtgcaatagctttatatggggttcccaacttcctccccctttatactagcatctgtgtcttccctccatgcactctcaatgccttccctccgaagattgccgggagtgcaccagtctttctgacttcccaattcctcagtggcagatgatcctcctggctgcgcttagtcaaccatcttgccacagagttcgcaaagtcttaagataatgacttcagaaagattatgatttagtagagaagatataatttgtacttaataaatgtctttaatatagaagaattcaaatgaattatgtagacacatcctcccttaagtaattggaacataattccctatttcttaagt

SEQ ID NO: 11161 - DNA, 1072 bp, Homo sapiens
tatgactatgatgttttagatacctcataagtggaatcatgcaggatttgtctttctgtgactcatttacttcatttagcatagtgaccttcaggttcatccatgttgctgcatatggcaggattttcttttttcaggctaaatagtactccatttttctttattctttcatccatcaaaagacattaaggttgtttccgcatcttggctattgtgaataatgctgcagtaaacatgatagtacatatatcttcaggactctgattttaatccttttggatatgtacccaaaagtaggattgctggatcatatggtcattctatttttaattttttgaggaaccttcataccattttccatagccagtgcaccatattatatagtctacaagagttccaatttctccacatcctcaccaacagttaccttttgtttttttcaataatagccatcctaacacgtgtgaggtgatatctcattgtggttttgatttgcctaattaagtgttgtaacaccttgaaattttcaaaaacaagcattagaaaagaaccgactgcatgtataataagatagagctgtaattgattttttcctttatgcatgatctgttgtgccagtaccttttatagaatagtccatctttgcctattagtttgtaatgatgcttttgacatatgtcttcatatatatgtgagtctggctcttatttctttccactgttttcattggtctttttacttctctctatgccaatatcacattttcttaatcacagctttgacactttgtaaccttgggcaagttaatttctgtgtgtatatatactccatctgaaattaagataatagtacctacttcattgggtaaatgaaaatatatgaatgtgcttagaagtatgcacatggctcaagagtaaaactcaaatattagtgattttgttattaaacttaataaaggtaataattaaccttaatatgttaataattaataataaattaagcttaataaagaggcttagtaatgaggaaactgagatttccactttgtttttcttccagactttctggggaa

SEQ ID NO: 11162 - DNA, 1045 bp, Homo sapiens
ttgtctgtatgtatttgcttattctggacatctcatataaatggaatcatacaatatgtgtgtttttttgtttattttattttttgagatggagtctcactctgttgcccaggctagaatctcagctcactgcaacctccgcatcccaggttcgagcgattatcctacctcagcctgccaagtagctgggattacagatgcgtgccaccacacctggctgatctttgcatttttgttgagatggggtttcaccacgttggccaggctggtctctgaactcctgacctcaggtgatccatccgcctcagtcccccaaagtactgggattacaggtgttagccactgtgcctggcccaatatgaattcttttatgtttgtcttcttttatttaggacagcacaatgttttcatgttttatccatgttgttgcatgaatcagtacttgatttctttttatagatgaatgatttctactgaatggtgcacatttactttatgcactcatcagttgatggacatttgagttgttttcacgttttggctcttctggatattgttgctatgaacattcatgtaaaagtttttgggtagataatgtgttttcctttctaatgggtagatacctagacatgaaattgttgggtctttttaaacttcgttgtttaactattttaggaactcttagactgtttttccaaagtcattgcatccttttacatcattgctggcagtgtatgaggattcattgcttcacattattaccaacacttgttcttgtctgtcctttttattatagccgtccaagtgggtgtgaagtggtatctcattgtgatttttgacgtgcatttccctagtgattgatgataagttctttttttgtgtgcttgttatatatcttttttagtgaaatacattcagatcctgtgcctatttttaatagaattgtttgtctttttattgttgtattttcagtttgttatttatttaggatgctagacccttatcagatgtatgatttgcaaaaattttttcttattctgtgggc

SEQ ID NO: 11163 - DNA, 1054 bp, Homo sapiens
aacacctgaatggagaaacaaaatgtagcatatccatacaatgaaatcccactcagcaattaaaagaaattaagtattgatatgtaaaaacatggatagatctcaaaataattacatggcatgaacaaagccaaacaaaaaagaggacatactatttttatgtaagactctagaaattgcaaattcgtctatagtaacagaaagcaagtactgttttcatgtacaagtctagaaaatgcaaagtagactatagttgcaaaacacagaataagtaacattctcttaatccctcaggttttttctcgcttcttgatttttattgtttatatcttattgggaatactgtgttctcattattgaaatgctaccaagaacaattttgctttccgtatctgttaattaagactaacttaggacaagaaaaatctccattaagttggatataactcagtgagatatttctgttcctctttctgcattttaaaaattcacatggacagataacaagtctcagattaggactgtgatgtaggtatggttccagaaatttcttctagatctgtggcctgtcttatactaaatttttttagtctagctagaaatttgaaagtggactgtgaattagaatcacatctgaagaattacctccattttagttcttgggagaaatccagattgtgggccttctggaataatgaaatggttcacaagatgcccatttgtgatttctgtcatggttcctagcccgtgtgtcttggtgtcattgtaaaaggttgttgatttgcttctgaatttcctacaaaagctgatgctagaatgaatattgttaccatatgagggatctctgctactcaaaatatgtgggaaacactcttttgtcaagtctcttgactaacagttactccatagtattttttaaagaacctaataaaagaattatgtttttaaatattgctttttgatttatggtacaaactgaaagttttaaagcaatagtttattttgaaatatgtatggcaggcttgtccaacctgcagcccatgggctgcatgcg

SEQ ID NO: 11164 - DNA, 1065 bp, Homo sapiens
atctatggttttgctttccgcgatttcagttacctgcaagcaaccatggtccaaaaatattaagtgggaaattctggaaataaacaattcgtgagttttaaattgtgcaccattctgagtaacatgatgccatcccactccatgtcctccccatggacactatacactaccttcccgtttgtcacttagtagccatcttggttatcaatctactgtcacagtgctttgttgaagggcattagtagcataatgcagcgttacaatgtacatcattcacttcacctcttctcatcaggtagacatttaatcatctcatatcattacaagaaaaagggtgagtacaatatgataagctaccttgagagaccacatacacataacctttattatagtatattgttctaattgttctattttattattagctattgttaatctcttagtgtgcgtaattaataaattaaacttcgtcataggtatgtatgtttgtaaaggaaaaaacatagtgaatatagggattagtgtgctatttgtagtttcaggcatccactaggggtctcggaatatatgtcttcaaaggcttatagaaaatttataatttgtcaattatagatgacaaatttctgaactccaggttgctaaaatgaattgagactagttggggcctttggaagaactgagtgtattttgtattttgggggaaggaactgtgaatcattgggggccagggggtagactgtggtagccagcctcaaagatgctccccagtgattgtgacctcttagaatccttagtctggtgtaatcctttcccacattgtacgacagttggtctatgcagtcagtagcatgtggcagaagtggtggtatgtcacttctgagattagtccttaatggatgcctgtacttctattgggagtgcacatacctccctcatcccctcccctcggatcactcactctgggcgaagccataactttgcccttaacttaccctatagagagactcacataatgaggaacagaggctgccaacagctacatgagtgagcttgtaattaagattt

SEQ ID NO: 11165 - DNA, 1061 bp, Homo sapiens
tctcttcacttggcttcctgggcacagtttctcactggctgcatcttgttggagtcctttgtaaaaccttcttcatattctttatctcaaaatatcagtgtctccatattctcccagccctcctttccttggtgatttcttttgttctcctggctttaaatattttccatgtgttgatatcttttaagttgataggtcctgccctgaagtctcccataattccagtttgaactatcccatatcttcatttgtatatctgacaggcttctcaagaagactatcagatataaaactaagctccctttcccaaaaaaccttaggctctgtcattcttccttatctccataattcccacttctgctcttccaattgcttaggccaaaaatcatttctgattcttttatttctcacccttcatgtaatctagcagcatatcttcttagcaattccttcagaatttattctcagtcagaccacttaacactgcttccattgctaccactttggttaggattgttgcagtaacctagtttcccacctttgaccttgaattagtccattctcgcactgctataaagaactactggagactaggtaatttatgaagaaaagaggtttaattgacttacagttccataggccgtacaggaagcatggctagaaggcctcaggaaacttaacagtcatggtggaaggcaaaggggaagcaaccacatcttaccgtggcatagcaagagagagagagcaaagggggaagtgctacacactttcaaacaaccagatcacatgagaactcactcactgtcatgggaacagcaagggggaaatctgcccccatgatccagtcatctcccaccaggtgcctcctcaaacactggggattacaatttggcatgagatttgggtggggacacagagccaaaccttatcagaccttctgcagtgttcttcactaccagcaaaagtgaacatttaaaatgtcagtcatatcatgccacttctcttcccaactcctcaatagctttctcttttgctcagattaaaatataaatactttgata

SEQ ID NO: 11166 - DNA, 1049 bp, Homo sapiens
aggaggtgcctgctgggaggtgtttagatcatagaggcagatttcccccttgctgttcttgtgatagtgaatgagttctcatgagatacggttgtttgtgtgtagcacttcccccttcgcactctctcctgctcctccatgataagatgtgcttgcttccccttcgccttccaccatgattgtaagtttcctgaggcctcctagccatgcttcttgtacagcccatggaactgtaagtcaattaaacctcttttcttcataagttacccagtctcaggtagttctctatagcagtgtgagaacagactaatacaagtactaacagtatatttattttatgtaattatttaaatattctgggtgatttgctttaagttttgagataacgctgttgatattttgaattagtgcctttttttcctactgatttaatgcccttatcaaaaccttactgactacaagactattacaaaacattagctgctaagtagatagtattattggactaaattatgtaggatagatgtgggttttcatatttcttcggagaacgtatattattaagtttaatattttataaattttttcaaaactacaactattctaaaatctaaaagtattctgtattcatatatcataaaatattttgattactattttcttgagttgattaggcaagttattgaccagaactagatgaaatttcagtaaattgatttagaaatcagaaaaagacgtgactttactttgaaaatactaaattttggtgaatacagacatcccttcaaacaaggcactttcttttttattgtgtccatatattctagtgagctgttcagtttaatataaattatttttaaattgcttatgtggtacttaaaaaattttgcacactaaaaaaaatctgtaacatctcttaatcatactttaatttctaattcctacatctcctcagaaaatatttgaattatagtatgttaaaatttaaagtttatcctgtgtagcataaattgtattttagtgttaggtgattgaactcttaccttttg

SEQ ID NO: 11167 - DNA, 1032 bp, Homo sapiens
aaaatatgccattctgtatttctagactagaccacttttctgaattccagatttttcataaatttcatgtaggactcaccacctcaaattaaaccaaatctttttacccctccttctcccatcccctcaacctaaactgtcttcatttcctgtattgcctatttcaagtaccatccaagagccatcctgagttcctcctccagcctttcttctcttgtctagttagtcagcaagtcttgcagattctgcctcctcacctgaagttttcaaacagtacccctttacattcttgaaaattattaaagatccaaagaacttctgttatatgggttatagctgttaatatttgtcatattcgaaattgaaataagattttaaggtattttaaaataacagtacaaaaccattgtattttgacatgaataacacttttatgaaaataactatattccaaaacaataaaattaccaaaaagttgcattgttttttatttttgaaatttctttactatctgactgaatagaggacagctaaattcttgtatattcttctgcatttaatttattgtaatacaatgtttgggttgaagtacatgaagcaaaatcagcctcacacagatacatagttgaaaaggagtattttcagatcattaatactacatcaaaacttgactagtggtggtttaagtcttaaagttaaatgatagaatctgaaaccatatcaatgaaccttttatagtattaaaatctttcaaatgtaaatttcatgcattttggtcatttgggaaatattcacggagttatgcagatcttccaaatgttgacacattttattctacaatttttttcaaatcacattttttaaaacatcacctatcttatgagaaacgcctaagtattgggaagctgtcaactttgtggtgtcagagtcaagttttccaagattctaattcttcatcgaaagcccaaattttatcattggctgcaaatacattgttttccttaaagacacagccttccttcattcattttt

SEQ ID NO: 11168 - DNA, 1114 bp, Homo sapiens
tcccagaaccccatctgctttcctttactttccacaatggccccagaagctttctcatggatcccaggactctgaggaacagtttgaaagccaaagtctggcttgaaaaaaaaaaaaaaaaagaaacacataaaaaactaataatacagattaagatcacagtttatggagttacactacttggattaaaaacatggccttcctgcttattataataactgtatttccctagacaagttaattccacaattcatttttctcatcgtctgacaagaaaataatagtaccctatcttaggagttttgtaagggttacgtgagttgatggttttaactcgtaggatgctgactggcacattataaatactgaatacatattatgtagaaattatctcatctttttttaaaattcaacaagttaagcagaatgactctggaaagattctgttctccataaccgttctatctgtcctcttttcttgagtctttttccacgtggaccttagtggactaagaagaaataattgagtgtacttttatttttcatatagtgttattgtaggaatggtatttatcaaccctttaatttctgaactatgctaatttaactcttcctaggcaagctgataaggaagggatataatagcatagaattgtttatgaatattctatctgtagggcactaggaaattcaaaattgttgagtttggttacccctagcccctgcctcctgagtagttatgattataggcatataccaccatgtcccattggttcaaataatataataagatagttttctagttccctaaatctgttactccatctagagaatgcccagtttttaaattttgcattattggtgataattttaattagcattagttcagtagattcaagagcacttcaacccttgtctttttcattgtcaaggcctacctaggaggctcatggttagtttcctggatgaagcatctcctcagatggatttgaagcaggggagtaatgtggtcttttccattggaaagcagcatggcataagatggttattttcaaaatatttacttggacataatagagctccttagatagattctaggaagtcattgaaaaaa

SEQ ID NO: 11169 - DNA, 1025 bp, Homo sapiens
tgtttttgagatgaaataggtattctgctgatattaagggagcagtagtgaaataggaagcctaaagaatggtgaagatttttttttttttttttttttttttgttaatgagacagggtcttgctctgtcacccaagttggagtacattagggtgtgatctcagctcactgcaacctccgcctcctgggctcaagggattctcccgcctcagactcccaagtagctgggactacaggtgtgcgcctccgagcccagctaattttttgtatttttgtagcaacagggttttgccatgttatccaggctggtctcgaactttcgggcttaagcgattcacctgccttggcctcccaaagtgttgggattacaggcgtgagccactgggcccagcccaatgaagattttaaatagttattgagataaatgagagaataaccacatgtgtgatatgcagaattatttctgagtactgtcaaaggatcaattgatattgggcactgtggatttgtagcacaccagcctctaaaattgggaaattctcttcagcacatgtgaacagctctgagaaagtttagcaagagtggaatgaatagaattgagtaacaaagacattaaaggttcgtgataaagcatgtagggcctggatggaagggctagaagacagtagggagctggtaaactgggagaaaacaagagttaaaaggaatagaaatctctgtgcaagacaagaagagataagaatgaatttccaggagaagcaagaagtagtggttagacagtaacccgagtttaagatactaaaagtggggccgggtgcagtggctcagtcctgtaatcccagcattttgggagactgaggcagaaggtcacttgaatccaggattttgagaccattctgggcaacataatgagaccttgtctctaaaaaataaaaattagccagtcatggtgtcacacgcatgtagtcctagctacgcaagaggctgaattcggaagatggcttgagcccgggaggttgaggctg

SEQ ID NO: 11170 - DNA, 1053 bp, Homo sapiens
ttcaccttgttagccaggatggtctcgatctcctgacctcatgatccacccgcctcggcctcccaaagtgctgggattacaggcgtgagccaccgcgcccggccgttagttcttataataaaaaataatcacagccaggcacggtggctcacgcctgtaatcccagcactttgggaggctgaggcgggtggatcacgaggtcaggagatcgagaccatcctggctaacatggtgaaaccccgtctctactaaaaatacaaaaattagccgggcgtggtggtgcatgcctgtaatcccagctacttgggaggctgaggcaggagaatcacttgaaccggggagtcggaggttgcagtgagccaagatcgtgccactgctctccagcctggggacagaacaagattccatctcagaaaaacaaaacaaaaaaaaccaaaaagacacacacagacacacacacacatacacacatacacacacacaaacacacaaaacaaataatcgcttatgagtttaatgttctcttgacttggaattccgtgttatttattcaaattctgtaaggatgacaaacttgtcttatccatctttgtgtagcctttcagtaaatgtgtgtagatttaatttcattttgtaaatttaattatgtgtaattcagtttgtgcattttctaacctcgtgcattttctaacctcttacatttttattgccacttaaaaacttctgagtgagctggcttggtagaagaagttaaattaaggttcggaattatagcatgtgtacccaattaatttaaagtgctgtttcagtaataagaggagtaatgttattgtttttaatgaaatgtgtttatttcttgaagaaattagggctgtttaaattcaaggcatataataaaattctaggaaatttcttaatattcatttacaagtattgtggggatgatgtatgtactatttttaatgattctattctagggtgggaattcttatttatgttttccctcctgtagtatatgaagaaatagagtgcttttttgaggtgggaaagaag

SEQ ID NO: 11171 - DNA, 1066 bp, Homo sapiens
gcccacaaaaccacgttttcctcataggcctctggatctgtgatgggaggggctgcctcaaagatctctgacatgccctggagacattttccccattgtcttggtgattaacattcagctccttgttacttatgcaaatctctacagccagcttgaaattctcctcagaaaatgggattttcttttctttttgcgggggagggatggagtcttgctctgtatcccaggctggagtgcagtggccccatcttggctcactgcaacctccgcctcctgggttcaagtgattctcctgcctcagcctcctgagtagctaggattgcaggtgtgagcccccacacccggctaatttttgtatttttagtagagaccgggtttcgccatgttggccaggctggtcttgaactcctgacctcaagcaacccacccgcctcggcctcccaaagtgctgggattataggcatgagccactgcgcccggcctgggattttcttttctattgcattgtcaggctgcaaattttccaagcttttatgctctgtttcccttttaaaactgaatgtctttaagagcacccaagtcacctcttgaatgctttgctgcttagaaatgacttctgccggctgagtgtggtggctcacgcctgtaatcccagcactttgggaggctgaggcaggcgggtcatgaggtcaggagatcgagaccatcgtggctaacatggtgaaaccccatctctactaaaaaatacaaaaaaaaactagccgagcgtggtggcaggcacttgtagtcccagctactggggaggctgaggcaggagaatggcatgaacccaggaggcagagcttgcaatgagccgagatcgctccactgcactccagcctgggtgacagagcgagactccatctcaaaaaaaaaaagaaagaaagaaagaaagaaatgccttctgccagttaccctaaatcatttctcccaagttcaaagttccacaaatctctagggcaggggcaaaacgctgccagtccctttgctaaaacataacaagagtcacctttactccagttcccaa

SEQ ID NO: 11172 - DNA, 1066 bp, Homo sapiens
acaacgatgtgaaacagttgatactactcaactgtacacgtaaatattgttggggttttatattgtatggttttaccacaattaaatattttttaatattgaaaagattcctgcactcccatgtttattgcagcactattcatgattgccaagatttagtagcaaccaaagtatccattgacagatgaatggatagagaaaagttagtacatatagacaatggagtactattcaaccataaaaagaaaagtgagatcctgtcatttgcaacaatatggatggaactgcaggacattatgttaagtgaaattagccaggcacagaaagacaaacttcacatgttctcactcgtttgtaagagctaaaagttaaaacaattgaacgaatggagagagagaatagaatgatggttaccagcagctgggaagggtggtggagatggggagcagggggaaagtagggatggttaatgggtacaaaaatatgggtagatagaatgaataagatctagtatttgatagcacaacagggtgattagtcaacaataatgtacattcaaaaataactaaaagaggccaggcgccatggctcacgcttgtagtcccagcactttgggaggccaaggcggccagatcacatgaggtcgggagttcaagaccagcctgaccaacatggagaaacactgtctctactaaaaatacaaaattattctggcatagtggtgtatgcctgtaatcccagctactcgggaggctgaggcaggagaatcgcttgaacccaggaggcggaggttgcggcgagccaagattgtgcgattgcactccaggctgggcaacaagagcaaaactccatctctaaataaataaataaataaataagtataattggaatgttttagcacaaagaaatgataaatgcttgaggtgatgtgtagcccatttcccctgatgtgatgattatgcattatatgcctgtatcagaatatttcatttactctataaatgttacatacctactatatactcataaaaattaaaaaaaaatatttttaagtaaacaaaatagt

SEQ ID NO: 11173 - DNA, 1083 bp, Homo sapiens
tggtgcgcatggaactttattacagcattcaacctggcacactgttatctggaaggtattgtaaaatagattggactatcagcttttaatgagtcatgcttatatattaatactttttcagttaaacttatttcttttaatttttaaagaatttccatgcatttgtgtatttgacaaaacaggaaataactgtgtcatattgtaaattgtacctcataaagagcaaattaaatattaacagccttatctctgtttctgtcttcatctcttattattatatctctcgtgatttctgcctttgcctttctgtctcctttttttcccccagttttcccaaatggtaaaaaccaggagttactaaacaacaaagggtaatcaatcccttaccatagagtagaaagcttttggggtttttgtttgttttacttttgaggtctacttatagatatgtaatttaaatataatcaaaagagaattttattaacagatgaatatcaatagcaatgaagtttatttgtagactcaccaaacaaaagtaacctccaaatggtatattgtacatgtaatgtttattcattaaattacaatttcatttttttcttcttttgaaactttctaataaaatcagcagtttattagtgatcattccctctttgctaaaagtctcatcttttttgttccatctgttccattataataaaattctgtttataatcctttcacttgcttttgtgagtttttcaaattaatagaccccaaaatgtcttcttaaaaaattaatgggctgggcatggtgactgacacctgtaatcccagtactttaggaggctgaggcagcaggatcacctgaggtcaggggttcaagaccaacctggccaatatggtgaaaccccatatctattatagtaaaagccctctttccttctgtcttgtatttcagttccatcccatagttcctcctcagatcacaaacatgcttaattctcccatacagtttgtttttaatctaatacttttctgattctaattttcctttcaagcaacttcattttttatcttcttgctgcctaattcttaatgatt

SEQ ID NO: 11174 - DNA, 1050 bp, Homo sapiens
gagaataagaaagagtttgattatcaaagagattgagaggtagtgaaaggccagatcatccagatcatgtagaatgtgttaggagaaagttaggaggctgggcatggtggctcatgcctataatctcaacacttcggaaggctgaggcaacaggatagcttgagcccaggagtttgaaaccagcctgagaaatataatgagatctcatctctacaaaaatttttttaaaataaaaaatcatccaaatgtggtggtgcacacctgcaatcccagctacttgggaggctgagttgcaaggcttgcttgagcctgggatgtggaggttgctgcagttagccaagatcgtgccactgcactcaagtctgcgtgacagagtgagaccctgtctcgaaaaaaaaaaaaggatttcatcctaagagcaatgaaaaaaactactgatagattttaattcatgatttgacatgatcaaatatgcacttcaaaaagatcacaaagtgcatgtcttagtgtatatgtagaatggaatggcaacaaggaaggatgacaggatgttgttggactggttaggaagctgttggttgtgtatatcagtggttctcaaacagggcctattatactcccataagacatttggcaattttggagacatttttagttgtcataactggggaaggttgagcattactgctatctggggagggtagaggcaagggttgatgctacacatcttacaatgcagcctcctataacaaagaattatacaaccagaaatgtcaatggactaagactgagaaacctggttgccgattatactactttcaattctggtggtaatgctggtggtggtagaaaaaggtgaacagagatacttttgtacatagttatgagcatgttgtacatattatctattttattatttcgtgtttggcattttttaaactaatttatgttaaagcacaagcatatttactcattccataagcatttttgtatattgttctttatgtgcacttttttctccttttttccaaaaactatttatggtgtctg

SEQ ID NO: 11175 - DNA, 1126 bp, Homo sapiens
aaagtgatcatcctttttgtcttataaagcacaagtatattttagacacttcataaataatatcattaaatgtttttctcatggagaaaaatgaagacttaaacaagaaaatacgaaaagaaaaatttgtggctagaaaaaaaaacccaatttaagtattttcaacacatttgaaataattaaaatctgcagtatcatgatatgcattttattctttcttcctatcaaattatttgaagtaagaaacctagagaaactagttactatttattaaaatgttttcttatattaaaatattttattttaaatcaaatcgatatatttagatacatttcacattaaatatacacagccctgtcaaaaattaatccatacatttcttttagaaacaaattttcgtagatgacttattttcccaactgtaacacacatgattatttgtttaagttggtggaccaggcatggtgcagaaatcagatgtcatttcaatgaactgatatcacagaatttgaagtcagtgtcatcgtggtcagtcacacattcttaatggcctaatggctgtattactgaacaaatgatcagattgtagaacctgaggactgcctgggacttcactttgttggccctttttctattcttttaagaaataaatcacactgtaaaaaagaacattttttagctgattaacagtttcagcctatactttattctataacagtttaaaatagtttgtgtcctttagggctcagaaaagatggtataatacataaaataagacagtttttaagattctgtggttaaacaaatatatacacagtaaagaacttaatggagttcagattatgcattctaatgttcttattttgcttttataggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcaggtaatttactgtaaattttatttactttgtaagatttcatggcttataaatacagatagttccacttaagatggactttgattatctcggaaaaggatacttttcac

SEQ ID NO: 11176 - DNA, 1026 bp, Homo sapiens
ttaaaagattcttgttgattgtgttccattcctctaaggcttatttcttgtttttccctctgttttgaaggactagccctaaaccttgttcttcctctagcatgtggatgtaccttatattgattgtataaataccagaccaacttgagctgtcttctctaaagactcatctatcccaacctttcttcattggtgattattttcatttttctttcagccatctcatacaaggattcttaagccttggatactacaagaattttctctcaactgtacttactactcaaattgtcatcctctttcagctttcctttatttccatatcccttaaacagtttgtggccttcacctagtcaccactcactctttgcctgttgtgtgttggcttacgtccatattgctccacagaaactgctttcttaaacttacaaaagaccaaatcttcacatcctcagtccttctctaatgatttatcttccctatagcatggtactggccttctgaaacctgagccttctgaaagctctttcttcccttgactttcacgatacttttctctcctcactgcttacctcaccaaaactatcctctcactttatttattgagcatatttttgaagcatctttctacaaggtgctagcaattttaaaatgaataaaatgattcttagatttaataattcaatatggagaataaagaaaggcaaacaagtaatactacagtatgttaagtgctaggtaaagaccatagtggaggctttgcattcagatagcctgacttcgaatagtccactgttactggcttactgctttatgacttttggcaaatagacctatctgagcatgtttctcgtctttaaaagaaggataataccaatactacttacatgtcttacctataatgagagaatccattgagatacagcatttaatgatgcttgccaagtagtcagtgctgaataaaaattgagttcctctgaaagacaaaaaactaagtcaactgctgaggggatttgggcaagaatt

SEQ ID NO: 11177 - DNA, 1019 bp, Homo sapiens
ctttgtactactttttagacaagttattaaacctttcagtgactcatttttcctcatctgttaaatgtcaataataatgctccctaacttacagggttattgtgaggattaaatcacttaaaatgaatgaatgcttagaatagcacctggcatgtaagtactttaaaatgcttgtttccactattattgtcattaatgttttttctttcttttaaaaaaggtgacattatccatattaattcccatgaaacaactattattttaaaccaaaattctaaaggccaaaactctaaatgactgagacttggaaatttagctctaaatttggaggtttttgtttgtttttgtttttcttgagacagtgtctcgctctgtcacccaggctggagtgaagtcgcatgttcatggctcactgcggccttgacctcctggcctcaggtgattctcccacctcagcctctcttgtagctcggactataggcatgcaccaccacacccagctaatttttgtattttttttgtagagatgggattttgccatgttgcccaggcttggagttatttttaatggctaaaaataataaagcttctaaattcagctctcaagtaacacagtatcagtattctaagttatggttattctagttacagatttaagctttctactccatggagtagttgatgaacaccctagattgagagtcaggagacctgtgacctggtcctgacttgctgtctactttctgttgatcgtgagctggtcctttcccatcactaggcattattttctttatttgaaagacaaaaagaaggccaaccggagtacgtaatcccagcattttgtgaggccaagttgggtggattgcttgggcccaggagttcaagaccagcctgggcaacatagtgagactccgcctctacaaaaaaaatttaaaaattagccagatatggtggcatgtgcctgtagtcccagctacttgggatgctgaggtgggatgatcacttgagcccaggaggtt

SEQ ID NO: 11178 - DNA, 1034 bp, Homo sapiens
gtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccatattatctataaccagcctttgttaacaaagggaactgatatacttgtgtgtataataaatggtacagttctgtataaaatagtgcatttatttaaattttaaaagtattgataatgttaaatgcttaaagctctatttattattaatacaaaattgtttgcttacatttttacttataatttgccttcatatgtggcggataagctcaccatatgatcatgcagttagcttcatgcttattttaaatgtattattagtgaccattaaacatctgaccagtaaggtcatgtgaacacagcagcaaatagtttatgatttgctgattttggagctttgaaatataggttcttaatacattgatacatattgtagcactatgacttcatcatacctcatttctttaaacagctctccaagctttcactgaagtctgtctgttttttatattggctgtctggattttaaagacttttcatattttatatttctactgattttgtttcccctaacaacatttgtcactgtctttgaattatgacccaggcaagatgatttcagattttctaaaatcttgcctgtgaggttttgttcatatcagtgcttcattttgtaatgtcttctcaagaaaaatacctatgttaactcacaagtataaaatatgtgtgtattataaaacaatgaaaagtgtatttttggagatagtcaagcatttagaagtgcagtgaacttgctgtcacggagtaaaatgctaattatgtttcactttcctagcctagtgaaaaagaaaagtgctcttgagtacaataccttaattatttcttaaaatactgactttgacctagctcactgtattttttatttaatggattatggattacagtattttt

SEQ ID NO: 11179 - DNA, 1052 bp, Homo sapiens
agatgctgtataggaatctggggacaaagggacagataagtggtgtagacaaagaggctggaaatagggttatgggctagatcatgagtgacctgtaagcattaggagttttgatttattttggaataagaaacatttatggcttttgagaaggaaaattacacaagggaaaagaaaggatttttattttttatttttatttttggagagatgagatctcactatgttgcccaggctggtcttgaactcctgaactcaagcaatcctcccggctcggcctctgaaacttctaggattataggcgtgagccactacgcccagccaggattatgtttttttatgggagggatgagaatattggtaggtgggtagaggataaatgagagagaatatgtatatgtgagattgaatatataatagaaaaaattgataggacaagtcctgcgttattactacattttatgaggaaaatctatatattagaagcactttaaaggtatatttgctattctagctgtggaaaccatctgaaaacacatttgaaagtgctttgaaacaggggtcaacttctctgcaaagggccagagtatgtttagctttgcgggccacagatggcctctgttgcatatgctgctgggtctccaccttcctcctccttttcttcccttcctcttccttctttttcttcttctctttcttctttctctttaaaagcataaaatcattctcagctcttgggccatacagaaacaggccataggccagatttgacttctaggccatagtttgccgaccctccattttagaacttagctttcctgaaagagcatttgggtctctctctctctttccctttctctctctctgtctctctctctctctctttcagtaagtgaagtaagaaataggtctttcttgaggaacaaaaagctgaaataatttcatgcatttgaatatgacccttgacctgtttttgtccatcatcactcagatttgtggctgcaaccaccaaccaatttggtgccataggatatagcataatttttcagcaa

SEQ ID NO: 11180 - DNA, 1303 bp, Homo sapiens
ttactataaatcacttgctcatctaacaggaattgtttacatgtagctgatggtctaatttttaaatgttcagagtcctaaaattatgaacagattatatgtcaaaaattaatttgtaatatacaaggtatattatggttgaactagtttttgtggtcttaggctggaaattaaacacctagtatatagaagcaataatatttcaagtatacatattcatttatagcattatttctatgggaaaatgcacccagaattctaactaggatcttcaagaacaactctccccaggtcagtgcatggagcagaaagagaagggaaagggatagaatgtcttcatgactttaatcctagtatttgaaaaaaaaaaatcaaaccttgcacctacaaatttctgtcttgatccagaaagtcattagcataaaaaagataatagtggccttctcacctaacgccaccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccgccaaaagtatgtccaacaagcctggcagaaggcagacatcaatacaaaatgggcagccacacgatgggccaagaagattgaagccagagaaaggaaagccaagatgacagattttgatcgttttaaagttatgaaggcaaagaaaacgaggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatgacggccgcgagtaaaaaggcttcagcccagaaggttcctgcccagaaagccacaggccagaaagcagcacctgctccaaaagctcagaagggtcaaaaagctccagcccagaaagcacctgctccaaaggcatctggcaagaaagcataagtggcaatcataaaaagtaataaaggttctttttgacctgttggcaaatgtaaaaaaaaaaaaaaagataatagtgagtattttattatttcaggaaggtaaaacagatcttttaaaatggctcgttgtatcattatgttctcatttagttattttcagtatttactttttctttgtaaaataaacgtgaaag

SEQ ID NO: 11181 - DNA, 1033 bp, Homo sapiens
taccacattaaggctcttggactttattctagggtagtgaaaagcaattgaggatgattaagcaggatagtggtattgtcatgtgtttatgtgtgtagatttctttagcagccatgggggaaagtgatttgaaggagacagctgggtgcaggcagaccaagtaggagattggaagtatcccacagagataaaactaatggatgaaatagggaagtggtagtgggtcagagccagggacaaatttgagaaatatttaggagcaaaatggtcggaatttagggattaattagatgggaagatgagagagggaaacaaatctgagaagtccctagtttctagtttgcatgagtaggtagctaatgtgacacaaaaatagaaaatacagaaatagcaaatctgtccactcttctctagcccaccacccaacatctacctatctcctctttctcagcagacaaccctgcctcctctttcatcaggaaaattgaggacatcataattatctctcttaactagctgctgtaacatgtacctactctctgtctggtccctcacccatccttatctctttccaagctctcaaacattgagtgatctttcctggctcaaggttaaagcccaccacctgtgcatcccacctgcttctaggaccttgttccatgcattacttccttgctttcctttattctccacttcattcattattgctttatcaccttctcttcaaaactttcagaatccttgtctatactcactgtaatcacttccttacttctcaacccattgcagtttgactaacaaactttccaacacacatatgtacatacatacatacaacccaggtatctgaatcaaatgaaattttttgggcccttaaagtttcttcttttagatctgtggttccttgacggaggcactgtgggacatcaccaaatattttaaatatttatgggaaacactgatacttgatatctttcaggccctatgcaaactgcaagttcaaagcagtacagtttcaacattagattaccct

SEQ ID NO: 11182 - DNA, 1050 bp, Homo sapiens
gatttgtaagctttgaaaggcttgaagatgcacagaaagctgtggatgaaatgaaaggagctcaatggaaaacaaatttatgtaggtagagctcagaaaaaagtggaacggcagacagaacttaagcgcaaatttgaacaggtgaggcaagataggatcaccagataccaccgtgttaatctttatgtgaaaaatcttgatgatggcattaataattaacgtctccggaaagagttttctccatttggtacaatcaccagtgcaaaggttatgatggagggtggtcgctgcaaagggtttggttttgtatgtttctcctcaccagaagaagccactaaagcagttacagaaatgaatggtagaattgtggccacaaagccattgtatgttgctttagctcagcgcaaagaagagtgccaggctcacctcactaaccagtatatgcaaagaatggcaagtgtacgagctgtgcccaatcttgaaatcaacccctaccagccagcacctccttcaggttacttcatggcagctatcccacagactcagaacggtgctgcatactatcctcctagccaaattgctcaactaagaccaagtcctcgctggactgctgagggtgccagaccccatccattccaaaataggcccagtgctatccgcccggctgctcctagaccaccatttagtactatgagaccagcttcttcacaggttccatgagttatgtcaacacagcgtgttgctaacacatcgacacagacaatgggtccacgtcctgcagctgctgctgctgccactccacattataactatgctgcgggagttcgcagtcctcagaaacatcttaatgcacagccacaagttacaatgcaacagcctgctgctcatgtacaaggtcaggaacctttgactgcttccatgttggtatctgcccatgctcaagagcaaaagcaaatgttgggtgaacggctgtttcctcttattcaagccatgcaccttactcttgctggtaaaatcactggcatgttgttggagattggtaattcagaa

SEQ ID NO: 11183 - DNA, 1046 bp, Homo sapiens
ttttacatagccactttgctagtctgctatttcaaagaattttttcccttgtttggtaaaaaaaacactcattatttataaataaagatgattttattttctcatttataagccctatggatttatttttcttatatttttgccctaggcagaatttccagtacaaaattagtgaaagtgccaaccttggcattcttgttttccattgagaaaggaatgctttcaggcccctcctcccttgaagaatgatggttgttttcagtttattatagatactctttaataggtaaagtgcaaatcttttgtattctttgcttacttgaagttttaatcattaataggtggttgaatgttaccttctttttctttttgaatctgttgatattatgttttttcttctttactctgttaatgtgatgagtaatatttatagatttcctaatatttaaccttctttgcattaaggctatcttcgttgtattttgtgtgtggtgtgtgtgtgtgtgtgtgtgtctgtctgtctgtatacaccgttggattcagtttgctaatatctagtatttttgtctttaaattcttgggaaaaaaacagacctatgattttactttttaataatgtcgctgtctatgttttttttttggaggggagggtggggagatggggcttcactttgctgcccaggctggtcttgaattcctggactcagagaattcctgggctcaaacaatcctcctgcctcggcctttcaaagtgctgggattacaggcatagagccatcaagcctgaccacgaatctgttatactagcctcacagcgtgagtgaggctattttgtggaagattttgaaactttgaaatatttctttcattgagagttcagtagaactgtttatctgagtctaattagtttccttgtatgaataatttttaaactgctaatcagtagttaatcattttattagttacaggattatttgtgctgtgtatttcttctcatgtcagttttgataaattatacttttctttttttgagatggagtttcgct

SEQ ID NO: 11184 - DNA, 1045 bp, Homo sapiens
cacctcccgacactactgcactggggattaagtttccagcacatgctttttgggggacacattgaaaccacggcatatggtatgtatgtgtgtgtgtgtgtgtttctttccttcctttcaacagggcagcacccttctaaaacacccccaaatactccctaaatgtccttggtcagcaccttattctcacaagtcttccataacttaactctgatttttcctgcgttcatctataagtattcactatgtcattaaagcctttataatttgattgtctccttaatggtgactcagaagaaagcttgggtttatgctgatacttgtaatcgaatccaaaatgcctgaaatcctgtatgaaagtttgctattaggttggtgcaaaagtaatggcaaaaaccaatattacttttgcatcagcctagtagatacaatatgaatgttgcctggggttattgttaatgtcttagtaacagcagcttacattcacagtgtgttcttttttaagagaggtcatattggtgtcacattacagatagggaaaaagaaactcaaaacttagaaacttgaggtctttttcccaagatcacatagctggtaaatggtggagccaccagggtccaaacctgtgctggaaccatcctgcagggctacatcaggatgccaccttaaaaaaaggttaaatgcttacattgcatgttattcattctgtttaaacttccaaaaaactaggaagaatgattgccatctttgacctaataagagtttataaggtcagataaaagtctgtatttttttgttgttgttgttcaacaattatgtgctaacataaaattgctgttttattattacctcaatggattatttgatgaggagactcatggtggagctgcctctttatatgcattagaaaaagcggtttgggtagaacttgcctgtagagaagaaataaatttaaaaagaaagtaaaagaaaaacataagaaaaggtagtttggggagaaatattttttaaaatcctaaattggaatgaatactcttgctaaaat

SEQ ID NO: 11185 - DNA, 1042 bp, Homo sapiens
cgtgagccaccgcacccaccattcttatttgagtagattttaaaaatccactaaagtttatggaggctgtttaggaaaaactctcaaactgtttttcctctactctcacactacaacaatcaacacagaagacttccgtgaccaaatgtgtgagagtttttccccaccaacaagcagcagacaccaggaagtccaggcctccagaacctctgaccaaccagattcaacttggggttcttatgactttccttttttggttcaattaatttgctggagtggctcacagaacttagggaaacacgcttactggtttattataaaggatattacaaaggatacagatgaagagatgccaagggcgaggtatggagtaaggcacgcagagcttccatgccttccctgggcaccacgctccaggaacctctacatgttcagctgtccagaagctccccacactctcttgggtttctgtggaggcttcattacataggcatgattgacaaccatgtagaaatgtgattgaacaaaaagggtatgatctcagactaacagactgagtggaggaatccagcaaggcttgtctgtttaaattcttcttggcctctctgtacagcattctttccttgaaggtacggggcaagaccctctcaggaatgagagttttttgacccacaatcaggttagagtcctgcctgggcaagtagaagaaaaacaggagaagttcagagagagagattctgttttctagggtctgctcctgatgcctgaagtgccccaaggctataacaaatgactgcaccaagggctattggaagttatgagccaggaaccatggatgaatgcctacacacacacaaaatcataatatcacagagaccaactttcacttttctcctgctgttgtgctatgtagaatcatcggtgggaagaaaagcattttgctatttcaaatgtcctcatatccgaactgatcatggataatatgttgttcaggaaatctgtctggctcattggattaaagtttggatcttacattttctat

SEQ ID NO: 11186 - DNA, 1050 bp, Homo sapiens
atctctggtagccttttctaaaggaagctctgtgctttcccaaggctgggaggaggtaatggccctgcctagttccatgttgctgattctagacaccttctttttattccttgtacagaagcccttcctcttcaggggtctggccacctggctggatcttgccctctcttgttccttgcaactcccatgcatagctctggctcattcctccacactcatggaggccttggatgcctttattagacgctcctcactaccaaggccagtggccttcaccgccacacctgagttcttgttatccgaggaaactcctcccctgctgacatggagcagtgctctgttactgtcactgcctgtcctacgggtgtgcccagtgtacttattctgcaagagagagacctacccagtctcctgccttcataccgttctttcctaccatctccacaccatgcattcattagttcagccatttctcttgaagttattttgacttccatccaaactgatcactctctcctctgaaccacttctgtggctggcccatatttctcttagtacctgttggtttacagctgggaggggattacttaggatctggttgggtccgtagcacctagtaaatcccttcacatactgctagcatggagggcatgctttgttgagctgatggaaactattgatgggtcattaacatttgaaacatattagtatattcagtaaaaatactgacaaaggacgcaaatctatgtcccccttgaaaaaaattatgcagccaggcatggtggttcacacctgtaatcccagtactttgggagaccgaggtgggaggatcacttgaggccaggagttcgagaccagcctggccaacatagtaaaaccccatctctactaaaaatacaaaaattagctgggtgtggtggcagacacctatagttccagctactgtggggctgaggcatgacatttgcttgaacccaggaggcagaggctgcagtgagctgagactgtactactccactccatcctgggccacagagcaagactgtctca

SEQ ID NO: 11187 - DNA, 1047 bp, Homo sapiens
actataggtgctcataaccatgcctagctaatttttgtattttttgtagaaacagggtttcacatattgcccaggctggtcttgaactcttggctcaagcgatcctcccaccttggcctcccaaggtgctgggattataggcatgtgtcactgtgtccacatatatatatatatatatatatggatatatatatataaatacacatatatgtgtatatatatatacatatatgtgtgtattatatatatacacacatatgtatataaagacacagttcaagggtcaagtcttttacaaagctttttcttagatgaacttcatctctctccctgttaatggatcacttcctcctatgtgacagcagcatatatacttttatattagcatctctaatattttattgcaatatttgtacatggaccacaatgtgtgttacccgtcgtccataaaataggcacaaaaattgaaggtaagcatttagaccttgtatagcaatttaacaaagtaattttatgactctggaatctaataataaaaattggagattgcatttttatatcttaatttttatttttttttctagttttaaacaaatttttatgaaagtatccatcgtgaaggatttacatttgaaaaaactggtcctttattacagatagtttgggaagcactatttattattttttcttatctgtcctctgtgctaggctgtaagtacctaagggcaaagtccctcttgtatgaacagtatttttgtatcaacagtaatgaatttgttgttcagaacaatgacactgtgactctcataaaaccattttcatacctatcacttgtccctttttaaagactgaattctactgtgttttatccctcagtcattgtacttatcattatcatactgtaattaacggtttatggttctgtttttcccacaaaaccttaaggatagttgaacccggctcttaatcacttttcccttccaaattccaaccacagtgcttggtataaaatcaatgctcagtaagtgtcattgattgaatgaacaa

SEQ ID NO: 11188 - DNA, 1024 bp, Homo sapiens
ttaatttctcttaggtacttaggagtagaatagccagatcacatggtaggtctatatttaaatttataagaaactgcaaactgttttccgaagtgatggtaccattttacaatttcaccagatgtctatgagagttacatttgccttacttcatcaccaacatttggtattgtgggtcttaaattttaggcaatctagtgactgtgtattggtatcttattgtggcttaatttgcattttcctagcccaagtttactaaaatttttctcttatgttttcttctaaaagttttgtgttttagctcttacatttatgtctgtggcccattttgagttaattttggtttatggtgttacgaaatggtttaattttttaaatatgtggatacctgttgctctagaactatccattgaagacttccctttacctgttaaacctttttcaaaagtcagttgactatgtatgtgtggatctctttctagattcttttctgctgcattgatctgtatgcctctctttatgctgagaccacactttattgattctgtagctttaaaataagtcttgaaatcaggtagtatataaatccttcaactttttaatctttctcaaaagtgttggctgttcaaggtcttaatattttcccatttgttttagaattagctcattgcactcaccacaacctttagttcagtgttgaataaaaagcagtgtgaattagaagagatcctaatctcaggcaatacatttatcgtcttttaccattaagtattgtattagctataggtttttcatacatccccatcatcacaatgaggaagtttccttctattcttgctttgctaacagttttttttttcctgaatggatttgaattttgtcaaatgacttttttttcatctattgatataatctcactgttctactttattccgcagacatcaccttagcaatataaggaattatgtcaggtgaaaatatcaccagctttctttcgccctaaaatgcataataaaatggaggt

SEQ ID NO: 11189 - DNA, 1075 bp, Homo sapiens
aataccccaacatgaaaaaaaaagcaaagatattttatggaggagaaaagctgtagtttcaaatacaccatttaaaataggttaatattcaaacatgttttagtagaagttaataaaagataccacttgactacagatctctaaggctctgaccttgtttttttttttaaaaaaagtaccataagttaaaagcatctgaaaactaccaatctctatatgtgaaaaaagaacctatttctctttgaatataaaaatagatatagattgtagaaatttagaaaacgctataaatataaaaagaaataataattacccatattaacactaactacttttaaattttaggctctatcttttcactatttatatgtgtatacatatacttaaatatatatgtgtatattttacagaattgagatttcattctatatggcttggaaaggtgccattttcatatagaatattattagcatttctcacatctggaaataggctacctcatgactacatagtactttactatgtgcatggccatgttagttttctgttgttagacatttaaatctatgattttttttcttatgctacattttttgaagtagaattatcaagtcagagggtggcctttgaattttgttagaatttcatgtcttgaattaaattcttactgttttcttttctggagtaatgatggtcatggttgtcatgtacaaacaggtcatatattcgctgaaaaattaattggcttttattagcagtaagctaacacatatagtttagtatacttatataacagtagtaaataatataacaagaagaacttttccaaagcattttagtgcagtgttgcagaagaattaaatggtattctggtggcctcaaggggcagcttaattattgatagggcctggataaataagaatagttcaagctaacactgctagctggttctcttgggttttatcaaccctatgactaactttttattttttaagaaataagccaaaactaaactatcattttttgcaatgatgtaattttctgaaatattttagaaaatatttttaatttgtat

SEQ ID NO: 11190 - DNA, 1027 bp, Homo sapiens
ttgtcagtggaaaaactgaggctttgcaaaattatttaacttgtacacagactgtaacaaggtagtttgaacacaggcacttcaacgttagagtttgaactcttagccagtatactagatggcctagaggtggtaataaattaatgtattataaaatcaaaaggaaggaaagacctaatctctttccttgggggcaagttgaagttaccagaaagtttttacagagttacatgtaggattgtaccagccaaagagaaggagggagagtctaggaaagaggaaatggcttgaggaaagtacagagatgggaaagcggggcctgagacttagcagtttaggaccaggctgaaggatggggtgtgggatttgtggaaagtgaagtagactagttaggcagaagttatggatgagttaaaaaaaattgaactctatcctaaaataatgtagcaagcctttcaacaattttaatcagaggaagcctaattagattttattttagttctgatgacctatagaaaaaaattgatcagccagaattgataagattggtaacttcttcaaggaaaagcagccagtcttagaggaaccctagatttctgacttgagtgacattgttgtcctagaagcattatgatttcattataacccttttaaaaaataatcttctaacatgtatcaggagtcttaaaaatgtttatacttttatgctagtaatttcatgtctgggaattggcttaagcaaataatacaaatgcaagatatatgccttttgaccagcatttatgatattagttcagagtgcttaaaacatattggtgaaattgaataaagaaataaatgattgactagttggtagaaaatagtggaaacattggaaacagtacacttaaatttaatgttaatgtacatttactaggtagttgttatgaatcaaattgtggttctgaaaattatataattacatgtaaaaatgtatcgtaacttaaaaaaataggaaaatatacttagacctatgtttaaataaact

SEQ ID NO: 11191 - DNA, 1071 bp, Homo sapiens
tatgtcatttgaagaatgctatataaatggaattgtatggtatgcaatcttttgagattggcttttttcactcaccatcattcccttgaatatcttttgatctcaagaaaaataaaaattttgcatctgtttttttaatttggacagagggcaatttaaggcatatttgttttatggttaagatccaaaatttgttactgatactagagaaaaaaatcgggattaccgtcagtgttagtttgaagatttgatagtgccagagagcacatggggaaattaaatgtattcacatactatttattgtgattttacttgattttttcttaagtaagccggtaaagcataaacttcctaatgttctgagatggtgatttttttccatgttataaatggtattaacatgttacaaggaaattccctcagtgtcatctatcaatgccaaaatcatattgaagcaattgtggaggatattacaactcaaggagagattttatatatcctattgcaaagtttaaagtatttttttttgactgtcattatatctctagtaagaggctgtggaaatgaaaatccagtgttcagtttttctttgtctgaaaaactgatgacagcaagataatgtttttctgtatctttttaaacagcctctattttctcctgccttgataatatgttgatgactctgttcagtctagatattaaaatggtcttgatcatttgaagcctcatagagccctcacagataggataccatgccttcctaacaaccctgtttctcgctgttttctggtgtgttcgttgtagaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatgtgagtagtctcaactttgattgcctgagtgctcccaatagaggactccagccattgttcttaaactgaccttggtcttgtgagaa

SEQ ID NO: 11192 - DNA, 1083 bp, Homo sapiens
ttaaactttagtataaatatttttgctcacttaataatcacggtgaggttcatcacctcttcagtagccttttatctgtttctacatagtaaatagaaaacttgccttctataataaaaacaaaatagtttttctatcaaggtcagtctcagcaagagaaatgggactgggctggatatcaacacatgtgcttgtgtgcatgtgcacgtgtgtgggtgggagggtgcggaggggttgggaagagagattgctcctcccgcagtgctgaaacaacatgccttgttcagtattaacatcttgaaggcagttatggcagcatgatccaggagatcgtcagctctaggatatttgcgatccaattctggcgacttatggatggatccttcacacccaacagctgtctatcaggggtgcttccgagggtcactgggtttcttttagctgcttggctgtgcagctgaagttaggacttttgatgaattaccctctcaatgatggtgtattgttctaatcttctgtctctgacatacccaaggaaccccttgtgtaaaaatcatgtccctctaaatgcaagtggatgattgtgccaataagccaggagagaaggaaacatcttcagtggtccagtggcacattcaaaattgtacaatgacatgacattaactcaaaaatgaagtttgaggttctgggcctttgatggactgcatctattaaaaacaaaaagtggtgtctcatgcctgtaatcccagcactttgagaggccaaggcaggaggatcaaaaaatgcgaatttttatatttttttgtgagatcccatctctaccaaaaaaaaaaaaaatacaaaaattagccagacatagtagtacatgcctatagtactaggtacttgggaggctgaggcaggaagattgcttgagcccagatgtttgaggctgcaataagctatgattgcaccactgcactccaacctgggtggaagagtgagaagctatctcaaaaaaaaaaaaaaaaaaaaaaaaaacatggtcaagatttgtaatagaaattgccatttgaattttggtctgtaagcccaaagattgtt

SEQ ID NO: 11193 - DNA, 1050 bp, Homo sapiens
gttgaaattatattcatcattccaaacccaacaaaatggttacatccttcatgaagggttccccaaacctcccagctggcattaattgttctgttacattttgttttcattaaatcaggctcccttccggggatctagctgtgaatgagacacacagggctcctggtctcatggagtgtacttcctggtatgatttaaaaaaaaaaaaaaaaaaaaaaaaaccactacataagccaacagctaaaccggcaaaataatttcaggtgttgataactgctacaaaaagcaaaagtgaaataaacagggtgatagaatttagagtgtctaggagaagcattttagatgggacagcttgaatgccaccttggatgtggtagcatttgagctaagacctgaataatgagaaggaaccagccatgtgaaaaggaagagaaagacccaagcagaaggaactgcacatgggaaaacaggaccatgctcacgtggttaaagagtcaaacacattcactgtgactgtaccaccataagcaagaagccctggagatgaaaataaaggccagaatgtggacagagatcagattttggaggccaaagtaaggtacttaaaattagccgggcttggtggtgcacaactgtaatcccacctactcgggaggctgaagcaggggaattgcttgaacccatgagacggaggttgcagtgacccgagattgtgccactgcactacagcctgggcggcacagtgagactccatctcaaaaaaaaaaaaaaaagtaaggtacttagatgtcattctaagttcaaggaaagccattggaagtttccaaaaaggaacatgacagcatctatatttttagaagatgaccctcaaaaccacaatgagatatcacctcatacccattaggatggccactctcaaatgatcaaactccagaaaataacaagtattggccagggtgtagagaaactgacacccttgtgcactgttggtgggaatgtaaaatggtagagccactaaggaaaacagtgtggaagttcctcaaaaaatta

SEQ ID NO: 11194 - DNA, 1020 bp, Homo sapiens
caccccctggctgggcggaccgggtgggggtgggtacgagccggggccgccgccgaggagcgcgtcccgagtgcgtggccggcggttgcttggtgtttcatcacccgaattgccacgaggcttcctttaggggagggatcgggggagggatgggagcaaggctagcagaggagggtcggcatcgcctgtggttccgaagcccgttagtcatcgttgtagcgttatcaactgtggagacctcaaacttgattcttcccccacccctggacaaaaaggaaaagtgttatttctgtgcagtaattggccagcacggacgctccatttcttctcaaaccttcctcaccatcctgcaggactagagaagcatgaggtttccctgtaaccagaaaaacgagtactttttgaaagtgctaattagttgtggcgggcgggggttgggggagagttacgttttattaaaccgacttgtcagcgtggtgttaaaaggctggaaagattcagtcgtagtatttgaaacagtcttcagtaggtgtagaggaatttttccaaattgtttgattcttaatggctatccaggaaaagttaaggcttaatattttaagtatgttgcttgccttcccccaagaacctttgcaagatgcataattgtttaccgtattgaaacattttttggggttttgttgttgttgttttgagacggagtctcgctcggtcgcccaggctgcagtgcagtggtgccatctcggctcactgcaacctctgcctcccaggttcaagtgattctgcagcctcagcctcccgagtagctctattacaggtgcgccccgccacacctggctactttttgtatttttcgtagagatggagtttcaccgtgttagccaggatggtctcgatctcttgacctcgcgatccgcccgcctcagcctcccaaagtgctgggattacaggcgtgagccaccgcgcccggccttccactgcatattgatcgtccaaatgccttctatgtgggggattctt

SEQ ID NO: 11195 - DNA, 1026 bp, Homo sapiens
tgcctgtaatcccagcactttgggaggccaaggcgggcggatcacgaggtcaggagatcaagaccatcctggctaacacggtgaaaccctgactctactaaaaatacaaaaaattagcccagcgcggtggcgggcgcctgtagtcccagctactcgggagggtgaggcaggagaatggcgtgaacctgggacacggagcttgcagtgagctgatacggtgccactgcactccagcctgggcaacagagtgagactccgtctcaaaaaaaaaaatcagatttttaggaattacacattagtggagtagttagcagagcccatttttctgagaattaggctctaacttttagttgtaatttagataagttccaaaataagtttttaaacatttaagcttctttgcatgattttatccatttacgttattcaggataagcatctatttgtttatcaagtaatgttttctttcaactttgttttttgtggcagatgtttataaattcttctgtgggatcagagggcacgcctattacaaccagaaaactacaagtataacagcgaggatggatgaacaggctctattagggctaaatccaaatgctgattcagactttagacaaagggtaagttactctgctgaatcattttttaatcatgtcaccacagattggcattagaggacttgaataaaaatgcacctggcaaaagtttactttgggtagaaatgaacagaaacaaaaaaatttgaggtatttgaatatattttgaatatagaaacagtgagtgttgtgatttattttctgtttacttggccaaacaaaagtattaaaatctcatatgattcaaggcagatctttatgcaacatcagtcattatttctaattatttaaaaattgtaatgcaaaggattcgtttaagagactttccatagcagcagacatgtgtattttattttctctttccttggcttgatctatacaagctgttttaacacttaccttaatgattttttttttattttaattt

SEQ ID NO: 11196 - DNA, 1059 bp, Homo sapiens
tcttgaaatctttcatttcttaagttccagcatccaatttttggatgaaagaggcattttctttgcctcttaagttccagcatccaatttttttaaatgtgccatgatttctttttcagaaaattaaaaccaatacattattagtggttttaatacagaagctctgctttttgtcagtaaaaatgggttctgtcacatacgtgttttaagcatccaggtccaggcataattcagtatccatttagccaatctgaataacaatttattaggatgaaagggaagaaatcttaaagtgaattctgaaagcccttttgttgcagttcgggagtagtggaaacttaattcagtttggtggtgagaagaatgactgtctgccaaccccaattgctcagttgtctatctgtaattctctgttttttacatgggcaataaaagttgaactgactcttgtcacatagagtcagtcaaccattagaaaaaaggtatggggtagaactaggtggtgaaagctaggacttgtttgtcagtgttgtagaattttgtttttttaattgttagtaatgcatagattcagaatacaaaggctttgtttaaaaactaaaaacttccacgttatctctcctctccttcctctcacccctgccccgccccccgcccttttttttttgagacagagtctcactctgttgcccagcctggagtggaatggcaccatcttggctcacagcaacctccaactcccgggttcaagagattctcctgcctcagctgggattagagtagctaggattagaagcacacaccaccacgcctagctaatttctgtatgtttggtggagacggggtttcaccatgttggtcaggctggtctcaaactcttgaccttgtgatctccctgcctcagcctcccaaagtgctgggattacaggcatgactcaccgcgcccagcctcctcctttttaaaaaataaaacactcgtctttggcttaaaacctgttattatttaaagaaaatggtatgtcatgacatttctagcagctgaaaccacctctcccctct

SEQ ID NO: 11197 - DNA, 1032 bp, Homo sapiens
tataaatagtgacaaaaataaaagtacgaaatatgtaaatgcggaaaaatacaggagaactggatatttacatgaattttaaggtcttttaagtttttaatttttattattatactttaagttttggggtacatgtgcagaacgtgcaggtttgttacataggtatacatgtagccatggtggtttgctgcgccgatcaacccataagttttttgaatgaggattttaacctgtatcatagggtgaagatgaagccatgtttgtagaatatagaaaacaactgaagttactgttggacaggcttgctcaagtttcaccagagttactactggcctctgttcgcagagtttttagttctacactgcagtaagtttgtcattacttttgtaacaagcctacttctttcttttgctctttgatatgggtcaaaataaatgattcatatgacttattaatccatgttacttattgagatcttatgtgtatctctggaaacaatgcacttgtcttcttgatttatcttgatcctttctacctttgtgatgtattgcctgggaaagttaacagttgctatgactttttaataattaaaaaggcttttgttggtgtcttaccctgtgcataatttgctgtatgaaaaatttatctttaaatctcactgacatattataccttggtaggaattggcagactacacggtttatggaagttgaagtagcaataagattgctgtatatgttggcagaagctcttccagtatctcatggtgctcacttctcaggtgatgtttcaaaagctagtgctttgcaggatatgatgcgaactgtaagtatactggagataattttgaccataaatttctgttttcagtataagctaatgggagttccttaattgttagagcttagtatatgttaataccggggcattttgatgttgcaataaataagaagaggtttcctaactttttcctgatctagctggtaacatcaggagtcagttcctatcagcatacatctgtgacattggagt

SEQ ID NO: 11198 - DNA, 1050 bp, Homo sapiens
atggcaacttgatcctccttgtatgatagtttccccaaatctaattttcacaatacttaatgtcaatttccgctttctcactttcccacaacctggtaaaagctagatttcataattgtaatttactacgttaaaacaacagtttgtatttttctgttttttttctttttttacttcaacccacttagtccatctgcctgttacctttccttcctctatcccttctctggagttaaatatttctctggaaatatttatttgaatttccctggcagtggccagggtagtaaagagaagagctggatcactaaacaagaattgaatatatagaaattcttaaacttgtttttcacaggctttatctgagtgtgcagtgacactgaaaacaattcatctcaaacgggtaagccttttagtccatgccccttcattttcatctcacatgtggtattattatcttgttcttgaaagatgtatcttgtgtaaaatttaacttttgttttgactttttggatgtggggaaaggggatgaatgaaagtagcagtatccatttattgtccttcatgttttgggtaacatgttttggtttgactaaggatgtgaaaaatcttagccagaatttcaagattcagttttcatgatcttgtaggcttcttcactaccagattttttattttatttttatttttatttatttttttgagactgagtttcacttttgttgcccaggctggagtgcagtggcatgatctcggctcacggcgacccctgcctcccagattcaagcaattctcctgcctcagcctcctgagtagctggaattacaggcacccgccaccatgcccggctgatttttatattgttagtagaaacagggtttcaccatgttggccagggtggtctcgaactcctaacctcaagtgatccgcctgccttgcttggcctcccaaagtgctgggattacaggcgtgagccactgcgcctggcctattttttatttatttacagggtctcactctgtcactcaggttggaatgcagtggtgcaat

SEQ ID NO: 11199 - DNA, 1048 bp, Homo sapiens
aagttaaataccatgaatttgaagcaaccttaaattcctttgacagataaatggataaacaaaatatggtatatacatacaatagaatattaagcctgatttataaaataatcctgtcatatgctataatgtggatgaacctagaggacattatgctaaatgaaataaggcagttattaaaagacaatgctctatgattccatttgtttgagatatctaaagtagactcaccaaagcagaaagtggtggttgccaggggctggagtaggggaaaatggggagttcttcagttaagaggcaaaaagcaagcttgttttgcaagatgcaaaagttctagaaacctgttgtacaacagtgtgcatgtagttaatgcttactgtactgtacatgtaaaagtggttaaggtgataagttttaagtgtttttaactacagcttttttaaaaaaagagctgggcacagtgacttatgcctgtaattccagcttcttgggaggctgaggtgggagtgtcccttgagcctaggagttggaggctacagtgagctatgatcacaccactgtactccagcctagatgacagagcaagaccatctcttaaaaaaaaaaaaaaaattaaaaaaaaaaaactggatacgaattacaatggatttaatacaaatacatttgttctttttctccctcttttccccaccccccaggagttttgtcaagcgcttcagcagcctgatgctaaagtttttaaaaattacttaaaggtaggtatttgtgaagctcacgtatcttcatacaattaggtaatgtttgagagccaagagagaatacatacctgcaattatagatgtttatgtgaagtcccttttaactaagctcttgaaaaagagtataagttaggtaagcacactgaatgtgtacacctttgagtatattggtgagaaaatgccagttttcttttacagtttcatgatgtaattaaatagaaactagagggattaggagaataagaaatgttcaagaacagttgtccaaattaagttgaaaagaaggggct

SEQ ID NO: 11200 - DNA, 1042 bp, Homo sapiens
ctcccaaagtgctgggattacaggcgtgagccaccgcgcccggccaattttttttttttcttttttttttttttgcgatggagtcttgctctgtcacccaggctggaatagggtggcacgatttcagctcactgcagcctctgcttccgggttgaagttattctcctgttgcagcctcccgagtagctgggatacaggcacctgccaccatacctggctaatttttgtattttttgtggagacggggttttgccgtgttagccaaggtggtctcaaactcctggcttcaggtgatctgcctgcctcggcctccaaaagtgctgagattacaggcatgagccactgctcccagctgaaacttagattttttttgtcatattattgtattttattatagtatgtatagtgtatactaacttacagggaaaaaatgtaaacaaaatgaaggtcatggggaaaatggcatcttgctttaatcttcaacttaaagttactcttaataatccatttataccattatgtcaaattttagtcatccctgcagaattttagacgaatgaaaacagacaaggtaacaccaaagagttaagcacagaaagtgatattgattaaaaagttgaaagtaaaaatctacattggctagaactgaacattcagatccgtctctccagaggaaaatctaacttgaatcataatggttcatattttgacttgttcataccatatcagttagcaacttatgacttgaaaatactttgaaacttaagatatttatattgaactgtttatacacttcatgtcagtaacagataatgggtgatcttacttgagactaaaaacagctaacatttgtttcttagctgtgttactcccttaaaacatagttgcaaattttttttttctcttagtataacaagaggattgcctgatccagccaagatgcagagcacttctaatcatctgtggcttttatctgatattttaggccaaggagctactgcaaatgtctttcgtggaagacataaggttagtacagagaaaa

SEQ ID NO: 11201 - DNA, 1049 bp, Homo sapiens
tggtggtattgtttacttaaagtttaggaggaaacaagtttaagtgggaagaccaagagtcaattttggatacgttaagtttgagctgccttttagatatcgagagaatagtaggatatatgaatctgaagctcagggcccaaggtagttttggaagttaaagcatacatatgatatttaatacattaggtctgaatgggagatgagggagtaaggcagttataataagcatggacagctgtactgagaagttttgctgtggtgggaagcagagaattgggtaattgttgaaaggagttttgtggtcaatttagagatcttttaaaatgggagatattaaagcatgtttgtaagcagaaagtaatgaatcagaacagagggaaacattgctgcattaaataagtgggataattacaagaattgatttctggaattggcaagatgatatgataggctctacagcacagatggaaaagttggccatgtataggtgcagttccattgtgactggaaagtaggcctggaaaatggacacagattggccaggtgcagtggctcatgcctgtaatcccagtactttgaaaggccaaggctcttaaggtcctcaaggatcacttgagatcaggagttcaagaccagcctggccaacatggtgaaaccctgtctctactaaaaatacaaaaattagctaggcatcatggcaagcacttgtagtcccagctactcaggaggctgatgcaggagaatcactcgaacccgggaagcagaggttgcagtgagccgagatcaagccactgcactccaccccatctcaaaaaaaagagaaaaaaataaaacggacacagattcaggtaggttgtatttggtaaagggcataagggagtgctggtctgattccttccatttccacattaaattatgaagcagggtcatcaaaactgaggatcaaaggaggtggtggaggtttgaggagggaggggaagatgtgaaatagtcttttcagattgggaaagtgaagttattaggaaaacaaaatagaatttctaagc

SEQ ID NO: 11202 - DNA, 1051 bp, Homo sapiens
aatactattttaggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatacgtaagtatctctattttcttcttgtatcaacatgttctgttatataatattttcctaagttaggaaaagaaatagaaaagatgcctcagcttcaccaaaagtacccatttcccacatggaaaattatatttaagtgcttagtaaattccttttcacttatttttggagtaaaaggattgataattctaaaatttatagttaaattagcttgtttcttaaactgtaagttttacaaaagtactttcattgctgtgccttctttcaagttacataatcacataaccacaaatggcatctaccaataaaccagccaggttttgctaagtgtactatcctgccatgttaaaatatcaaagcctaagtcttcattgttagcatggttatttgcctatgataaccctatgcagataatatggttactattaaccataataatggttaaagcacctggctccggaaaaataatcagtgtttgttttatgtaaacaaaaacacattacacccatgtgattaaaaaaaactacccatgtgataaaactgcatataaagttttggtcaatgatggaccatatatacaacactggttccgtaagattataatatcatatttttactgtaccttttctatgtttagacatgttcagatatacaaatactgtttctaattatgttacagctgcctgcagtattaagtacagtagcatgctgtacaggttcgtagcctaggagcagtaggctagctaccctatatagcctaggtgtgtagaaggctataccatgtagttttctgtaaatatactctgtgatgttcacacaatgatgcagtttttagaactattcccatcattaagcaatgca

SEQ ID NO: 11203 - DNA, 1029 bp, Homo sapiens
tgggtgtggtggctaacacctgtaatcctggcactttgggaggcagaggcaggtggatttcttgagtctaggaatttgagaccagcctggtcaacatggtgaaaccccgtatctacaaaaaaaaaaaaaaaattagccaggcctggtggcgcttgcctgtagtcccagctactcaggaggctaaggtgggaggatcatttgagcctaagaggttgaggctgctgtgagctgtgattgtaccactgcactccagcctgggtgacagattgagaccctgtctcaaacaaagaaacaaaaacaagataaatgcctagatatctgttagattagtggtcagttgcaagaagtaaataaaagaggttgaggctgctgtgagctgtgattgtaccactgcactccagcctgggtgacagattgagaccctgtctcaaacaaagaaacaaaaacaagataaatgcctagatatatgttagattagtggtcagttgcaagaagtaaataaagcttccatggtctctgcgtgtgtatatgtgtgttgagaaggaatattgggaataatgagtgattgtagctgcatcttgtttccgtgtgaaatgtgtctttaagctcctgctggggtccagaccccatcccgtgttgaaatgggactccctggttgtttctggggcatggtgtctgtggaagaaggtggattctggatcttgcctggctgggaatgagggctccagcagcaaggcttagggtttgaaggggaaatagtgtgtgtgttttaaggggctcagggggagatgtctttggatatacatgaagagtgcttagaatagtgctaagcactcaataaattttagctattaacatatataatgtactgtgccttttgttataaaacgcagacctttaaatagaaactagaagggccacgttcttggaaaaaatgttcagtgttagaagcagtaattatgtattaataattatgtaagtgccaaatttggagcatgcacataatgttgatctctctctacccctcac

SEQ ID NO: 11204 - DNA, 1025 bp, Homo sapiens
ggaaccacaggtgcacagccgccactcctggctaatatttttattttttgttcagacggtggggaggctcttgctgtgttgcccaagctgatcctgaactcctgggctcaagcgatcctcctccctccgccttccaaagtgctgagattacaggtatgaaccactatggctagcctggtctacagaaatgtctaattttcttcagactttgttctcccttcaaattaggtttcatctggcagagtggctactccatttgtttgcaagcctctgcccttgatgttcagattcctgctgctggtggagccggctgagtttcccagatgggctccacctgcctcctcctcggttgctgcagcattcattgcttcgtgcttcctgtctggctcgcctccaaatgagcctgttcatttcctttctccggaaactgtccttatcactgaggttcaaaagttccataaaggatatggcagtcttgagacttgacctccaaactttgaccttaataaaaactggttttttaaacccagccaacctgaatgagtggactatggcttttgattgctgttagctgaaggagatgtatggctgctgggtgacgccttgaacagtgagatgttatatataatcttgaatttggggtggtgcttgtgtcaccactcggaattatgttgtcagtctcacttccctcctggcttcttggcaatcgtctttattaatgttttcaattttcttactatccagtgaacttactttgtatttattgtttggggtagtgttgtagatggtattactatttgaaaacttactgttgaaagggaccgtagtccagtggcctcttttaataatcagggaaaactgagtccatgaagacacgcctgcctttgaaaacctaagaatccactgctttttctgttgagacagaccccacagagatctccgagaggacggctgcagcaagagtgctgactcccatgcagccgcattccttttctaattgtcaaagctgattagtggatttggat

SEQ ID NO: 11205 - DNA, 1042 bp, Homo sapiens
ttggagttagggaggattagcaggctttcatttgcttccacattttttttcagcagtttaatttactgaaactggcataataatgcctccttgattaggttgttgggagaagtaaaggcaatacaagtttggtgcctggtatacttcatcagggtgacaaaatgctgtcatttggtcatttgtgatcatgtctgctactgcataatgtcatgcactggtgggactctttagacagctaattattggtaaattcttcacagtgagaagaggatttaaccgatatttctccctctagagtgtggggaggtagagaagtgggtgagactggaagggtgggaaggagaagtctggctacttgtatcttggcctggggatttgtttggaagatgaattatcctctggtagttgtgtacagtttacaggtcagtgattagtatgagtccgtgaatagtgccagttaatactgattaactgctgtactttttgccaataaatattgtaaagctataaagacaacagagttaatacaagttgctaaagagaaacttgtggtaaatgtctttaaatgttgtttaaaatagaaatggccaatctagcaggcatgctgaggaaatgatgtttttgcagaagggaaatttagcaatgacagttttgcagaatatattggtaatgaagtgttacttgtagctgctgacaaattagttttcttaaaaaatatatcccctaggaagactgtagtatgaaagaatgagaaccgtaattggtggatgagcctggagagtttgaaggtaagagagaaagagaagcagcgagggagagaaggagagagagagagagagagagtgagtgtgtgtgtgtgtgtgtgtgtgtttcaaggtaacatgcaagaacaataaggttcttcttgtgtggttgtaatttttttttttttttttttgagacagggtcgcactctgtcacccaggctagagcatagtggcataattatggctcactacagcctcgacctctgggctgaggtgatgctcccacctcagcctcc

SEQ ID NO: 11206 - DNA, 1631 bp, Homo sapiens
gcaaagtgctgctgggcttcagctcggacgagtcggacgtggaggccagtccccgggaccaggccggcggcggcgggaggaaagaccgggcttcgctccagtaccgcgggctcaaagcgccgccggcgcccctggccgccagcgaggtgactaacagcaactctgcagagcgaaggaagccccactcgtggtggggggccaggaggccggcgggccccgagctgcagaccccgccggggaaagatggagcagtggaggacgaggaaggggagggagaggacggtgaggagagggacccggagaccgaggagccgctctgggcgagccggaccgtgaatggcagccggcttgtcccctacagctgccgggaaaactattcggactcagaggaagaggacgacgacgacgtggcctccagcagacaggtattaaaggacgactccctttcccggcatcggcccagacgaacccatagtaagcctctccccccgctgactgctaaatcggccggcggcaggctggagacttcagttcagggagggggaggactcgcgatgaatgacagggcggcggctgccgggagtctagacaggagccgaaacctcgaagaggcggcggccgcggagcagggaggagggtgtgatcaagtggactccagccccgttcctagataccgtgttaacgctaagaaactgacccctctcctgcccccgccacttactgacatggactcaaccttggattcgtcaacaggctcccttctgaaaaccaataatcatattggcggtggggccttcagtgtggactcccccaggatttattctaacagtctccctcccagtgcggcggtggccgcctctagttcactcaggatcaatcacgccaatcatacgggctccaatcatacctacctgaaaaacacatacaacaaaccgaagctttccgaacccgaagaggaacttctccagcaatttaaacgggaggaggtgtccccaacagggagtttcagtgcccactacttgtcgatgtttctcttaactgctgcctgcttatttttcctaatactgggactgacttacctaggaatgagagggacaggagtatctgaggatggagaactcagcagtaagtattaaatcctgtgggtaaggtaacaaagagaatgttgttagtggtccgctttagccgcgcttagcgttttacatgaagtgacttacctgcaagaatatggtttaacagcaaaaacgcaacagtgcgtgcatgtgtcatctttcttaaagaacaccattatcgaaatgatgtcatatggctggttttaaaagttttctgcatgatgtattgtgaaattcaaaacaatttttaaaagaatattataagcttgttagtaaaactcatttgtatatgtgacaattctcttttagccctgaaagactatttgcgcagatgccagttacttaacaaatttgaagtattaggataaggcacattataaatgtagtgtttttccaaattgagttgtgattctaataggcaatgtaatagctcttgaaattcgaattattttataatattaactgtatgcataaattcggattaaatattttgtggtattaactgtatgtataatttct

SEQ ID NO: 11207 - DNA, 1023 bp, Homo sapiens
ttgctgtgtcacccaggttggattgcagtggtgtgatcatggcttactgcagcctcaacctcccaggactcaagcaatcctcacagctcagcctcctgagtagctgggactatagatctgcatcaccacatctggcaaattttttgtattttttgttgagacaggatctcactttgttgtccaggctggtcttgaactcctgggctcaagcgatcctgtcaccttcgcctcccaaagtgctgagattacaggtgtcagccatagcagccggcctattctctcattcttgaagaatgaaagctccatgttatgtttgaagttttacgagttgactgctttgtaagaaaaaaaaaaaaatcctagatctatgagaatattcccgtgaatgccagggatttgcatataccagtttgatgatttcagaaattaaagtctactctatgaaaatgtttttcatttgaaaattttccctagaatgatttaaattaaaaataatgaggaaaaacttgtgaatctctacagatatatccacggagactagtttgaggatacactggcatagctatcagagaacctgggcttcaatattggcccttccacttactagctttttttcactaaggcaagttgcttagccattgtaaacctcaatatcctcatatgaaaaataggttaaatgagaatgaagtaatgtgtgtaaagtaaaactcatacatggcacatagtaataataataactaacccttacgtagcattaactgtgttccaggcactgagctaaacaattattatttaatccttatgaggtaggtacttatcccattttataagtaaatggagacactgagaagtaactcgcccagggtcatgtagctagtaagtgaagcggcagtatttgaactcagacagtggctcttaactgttcttctagattgccttttaatatgtataaataaggacttgatatatgttctctactattattgtctttattttcagaaaactgtgacaagtatagattca

SEQ ID NO: 11208 - DNA, 1358 bp, Homo sapiens
ttgtgatttaatttttccttatttttaggcacaaaggacttcttagcttagagtggaagtggtatcttctaagtccttgctcatattcctgattgggaatgttcctttatacttgttcctcatttcccattcattaaactgctttctacaattctttaaacatgtagaatggagagatggctctttgagtctgttacaggaccgtggcggcagataagggaaagctcagctcctattggcaaaagtgaaaactaatgtctagtaaaacttttgtctggatgaagaagttttctaagggtttcagtacttcattctgagaaagaattgagaagttcttattcatcatgctctttgaattgtaaatattttttcagttattttacaggattttatattgtggattaatacttagcagcatgttctatttaatttgaataatttctttgaattacatttggattcctagagaatattttctcacaaactttttcatttcaaaaggaaaaacaggcagtccctaatttttgaatacgttgtcttccagattgtgtgtaaaacagttgtttgaacttggagcatgttttactacactggttttaagttcctgggctagcccacagaagcctatttaaaaccacatcctattttagcactaatatactgttggtttaagtttagggaatcagagcattggatcgtgttctgtgggagttggaggagaaagtaagtttatttttggcttttagtgttttctcttatactttttcatctctttaatttctgttttccaacttatactggcctaagctttctgctcttttactataatcttggctcaataactttaaaagattcaataacttctaagtgctcaataacttcaaaattttctgtatggaataggtttacttgttgagtgcttggcaaataaacgttttatgctcattcgtatctcatttagttttaagagttttatgaggtaggggctagttttccatcattaatgaggaatctgaggattaggttaatcactttgtccaagtttatagggcagggagaggagttatggagttaacgttgttgggtaaaaaccttagcaacatgacttgaaagctcatccactaaccattggacatactgttttcctttttcacatatcctcttctcctttctctctttactaagttccaactccccctattccctcaattcagatactttttttttctttttgaaagagatgtgtcttgctctgttgcccaggctagcctcaagtaattactcgggccttgggctcaagtaatcctcccacctcagtttcctgagcagctggtctacaggcacacaccaccaagtct

SEQ ID NO: 11209 - DNA, 1109 bp, Homo sapiens
tactaaaatccacagatgctcaagtccctcatataaaattgtgtagaatttgcatataacccatgcacatcttcctgtataatttaaatcatctttagattacttataatacctaatatgatgttaatgctatgtaagtggttgttatactgtattgtttttaaaatttgtattattttgtattgttatattgttagcatttgttttgtttttttcctcccacgtatctttgatctgaagttggttgagttcttgaatgcagaacacacggatacagagggctatcaccactacctttcttcccaacattgtggtaaactacaggggtgtctttagctgacaaattagatagaggcagcaccttaattgtttccctctggagttttgagctgccgggacttacttttgtctttgtgggacgggtgaagcaggcaattcattattaactttatagtttatcttagagtaaattgttgatatttacttaacatctaagagtcttctcttagattaaactttttttgaatgaggacttcagttttagttactgatcagattcaggaagaataattctatcaaacattcttttttgagttgtggatgctctataaagatatcggaattcatctttggaaggaacagactgtcattaaagtcttaaatgtctattttggtattttctggatttgctaatgatctaactttctaatttagtaatattttatttagataaatgaaaccatgcttatgaaatcattgacagatgaatcacctccaactcaataggttaagcattttagaaaatttatgaatattttcagacacatattttaaaaatttctagacacaagatcttatattttagctatttttcgatatgctatgtttctgacaattttaggaaaaataaaatcttatttctaatgtaaattatatgaatttctaaaaataaggctatattaaacatcattctaaaaccaaaaaaaaattgttacattacaatgaatcttctaggtctttgcaaaagagagggaacttttctttttcagttttcaatttataaagagtttagattgaattatgaataaagctgctgtaaacatccatgt

SEQ ID NO: 11210 - DNA, 1032 bp, Homo sapiens
tgtccaattctttgttcaaaacaccaagaaccaggatgactcatagtcaagaccttccaccagtaatagttctacatcctcactgcattcgtgatgtcagtgttctggtttttagccattctgataggtatgtaatggtatctcattattttaatttgcatttccctgataacgtatgatgtggatcatcttttctgtatactttctttggtgagatgtctgttaagttctttggcccattttttaataggatttgttttcttgaatttttttcatctattttgaatagcagtactttatcagatatgtcttgcaaatatttcctgacagtctatggcttctctttttattctcttaacagtgtcttttatggagcagaaattttttaatgtgaatgtcagcttatcacttctttcatggattatgtgtttgctgttgtatctaaaaagtcattgccaaaccctgggtcatctagattctcttttatcttctaggagttttatagttttgtgtttgatatgtaggtgtgtgatccattttgacttaagttttgggacgggtataaaatctgtgcctagattaatttttttgcatgtgagtatccaggtgtttcagaattatttgttgaaaaaactatctttgctccattatattgcctttgttcctttatcaaagatcagttgactgtatttatatgggtctatttctgggctctctgttctgtttcactgatctttttgtctgttcttttaccaataccacactgtctagattattgtaactttagataagtcttgaagtcagacactgtcagtctcccacctttgttcttcaatattgtgttggttattctgggtctattgcctttccatataaataaaccttagaatcagtttaacagtatcccgaaaataatctgctgggattttgattggtattgcattgaatctatagatcaagttgagaagaactgacatctagaaaatattgagctttcttatccatggacatgaactatctttcagtttaatt

SEQ ID NO: 11211 - DNA, 1074 bp, Homo sapiens
ccttctctttaactgattatccccatctaggtttgtatctcgaaattcagatcaataggtgggattacaattgaaaggttattaatgaatacaagggtggtggtacaagagtttaccttaggcaagttgtatggaagacagtaatagataattttgtccataaaacttttcctattttgattatgtaatctcaatattcataatttgttaagtatacatcaagggaactgttcctgtcatctagaatgaccatctatttaataaagccatgaaacaattagagaactttcagaaaacaaatgggcataatgctatgttgcaaaaacatgtcctgccttgttcaccctgtccatttttagattggtctggatgatagtgaaatgcagaagtgtttgccacacaggtgcagtgttttgcagctgttggaaacattccccctcacccacaacccctttgctttcttcacataaaattatgctgtgcttagaccattaatactagaagatgggatttgagaatttgaatgtctgtttacataaagatgtaatacagagaaataactgctcattcaggcatctgaatgtaactgcctagatgaatttattaaaactgtccttaaggtcacactagccttaaggtcatggagttttagatacaagagactgcctttaaaactcctgtctgtagaattgctgccctccaggactgaactgtctttgaggacagggcttatatatatttatttttaaatctcttgtaactaacataacacctggacaagtaggcactttatatgtttgcgaatattttatgttggaagatgaagccaaatgaaaatatcttttagtatggtactaaatcagaaattataatttttttaaactgatgccatgtggtacactctatagtagtcatgaacagagtgccatggcctgagagagaaggggagagtgaataatcatgtccatggaaatcacgggatactttatatttttatgtatcacggaaaatacttccctagactacaattggagaatttgttttgaagagaatttttttcctcatctaagagaa

SEQ ID NO: 11212 - DNA, 1019 bp, Homo sapiens
tgagtattccctaactgtcgtataattaaatctgacacagattttctcttaagagctgaactgtttatcactttactgtaaaagactactgccaagtaaaatgggagtggcatatcatcagtggatcttgtcttacacttagaagtatgcctgttgcctgtagttgttggataccttagcagtttttgtccgttttgccctcattttacctctttggatcttctgcatattggcatgcctattcgaccatcaaaaggacttagaaaggaagcatatccttcaggctatttctttaattttttaaagagtgctataatactaattttaacctaaattttacttatataaaaatatttttcacttacccatcattacagggacttcagagattaagatgtttaagcttgtaattagttattaattttttattataggaactgttatatagacctgtatagaaaacattatttgttgtactgaaggatgtgtaataatgtgtaatcacatccatagaatattactttctgttgttaaagtggaactctgaaatgattagtaatattctattgcagtgataattgtttaaaacaaagttggctttttcagttgccttaagtataacactgctacagtgtcataatttaaatttggtacagtatacttactgaacattagaaatagaagactattttcttctgtttaattttccccaaggaagaaactgaaattctgaacttctgaataatagtaacaattataatgaagatagtggctgtttacttatattaaatgctcattctgtacagggccccttgccaagttgtattagtctgttctcatgctgctaataaagacataccgagactgggtaatttataaaggaaagaggtttaattgactcacagttcggctggggaggcctcacagtcgtggcggaaggtgaaagtcatgtcttacctggtggcaggcaacagaatatatgcagggcaactccactttataaaaccatcagatctcac

SEQ ID NO: 11213 - DNA, 1080 bp, Homo sapiens
aagtgttaaaattcattattatttaatcaaaggcataaggcaaacagtttaaaatatccttgaagagtccgggcgtggtggcaggcgcctgtagtcccagctactcgggaggctgaggcaggagaatggcctgaacccgggaggcggagcttgcagtgagccaagattgtgccactgtactccagcctgggctacagagtgagactccatctcaaaaaaaaaaaaaaaaaaaattccttgaagagaaaattggctgaggattgaggagggaaatatttaatggtgacaatatatgagaaaattggatagagtcaccctatagatttttctccctccaaaatgaaaaacaatagtctgggccttactaaaacacaattagaaagtagctaattcaaattacaaaattgcctttatttaatgaaagattatttgaaagcttattttatgtatttacttgtggaactttaactagtttgcagaattattagggaagccagtagttagacatttaagctgaaatattaggagacaatctgaaaagcagtcaaaatggaagaagagtgtaatcaaactgtaaaccagtaagtaagtttaaaagttgatttgtatacttttcagatttactgctagtttagtgtacttgtactaaagataactgaaccaaaacctttgtttctttctcaaaatgtgttcattcacttaatagcatgtatcatcatgccactgcactctgccacagcctgagtgacagagcaagactgtaaagatagatagatagatagatagatagataaagtaaatagtatatctcataaacacctacttagattataatttagttggtcatttggatagcagttgaggcccttctagtatatagacggtcatttaaactgtttgtttgtttgtttgtttttttgagacaaggtctcatttttatcacccaggctggagtgcagtggcatgatcacgactcactgcagcctcaacctcctgggctcaagttatcctcccacctcagtctcctgaggagctgggactacaggtgcataccaccacacccagctaaattttgtattt

SEQ ID NO: 11214 - DNA, 1015 bp, Homo sapiens
tagggaaattgagataggtgagtagtagcatgtaagagagcaggtaaatatctaaccatttatttaaaatcttctgtcccacatcagtttcttctccaaatactaagagaacttgctgttgaattttctaaactactgtaaataatttctggaaaatcttaatgaaaggtagtaaaagattaaagatggataaatgtcattctgatttctcagaagtggaaagtggcatttgaaaaccatacaggaaagcttgttgtcggtccagttccataaagataatttcataaagatctgagttcttgcaaatggaaacgttgatccctggaaggtggctggcatttgaacgtggacaagtcatgccatacaaatttcatgcctcccatccccttgttaaaattgtggtaaaaaatatataacgtgaaatctgttaacatatttttaagtataccgtacaactatatgtgcattcttatacagcaaatctctagaacttcttcatcttgtatgactgaaactctatagccattgcacagcaggcccccgttttcctctgctccatatccctggcaaccaccattttactttcttcctccatcagtgtgattaacagatacctcatataagttgaatcctgcaatttttgtcctgtgactggcttatttcacctagcataatatcttcaagtttcatccatattgtaacatgacagtacttccttcattttttaaggctgagtagaatttcattgtatgtatacatatattttctttatccagtcatgttgatgggcttttagattgtttccacctcttggctattgtgaataattcatcaatgaacatggcaatgcaagtacttctttgagactctacttttaattctgttagacaaatacctagaagtgggattgatagataatatggtagttcaactttttattttttgaggaacctccatactgttttcatattgactgtaccattttacattctttccaatagtatagtaggattcc

SEQ ID NO: 11215 - DNA, 1033 bp, Homo sapiens
ctgtattcactgtttttttttactgcacatatgctttttagtttgatgtagtcccacttttctgtttttgcttttgttgcctatgcttttggtgtcatgtccaagaaattattgcccatatcaacgtcaagaagcttttcttctatgttttcttcaagaagttatatagtttcaggtcttacatttaagtctttaatccatttggagttgatttttgtgtacggtataagataaaggtccagtttgattctgttgcatgtggaaatccagttttcctagcaccatttattgaagagattgtcatttctccattgtgtagtctggcacccttgtagaagattgttggatcatacatcagtggctttatttctggttctctattttgttccactggtccatttatgtctattattatgctagtactatactgttttgattactatagttttgtcatatgttttaaagtcagtgtgaggcctttgtggttccatatggatattaggattatgtcttctatttctgcaaaaaatgctattgggattttgtattgctgtattgccttcggtggtatagtaatttgagtaatattaagtcttccaattcacgaacatgagatgtctttctatttatttgtgtcttttatttcattcagcttttttttttttttttgtagttttcagtgtataagtctttcacctccctggttaagtttattcctaagtatctaaatctttctaatgctattataaatgggattattttcttaacctccttttcagattgttgttagtgtatagaaatgtaactgatttttgtatattgattttatatcttccaacttagctgaatttgtttattctaacaagattctttttagtagagataggggccttgctatgttgcccaggctggtctcaaactcctgggctcaagttatcctcctgccttggcctcctaaagcacggattacaagcatgagccaccacacccagccaaataacaagatttttttggtgaaatctttagggctttc

SEQ ID NO: 11216 - DNA, 1027 bp, Homo sapiens
cctaccacacacacacacagtattcttggttggcagttgttttctttcagtactttgaatatgttatttcactctctcctgctttgtaaagtattttggggactcccttgtatgtgatgagtagcttgcgtcttggctgctttcttctccttggttttcaacaatttgaacataacatgtctgaatatggacttattttggtctatcctcattaggattcattggcttccttgagtctgaatacccattttcttccccaggtttggggagttttgggccccaaataacatggtgtttttgtttttgttttgttttgttttgcctgtttctttcttctctttctgaaacttccatattacttatattggttggcttaatggtgtcccattaaggtccttagactttctttacttgtctttatcctttcttcattttgcttgtctgacagaataattccaaatgaccttcttttgagtttgctgattctttcttctgtttgatccagtctgcttttgaacccctctaatgaattcttaaattcagttattctttagctccaaaatttctgggttttaaaaatattttctgtctctttgttgatattcttacttgattcatgcattgttttcctgatcttgttgagtatctttatgatggctttttctgaattctttgtcatgtaattcttagacttctacttctttaggatatgttttggaagtgtattttgtttctttgattgaccatgttttcatggttcttcatgtgccttgttactttgtgttgggattcgtgcatttaacaacaacagaaataaaaaaaacagccacctttgtagactttgtgtggggaaagtcttttaccaatatgtctgtgtagacattctggatttcttagatatcttttctgtggttgtggttgtgacctctctggatttttgcctgtgaatttccaattagagaagttttgctggtttattttctcatagtttataatcttttgatccctggtatctgtaggttatccc

SEQ ID NO: 11217 - DNA, 1053 bp, Homo sapiens
gatccacctatcttggcctcccaaagtgcagcgattacaggcatgagccactgctcctggcccagctcttttttcttcttagtggcccccaggcatctggagtatactgagtcctatccgcattttgaatcaggtgaggcagaagccagcgaggcaacactccttgcccctgtgaagtcagaactttggatgcatgtctaacttttttcctccccagggagaagccaagagttggggtttttctcaactttcttcatgccgagctgggggtagggacaatggtgagtgagtgctgttgcctttgttcttagtagtccttaatttggtgtctttcaactattagattcagacatgacagaaaccagttgccccgaaaagtcagatcattagatgtatgttctagtcttctgttttccttctgaggaggaagccacgagttgggagtttcctctctattgcactgccctgtggggtgatgagagtgtctgggaagtgagtgatatgaattttcctaacagctttgatacaggtggttttgtgcttgcctaggtgcaggaaccttttaactaatttctggatttttcacaaatggaattggtccatgtatttttgttgaatcggtgtctcattgagggaaggagggtctggggcttcctattctgctgatgtcactcctccactttttaaaaattaagaatgtagtatatgttttaaggctttcagcaaagttttggtaatagtctcctgtgattatgcttgtcaacaaagagaaatattgactgagtttttaacttaatgcatgacttatatgtaggtaccaaaaagatcctaagacagtataataaggagattatatctggagtcaaattctggtactgccagtagaagctattacattttggtaaagtctctaacttttctgaacatgtttctctgtgaatgtgggactgccgttaatacctgtcaaagttgttgggagacttgagtatataaaatgcctagctcagtgcctgatgattatagtagcttcccaataaattcaatttctgtgtt

SEQ ID NO: 11218 - DNA, 1028 bp, Homo sapiens
gtgaatacttattttatcttagattagtggtgtgtagctaaggaaaggtaaggtcatatcttcctgtaacagtccagattagatagggaaatgggtgaaaagccacaagttgttttgcaactctggtctcacagtaattgagagcaaaaaggaaaaagtgcactgtagtcccccttgtttctgattttgtggggtgtgaatatgccttctagtcagatcgccttagggggccaggaagaggagggttgagggcagagcatgtttacctgcgtgcagagccacttgaaaaattataggctcatttacatatttgcatccttgtgtatgtgtttgtgttgcaggggagtcagtgtagtattatgaaaagaacatttgacagtgaattggaaaactaggtttttctagtcttgtttttgcctgagtcgtttaagcttcttgtgcctcagttttcatatctgcaaaatgaatgaattggactgggtaatacctggtgttgctttaagattctgtaggctgggcatggtggctcttgcctgtaatctcagcactttgggaggctgagtcgggcggatcacgaggtcaagagattgagaccatcctgaccagcatggtgaaaccccatctctactaaaaataccaaaattagctgggcgtggtggtgtgtgcctgtagtcccagctactcaggaggctgaggcaggagaatcacttgaacccgggaggcggaggttccagtgagccaagatcatgccacagcactccagcctggcaagagagcgagaccccgtcccccccgcaaaaaaaaaaaaaaaagattctgtaatttaaggattattttaaagtctccaactttctgtaatttttaatggaaaaatatagttaatacagtatgcaaaattatgtctttttaaaaaatattttgttcaagttgactatcttgtgcgattcactataagtgttacactgcatctaagatcttatgtttgaacttcgtagcctagtgtgcccagtaatttgagctactggcaa

SEQ ID NO: 11219 - DNA, 1047 bp, Homo sapiens
ttagctcccacttagaacatgtggcatctggttttcttttcctgcattaatttgtttaggattatggtctccagttccattcatgttgcttcaaaggccatgatcacattttttatagctatgtagtattccatgatgtatgtgtaccatgttttctttatcccccacaaaattatgtttatgttatctatattggtgtatataactcatctttctaaaacttagcatttattatccatatgtttttctactttttaatttatttatgctccttggacatttatccattaggattcttgtgttttcctatggagtcaaatctgtattttctcctattactttcaagcttcattatctatatatttaataataatagtgatgataatagtgataataataccaaccacttacagatatgtgctatgtgtcaggcactattctaaatatttatttattacagttttatcaaggaagtacaatatcatcatgataaatcatatattaagattaaggactgaggcaagagtgttcagtaatttgtatgactgtgatttaatctggcagtctgactccagagtctgtgtttgtaatcattccactactttgactcctatgtagtcttttcttttaattatgccttttcccatttaactttttaagatatttaaacatttctatgacattcaaaagagaatggccctagtgtgatgttcaaatgggttctactgtacgacaccggttgctcaaagccatgacacaatgtaattttccatgattttgttctacaggtcttttaaaaattctctgggattcactattgcttttctttttcctaactggggggaaaagtatgccttatttgttatccttctaaaatatttcagttttttacttttggtctgtggtttggaattgattcccttgatttcctttgtgtgttcggactagtttcttcatatttggacaatgccctcctcttttgaaaaatattgatatgaccttagatgaatcacttaatcttcctgagctttgactttttcaagtaag

SEQ ID NO: 11220 - DNA, 1025 bp, Homo sapiens
ctcacccttcaactgtacataaccatcctgtggtgttcctctctcctgcccttatattaccccatagcttcctatgcatgattctttcttactatcctcacagtcatttctactgtgctctttggagctgtgattccattgtaaatacattcttttttatcctcaaatctcttcacaaaatgttttcttcatttttttttaattgagacttgtttctctcccaaggtccctcttgcagctgcaagagtacaagcaataactcttcattacctccttcagaacctcacttttcctttctcatgtaagaactccttacacagccacttattaactttcatcattgctgtgatttattagctccctggtaatgcccttcatttattgaggattttagttttccactctaattcttgctatcctcacgtgtgatttcagtgaccatgtggaccgtccaatcaacaactgagtgtcttcaacctccatgtcccgatcccttccctttcttcccagtctgttatgtacttcatcattttacttccctgcccatccatcctagactctatggtgaccatttttcacctttgccagtgctctctgggtcctggatttgttttccttatgctaaattccccggaaaaatcctcaaccatctgctttcagttgtagctccttcacacaggctgcatggccctgctggaggaaagagtataattatgggataattgccactaaagatttatggtcttcaatttcaggttgccccttggcactattctgcagtccttctgtgtctttatcacttttctcaaatccccttttctaccaccattttctttttgaacaatcatcttgcctcctatttcatagagaaatttaacactatgaagcttgagcttttctttcctgaaactaacaaacgtttatatctacactgaacctcctttctatatgcttggaggaagagatgtcctcttttctagttcaaagtagtcatctcaactctctcctttgggatgttactccat

SEQ ID NO: 11221 - DNA, 1033 bp, Homo sapiens
gagtagaaaaaaatcaatgcaaaattacttgctattcacatatatgcagaaaatgtaagtccttggaatgtagcacacattatcattacataatctatatccatatgctgtttataacaagctgaaatgttatacccttgagaaaagaaccagattctggcacaggactgttttgtggcaaggaaagatgaatggattccaaaattttaaaaggggggaaaagcttgatggttccacaaaaaataagagttgaaatggggatttagagatatatatgttaacacaagctgacaattaaagcaattaatttccttctttatctatatcccctcctagctcttctaatcctgactaaggtaaatggattgactcacctttttagcagatgaagataggaacaaagatatctggcattacagcctgtctccccatcccccgccatccccatttgtagcttttttttttacagatgtttttttccattagttagaatagttagttcttaaagcagttagagacagatctgtaccagtcagagaagcagtggttcaagcctgttggcttaattgctttgagtatgttgctaatgatgctggggccacatgttagatagccaatgtgagcgtttttatgcagtggaaaaggtctttctccagacaaatattgtacctctaatccttttatgagtaaatctgagataaagggatttgtgaatttgtcagtgactcattaaaaatatattctgagtcccttaggatagctattattaaaaaacaacaaaataataagtgttggagaggatgtagaaaaattggaatcttatactagtgggaatgtaaaatggtacacttaatgtgaaaacaatatgtcagttcctcaaaaaattaaacatagaattaccatataatccagcaattccacttgtagttatatatccaaaagaattgaaagcagagactcaaacaagtattttttctccagtgtttatagcagcattattcatagtagccaaaaggtatttttttccttgact

SEQ ID NO: 11222 - DNA, 1005 bp, Homo sapiens
gggaaattcaggtttagcacttaaaatatatataatagaataaagatctaaagcctattcagaagttggagaggtttcagttagagaaaaatgtcaggagaaaatttagataagggaaagaatgttgagacttaactgcccctcagaagtaatcttacattttcatcaggtacatatatttatgagaggaattactctgacatttttgataagtacccaaccaaaaaatgtaagtaatagtttgtcttagagtcccaaataatgctttgtagtgaatagccctaattgagaactgcagttgaatggatcattatttcatttttagtctgaattgcatgttgctgggagtagaatctgtatttctttgaatttccccatcctatatctcacttggtatttttaaggtcagttaagcacagtaaataatctttgctcagcaagcaacccacatcaccatcttcctgtctgatgtagctaataaattctaagcaaacttcaaactccttgtgaagcttcctaatggatgcctcactggactgaagagcttttggaagcaaaataaaataatcatctaaagttgaatgtttttggatcaaggttactaggtcaacactaaatttgaaaccattttgagagacattttttaatggcacttagaaattatggctaaagatcaggctgttacatgtgatgtagctcaggtcctttgatgctaaaggtctacaactgacttctgtgtaagatgtatttttaaaaacattaactgtgatttaaagtagcaagagacagtgttcaggccagggaaaataaaatctccctctccaggtttttggttgaaatggtttgagttcagtaattttattgaacctgaaaaaatattattaatagctgccttcacaaagggaaatagggaagctggcccctgtcaattcctgcttaggagttgccgagacattttgagattgcaagaaaactgtggatgaaatccataccaattagagatcc

SEQ ID NO: 11223 - DNA, 1038 bp, Homo sapiens
gcagtgtaaacactgtggctaatttgttgaagtgagatgccattgatgattctccctgccttgagagatgacagggctccttcgcagaaaaagctgattgctgtagcagattgctaggggaaggcacattgcaaaaagtgatcaggaaaagacaagacatgttaccaagacagatcatttttcttgaagaggagttaaaaaaagacactaaaaaggaattcctcccataaagtttgtctttcagagagcaaccatttctacaactccgttcctgcctaaagaagcaggctgtaacctggagcaaagcttggagaggctagtacatcagttttacagaagcagttctaagaatagtgaatatggataatacagacagcaacccagacacttgatccatgcgtttgctacgtaaaagttggatgagaataactttcaacaaatttactttccagtgacttgttattttttaaattgtattcttattaataaaaatgatactttgatactgggtatgtaaccaaaggaaaataaatcattctaccaagaagacacatacccttgtatgtttatcactgcactatccacaataacaaagacattggaatcaacccaggtgcccatcaccggtagattggattaagaaaatgtggcacatatacaccatgaaatgctacaaagccatacaaaaagaatgaaatcatgtccttttcagcaacgtggatgcagttggagaccatagtactaagtgaattcacgaaggaatagaaagccaaataccacatgttctcacttacattaggagctaaacattgagaacatatggacataaaatgggagcgatagacactagggactactgggaggggggcatgggttgaaaaactacctatcaggcactatgttcactaccttggtgatgggggctgtactccaaacctcagcatggtgcaatattcacatgtaacaaacctgcatgtgtaccccctgtatctaaaatataaactgaaattagaaaaaaaacagaagccaacaccatga

SEQ ID NO: 11224 - DNA, 1053 bp, Homo sapiens
gctagtgcctagtttaccacctaaagcaaaatttttaaagttgatctattcctaagtaagggttgatttatttttagtgactctagtgacaggcatttgtaaatgacccccctacgccgctcatctttctgaaaattcttcatgtgtatgcatacattattccaatttccaaaacagaagtaggctttcttttttctaaagattccttctccagaatctttcattctttcagacacaattatttcctacaatggtgttataaaaatccctcttgtaataaaaatgaataaatacatttgcccataacatgacttatttttcttcagttttataaattacgcttcatctggagaagagaataccttgcaaaataatgaatgacattgatgaatcgttcatggcatgtgtaaacttaaggtattttcactttcaaatcagaatttgttgagtatgttactattctatataaatatgattttcaaacatttgtttattaagcatatattgtgttctaacaaaacatatatgttcgtcaggattttgcaatgcaaatctttttagaaaaagttatattgttcataacatgtaagataaacataccctgtgagactgaccagaatagatatgagaagtcttctatgagtaacaaagtgagtgttttcctgtaaactgagacccatcacaatgcaaaatacattgcaaagactggtaagtatatgagaagaaagaagcctaaaattagaggagctgcaatgcacactgaaatcctgatggttatatacttaaaatttcttgctgcttggagtttcttgacttacaaagtttatatttggattcagtaattggccttgggacatttgaaaacaaagctgttgatttgaaaattaacagtgtgaaactggacaatgcatgcagaatgttgcaagaccaagtgaatgactactaaattagccatcacttcaatttcaaaccatattcagtagaaaattgatttatataatatgtaaaacaaagacatttataagaacacaatttcctatgcttggaactttt

SEQ ID NO: 11225 - DNA, 1036 bp, Homo sapiens
ttcaaatcccaggtctgccacttacctgctttgtttgtgaccttgagccagttgtatacctaacctatctaagacttagttgttcatctacaaaataagaggaataataatacccactttataaggctgctgtaaggattaacgtaacacatgtgactgacaatcgagtgcctgggatattttaaatgctcaatatttgtgagttaacattacagtcatatagagtttgcgttaattcatgggacctgttggatagtaatgccagatcagggagatactatttggtgagaaatgttgtggcttattttatctctcatctacctgtctgtctatctgcctatccatctatctgtttgtcaactatcatgtaaagctatttgtttttaccaggcagattgaagagaaaaagaggaaagtttcatttggcagtgtagacagtcaatatcactgtaccaagtacccccaccggctgctaactcagataacaaaagtaaaatgtggaacaaggtatcctggttcaagttacctgtatttgtgtgttaatatagccatggatgattcttatacatgaaacaatatgtactaagttttctttatcctaaaaagcaggaacacgtttttatagatgtatgtgatatgtgtgtgtattggtgtgttgttgtgtatgaagattggactagggctgacaaaaacggaaaaactaattgctttataaataatgttaacaactgtgatatcagaaaaatcttctgtgaagtaaagcaatgaaataaactctcaagatagaaatgtattcatgttaagtgtgggattatggttaataaagtacatttttaattaatcattatttctaggcacatatagttttaatcactgggacaaactgatgatttctgcctgcttttttttcctctgctttaggtgaactgattgacaggtgattgtttcaggcaaggaacattaaattaaacatgtagaagtgtgcaaatatttgttattttgaattagaatgcttgtgtattctttttcacattta

SEQ ID NO: 11226 - DNA, 1026 bp, Homo sapiens
gagggcatcctttatacccagtgttgcatatgatgggttctttggctttgctttttcctcttcctcaattctttcttcatgcttcaaattttaaaaagattttttttttctgttatgctggattatatgttcctgtttgccattcctttctcctctagagttctgcatcactttctatttatactttggtattgcctttcttttaatttattcatcttatatttttcctctgctcaacatgtgttgggattagatttcttagcataaggaaatgggatgatctttagatgaaaaacatctcagtgttaaaatgtgaccttaaagtaaggatatttcattcaaccttctgttcattaaattagttctctccaaacctacttatcaagtggtgatcatctagcgtgcttgattacctttaaagttagggaacttgctacctctcaaggctgcctctttcttctaggaaagctctgcacattagaaaattgttccatctgactacctgtaacttccgtccactgtctctaggtcatccttctgggaatatatagagtaattgttttcactttcactcatgatagccctgcaaacggttgagggcaattaacacatactgtttgtatgtatctgtgtttgtatgtaacacatactccagttttctcattttttccccataaaggaacattcttgttattcttttctgaacatgtttgttcgttaatcttttgaaagatgtcacctagaactaaatatcatatttcaagtgtgggttccataaacagtgggtttatcaccttccttgttgtacatatggttccagttatcgattgctgcatagttaaccactctaaaacttaatagtgtaaaaaaactattttattatgcatatggattctttgggtcaaggataggcagggtagagcagaaagtcttgtctctgctccatgatgtctggggcctccactgggaagactcaagcatcaggggatgactttaatacttgggatccagaatctggagctgttt

SEQ ID NO: 11227 - DNA, 1030 bp, Homo sapiens
aatgggcttatactttatagcaagttcaattctttccaacagtgtcattcaccgatttccttgagttagagatatatttttgaaccgactggattcattaggtatatgggttagaagccaaattgttccccttttattcttgtgggatattttgctttgttttaaagttcttgtgcttctaaaacttgttccagtagatattatagattcatgtaagaggcctgggaaaagatacctaccgaggaatcctctgatctgatgtaattgggatccatatgggtaggtgtgggagagaaacttgcatcagtcttgctttcagaggggatgaagcattggccaattcagtgatctaacgagtgtgttaactagatttgcttaagaacacttctattgtttactttaattcccttcatctttttttttttttatccccctagtttgaactggatttcagatctattgtttttatgaggtggtctgattttcatgtgtgtgcgtgtgtgtgtagaagaggctagaggtaaattgggtctctttttttcctggctttttatagttaagagctcaggctctggattcagatggcttgggttcaaattctggtccgtcacttagctaactggagtcttaagaaaatcacatgacctttaaaggtccagtttcctcatctgcaaaaggtatatttctcatagagttgtaaggattaaatgagataatgcatgcaaagggcttaataaagagcatggcacataggtagtgctcagtaaatgttggaaattatgattaatttcactgtacactttcattttgacattagctgtaggctaaaccttaattacttacagccaccagtagttacacatagaatgaagtaacagagttatatgtcagactaaccaagtacccttgacagtatcattatgtcctcaatatatttatgctgaatattaatcaagtttaagaactgcttataaataatactaaagaacattttaattctctttgctattaaggaggagttttacattgc

SEQ ID NO: 11228 - DNA, 1054 bp, Homo sapiens
acagagatgtgctgattctcagaacttctatagaattccattagccagtcctgccaattgaaatttggcatttaattatttgcatttttctattcttgcctaggaaaggagctcgtcacatacctagtttagtgatggaaagtatttggagaaagttttagagagtggggctcaggctcaagaatacaatgaagtaataaagttgttaacctcatgtataaaatcctccatccagatgttgcttagtgatgcagctagtgcttctggaggaaaagaagcaagaaccaaataatgaagactacatcaatgggaacaagtgatacttttaggtgttttgttctcagaatattttaaaagaaaggaaattaacaacagaagaaaaatatttccctatatgaattaatggtttttataagaaaaatatctttctggagatactaagattgacctagaaattgatccaaggaccagatgcttaaagttcacttcaattggtcactagaaagatcccagcaatccccagctggtttctcaggctgctgattccctttatttggtaatggggtgtgtgcagtacgttgattaaaaaatatgcatttccattccattgcttttgaaggggggcagttgtctttctcttattaaagagcttgtgatacacaggaaagtgatgtaattttatatattagtcaaacgtgaggattttagataagacagcaagggtttttttcccctagtttgtagaaatctagaaatttaagtgatgatttgaggatcgagaagggagaactgaatcaaaataaaatctactacacacattctttggttttggaattctttggctttattctaaagatcccaagcattaatgcattgaagaacccggaaatctgattttgaagctaaaacattaagttttacatgtccattactgtttccctccagagaggtttgctacttacacacacacacacacacacacacacacacacaagcacacacacacacacaaaacaaaaacttttagctgtttgtaatttaagactttccttgt

SEQ ID NO: 11229 - DNA, 1049 bp, Homo sapiens
gacaggaacattctgtccataactaatggctgtcaagcatttatggttgtaaaacacaaaaacctttattgctccagccagctctatcatccagggactgattattgagtttgtgatgatccagcctcttgtccccttctttgctttgttttctctcctcccccctgctgcctgccctttggccatttcactgctcattagcgcctccaccagatggggggcagggtcaggaacagggggtcagctctggtaaaaggcttggtaagaaggaggctgagagtaacagccaacataaggttttcagattatctacatccaggctcgcccccaaccctgtcctcaggaatcactgaatgcagccatgacactgaaatttgtttttcattcattattttttcattcttacaataaacgtggttttataagttagttaaaaagtctttttcaggatgccgtagtaaacaagagtcccttttgagcatttccttagtaaacgatgaatggctgctggtcaagcttgttctggcaagtctttagcctctgttcagattcagaagaatggcatcaaatctatgcttacattagactcaggttgtggaatgtagttctttcaattcaggtttagtgaatttgtcttatgatgctgaaagagtcctgtttgggtgttaagaggccacagagctaaccctaactatatgaccagggaaagcccgtgttatcacattgtactgtaatttcagtgcattaactcagaaaatgcacctcgagtgcctgtttaaacgtgatgttgtgcagaaggaacagcatgtacaggacagagatagagacggaggctactgaaacactttttttgttgttgttgttcacctatttggttgcttgtctctttcttggctggatcatttaaaccctagagttccagttctgagaccctttgattttgtgattttcccatttgtctaaacattttgccaaagccttctgacacgattataaatcaagtctgtgctgggtcctagggatgtcaaggctgacaagataggtggggc

SEQ ID NO: 11230 - DNA, 1031 bp, Homo sapiens
aaacaaatatattacaataaacatttagagaagctgacattttatatccataaggcaaacacaaaatttcccaatttgtatgaaaatttgggtgttttatcctgtgcttttatttatttttttatttttgagtctgagatatttttgtgtccaagaaaatgtttagattaattcacttgcagtcttgaagttatctttggtagaaaaacatccttatgtgtatgaaaaaagcaatttagaaaggagatttcatgagcatccttgacagtggtgtacaagtttaatcgtctttcctgtgacaggagggtcttcatgtattcaacctagaatttctccttttacggttcttagtccatttcctcttgtcttgttcttaatggtgacagagaacatctgctatgttcctcttcaaaatatatcttcctacttggggtactgtaaagtgtacgtactttgggtcttaacatatctgcatttgagtctgaaccttatcacttactaaccttaggcctttgttacctctctgagactaaatttcttcttttgtgaaatgaggctggtaatatctccattgtagtttcagctaaagtatccagtacctagtaaatgctcaaaataccattattttggcctggcacagtggctcaggcctgtaattccagcactttcggaggccgaggcaggtcaatcacttgaggtcaggagttcgagaccagcctggccaacaaggtgaaaccccatctctactaaaaatacaaaaaattagccgggtgtggtggcgcatgcctgtaatcctagctacttgggaggctgaagccggagaatcacttgaacctgggaggcagaggttgcagtgagctgagattgcaccatggcactccagcctgggtgacaagagcgaaactccatctcaaaaacaaaaacaaaaaccaagaaattagacagctgtggtggcgggcacctgtaattccagcgagcagcttgaactcaggaggcggagtttggagtgagccaagatcatgccactgcct

SEQ ID NO: 11231 - DNA, 1037 bp, Homo sapiens
cctgtttgctgcatctctcagctgacttttgtcccttcctgctcacttagtcaattcagagattacagtttgtacaataatgcgctgccttgtcttctcgctggtgaatctggaccggagtgctctgcctctgcgccgacactcactctgatggtcttggctggaggacagaggctgctggcaaaaacctaagagggaacataccgtggtagcagcatgaaagaatttggcaaggaggtgctcgtcacatgattgtgattcatactgtactctcaaaatgtggcaggagggctaggagagacttttaatgccagcacacagagcagagacactcattttcaaacatcacattctttttatagtacaggcatgcctcacagggaaaatattgaacttggcctgccagcaccacgagagtcgtcccaactgtgattttattgcttgagtcactccctgaatcagatactggctgcacggaggaagtcttctattagggatgctttgaaattgtgtttttaattaattaacaccaactctggacaggtttttcatttactcctagctgactcttttttgtcttttctttttttgcctgaaacttgttagacatttttgtaaggtctcagttggatcgcttttaagtatcctggtgaaagagtcatctgtgttgggtgaccaaagcgaggggacccttcaaagtagagtttgtcatctccgagagaatctgatccatgggaatggggtcgtcaggaaaacggtccctaaaagtctggcatagcactttttgatgccttcagccgtcctcaatccattcatcctgttgttaaaacttaaaactagagctggccagctgttgagaaaagtcctcagttttatttcaaccaaatgatgctgcctcctggggctggaagggggctgacttcaagcacaattataaatgtgtagctctttcaagcggcggaaacctacaaaatggccttgattcacagggcccctctggctcaaagactctctgcttcccgtgtgtcataaatctg

SEQ ID NO: 11232 - DNA, 1064 bp, Homo sapiens
aacaaagaagggcttgtgctcccaggaattttctgcattcctctctggagtaggcatttttctcagctacaaaggccctttggcgaattccctctaatcattggatttgccctgggctctgataggtgccattcatggacttggtctgctgtttgatggggctgaggcattaatgggatcttttcatgataaacaaaactgggtaacattaccagagggatcacaaagctgctgttgtagggggagtgtggtgctttctctctctttctctttctctctctctgctttttccttcttcctcctcttctccctgttctttttatgaacgcacatttgtgtgcgtgtgcagcatggccatttctagaagcagatcttctgacctttgctgctactcgtaagtcaatggccaatggcaaggcctttgttgaacataagatgattctatatactgatctgatctacagtagcttcacagcctgcggggaggtctgtgttttcttaattgattaaacgttggaagaatactgcatgaagaatctgattttgagatctttcttacatgctggcatttaattactgaaagtatctggtagttgagatgaatgagtctgggggaataaatacttaacacaagaattcaacttcatgtggctgctgtggtggtatatccctggctgtgttatcaatgccagactgaatggggtaactcgtcactgttgttgtatcctatttgcttctcaaaagaatgcaaaaatggttagttgaaacctgattcctgcaatagtgaagaagtgaaattagaattattttaggtgatgaacactatttttttaaagtttttatttttgtgggtatgtaggtgtgcatatttgtggtgtatgtgagagattttgatgcgggcatacaatgcttaataatcacatcagggtaaatgaggtattcatcacctcaagcatttatcctttgtgttgcaaacaattcagttacactcttagttattttttaatgtacacttaaattattattgaccatagtcaccctgtggcataacactgtttttttga

SEQ ID NO: 11233 - DNA, 1032 bp, Homo sapiens
tatttcattgtctcttggtttagaatgtgtttatatacacataaatatattctccaccaaatatacaatttggaactaatggctttgctgattgaaaagactgaaacttgtgtcacttcactaaagcatttcctaaaaacaaatgccataaagttaaatgtatatatggccaatgtatgctagaaaataaagggacatgtaggattttaaatcaattgatttttcagccatcagtttgagtaacataaattgcagactattaggaaactttggagaaatgcataggctcacagtaaaaggatctgagtggggaaaaaattaccttctagggaaagccaaaaagactgtagtcacaagagcagaatgaacatactgagacatcgccggggaggtgggggcagagcaagggtctctggtaaacaggagccactgtgagaaggatccaaggtaaaaggttcgagaaatcacagtgagtatttttttttaggttaaatgttagcaaaatgcttctgacaggcgtgtcaaacactgtatccgtggacctacagaggctgtttgtgttccaagagtagtgcttcttcattctgaggaagaatagggatttgatcacagaatttctgaactcagagttatgccacgtcttttggctttttgattggtgagaagtaaggcttctgtgaataactagcagataacagataacatccatttttgttgctggaatgaaataagacccaacactggcaaatttacattcatgataacggcctagagccacttgatttcctagtggagataaagaggtaatgttttatttgggggaagtggggttatatttgtcagtatatagtagtaaataacaaaaccaaacacatcgcgtagcgatccatgagcagtaatgataatatcttgaatttgtacagtaatttgtaaagcactagttaatcagagagaactttaaatcattagcttcattttccagaggccctgggccagggacgtctgacagatctgttcaacgtcatagaatta

SEQ ID NO: 11234 - DNA, 1059 bp, Homo sapiens
aatagaaagaggaagctggtgaaggtagactttggcagctggggcagcggcacttgggccgcttatgtgaggtagcccgcagaggcacctttgggtggagagagaataaaatctggttttgacacgtttgttttagatggcaatgaaatgtctagcctatatattttgtagacactgagaaataagggactgaaaagaggaagaggtgtcagggctgaagatggaaatctggggctcatctgagtataggtggtaattgaatccttatggctgcactaagggaataagtagagaaggaaaagatgggctaggagcccctggctgaaccccaggggcactaagtggtaatgcatggagggagggggagaagttaaaagaaggaagaaaaagcagacagaaatatctgaggagtcccagggcctaaggtccctgccactgaggccgtgagaatgttgagaaggcagcacagatccctggaacgggattgccgctaagaagttaagtaagaagccatggtgtttgacagcttccataaaagcaaatgacaaaagctaggactgcagagaggtgaaaccagggcctaatctggatctggtctggattgtttcctccatgctctctagcacagagctttataagacagtgttggtttaacgaatgagggagggaatgagggaatgactgaatcaagcaagtaagcagatatagaaacatgggcgttttcataaagcagagtactcaacagtgcctgtgagcatcactgacaggccaaacacataaaacaggcagaagggagaaaaggaattgagaaaaagaaggacaaggaagagacagaagggggaaggaaagagcagtaagaactgaaaaaggctggagtttcctggagtgtgcagttgtggagccctagatctgtgggtttggcccttactttgctcgtatctctagttgtttctttgacattcatcttgtgtctgtgatgaaactttaagtttcttagtaaagacaagaactactattgtgtatctctttagtacctaatacaattctacaagcatttac

SEQ ID NO: 11235 - DNA, 1012 bp, Homo sapiens
agttaacttcagcgggagtgaacgacaggggtgggctccactttatccagtgcactcggaagccggagggcccccaccaaaaagagcaaggggaaccctcgccctcaacaaggcctgcatctccggactggagctcaagtatagcccagcgagtgtcaagaaacgaaattctccaagggtggcggaatcaagccccaagtcccatgtgtcactggaccggtgaggaaccgaactcacctgagaaacgaacacccacacctcacgctcacgccgaccggaagtctttgcacttccgtcttccgggcggaggccacccggggcggacgcattgcacgccgggagacaaaatgtctcaagaagccttgagaggcgggattttggaacccgggcgctgacgagcttccgccattggtgtgatcgcggacctagaaacttggtccgtcccatacaggtgtagaagtcggatttggagaatgctgacgggtgtccggtcaaggttaggccccaggtaggtccgctttccggacgtgggcagggtagccccgagactaacctatggagtgaacctggccaggggaccctacttgtcagatagggagctccgagccgacctttagatctgacctcagcgtttacatgatactcatgtatttccttagatcaagtcagcctagatcaggtgttcttccagaggccgtattgagatcatttttatttgcagcctgtgcattttctcatctcgggtgatggcctcacagatgtacacatatgtaaaaccgtatcaaactgcacactttaaatatgtgcaacttattgcatgtcagttatactcaaagcggttaccaaaaacagaaaacaagcttttcctaccccagagaagaatttaaagggtaaaatgatcaaaggatttcagttctatcaatgtttacctgtctgatcacttacgtatcagacacaatgctaagcctaggacgattgtcttagctcacgaataacacttactgtacaacta

SEQ ID NO: 11236 - DNA, 1037 bp, Homo sapiens
tgtaaagagttggagaggttcctctagccctagccctgacctgccattttttagataaagaaacatggtagttggaagatttctgaagaaggtaatcattgaattggactccaaggaacatggagactcaggtgaggagaaggacattggacttaggggaaaggcctttgcaaaggcatcgaggaatatgatcgtagtgtgcctggaggattttgaggtgacttcattgactggaatgaagcctgtgtctgacagaatagtggaaattaaacttgggttagacagtgaattcgagctttaaagttagtaaagtattttgacttatctcattacatccttgataaagtgatgttatctccacatttacagaaacgccagttgaagtgtggggatgttaaacattttgcctaagatctcagttaggtgtagaactgggacttgaaatggagatttctggccttccagcttgttgttctttccatggtgtcattatttcctcatttattacagatgctgtacactaacaatgaaactcgaacttgatctcttagggagccatttaggttcctaagcaagagagtgaaagaagttttaaggaagatcatatagagtcatagagccatgagccacttatcatatcttgcctgttacctttatttatcacatgaatgaatggagacctagagatgttcagtgtagtttatcagtggaagagttttctgatcagtttatgatcttttttttgtactatgccttcatgtctgattaatctgaaggattgaattagaaggggacacccgaaagggatcattaccaagttttatctgatgtgtcagctctgattagttggtagtatcttaatatctgcttgggatgctgagtgagagaatatttctgaagctatgtttaggctcaggagagagtgcaagagcacggaaagagcactggagtgccatttatcatccttggactagggttgccagatttatcagataaaaatatgaataattttttagtataagtttgtatcaaataat

SEQ ID NO: 11237 - DNA, 1035 bp, Homo sapiens
agtacatagttacttctaaatgccagacccagagctgggtgctagagataccacagtgagcaaagcagatgtgatcctacaaggagctgatagccaattgctttggttgctgaagcctttcaagggttggggaaggtgcatgatttctttttctgaagcagagggaatacaagtacgtagggtagactaactacatttttacaaaattaactttgttattttaattgttctaacaggtgggagaatctccacaagtgtcttccagacttcagaatttgagactgaataatttaattcccaggcaacttttcaagcccaccgataatcaagaaacttagttttatttcaaattgttccgagtaactatgtttttctattggagacaaaatgaacatcgtaacgtcaaagtaccaagataaaaaaagtttcctataactggagttttaaggtatttgtgttagcaaatgttttaaatccatttcatcaaagtattaatgatttcaacacgtcatcatgagaactggtagcactggacataagtgaagagattagatattttatatacatatatatttttatacaattatgtacattaagccaggcacggtggctcatgcctgtaatcccagcactttgggaggctgaggcaggtggatcaccagaggccaggagtttgagaccagcctgaccaacatggtgaaaccccatctctactaaaaatgcaaaaattatatgggtgtggtagcacatgcctgtaatctcagctactcaggaggctgaggcaggagaatcgcttgaacccgggaggcggaggttgcagtgagctgagattgcaccattgcactccatcctgggtggcagagcgagactccgtctccaaaaaaaaaacaaacaaacaaacaaacaaaaaaaaacaaacaattatgtacattaaaacattgtatttttaggataatgcctcgtaactttgatgatcgttgtgtgttacctttgccaatgggttgaagcagtggcaaagaaaaggtgtaattacat

SEQ ID NO: 11238 - DNA, 1027 bp, Homo sapiens
aattggtattaactcttctttaaattaatctggccctgggcttttctttgtggggagtttttgttttgttttgtttttgttttttgagatggagtttcgctcttgttgtccaggctggagtgcaatggcacgatctcggctcaccccaacctccacctcccaggttcaagcgattctcctgcctcagcctcccaagtagctgggattatatgcatgtgctaccatgcccagctaattttgtatttttaatagagacagggtttctccacgttggtcaggctggtctcaaactcccaaactcaagtgatccacctgcctcagcctcccaaagtgctgggattacaagcatgagccactgcacccggcatgggaagttttaaagctactgattaaatttctttacttgttataggtgtatttagcttttctatttcttcttgagtcagttttgacagtttttctctagaaatttgctcatttaatctatattttttaattttctgacatacagttgatcatagtattcctttatggttttttaaatttctgtaaggctggtagtaaagcctctgtttcattcctgattttagtaatttgagtctctttttttcttggtttagctaaaagtttatgaattttaatctttttaaaggaccaacttttggtttcattgattttctttactgtcttcctattctctatttcattaattttaactcttgtcctattacttttaggagggcctcttaaggaggggtcgtatgctgacttaaattgagggttggtcaaagttcaaaagcctgggggaaggaagcttaatattttctctagatcagtaagtacaagcaattcagctaagaatttgcttcatttatgaagcaaagaatggtaattttcaggacagtctgtgtctgattttgttataagtaaatgggggaagggagataaacatctgtgagtcttatctaagtcacccggggaaggatggttctttataataagccatttcctggaacacgcaggcgat

SEQ ID NO: 11239 - DNA, 1041 bp, Homo sapiens
tcaggtagcgcgaaggggctaaaccacccaccattgtggagaagggagttgctctaggccgggagaccgggcgccgggcctattcgcttgccatcctgcggcgctaggccgccttgctcgctggggcccaagctgctgcccactcggggacccggcagcctcctctctgcccgcaggtgcgcgtgggccttgctgcattcaggtggaatgatgaacttttgcgctcttggctgatacatagttcttttgtggattattaattttcgtgaaggtgggaagaagggggaggggagccaggatggaggaaacttcgctcatagggttttcccgccagcatcactgtcagttcctcttgtcaggtaaaaccaacttaggaactcggggtttcagtctcatgtcctcatatccaaaatcactgccaaaggggtggattgctggatcttaatcatagcagacggatcttcaaaaggaagagatgtttaatacggacctggtgaatatgaagctttattacagcagttctgttcaggagatcggtactgttggttccaaagtgttgtaatatgcatagtgaagatttgttatatttttacaggttatctttgtttttatttttccttgcacgcttcggtgattgttgcattctttcccgcctcccatctcttcacaaataagttctcaatctaaaaaaaaaaaaaaaaagaaaaaaaaatcgcttatttccttatacctgttttgttctctaatgcttagtggttgtaatttgggtgcattttaaaggaaataacaaatagtcttcaactaaaattgtgactaaagagcttgtttgttttgtatgaacaatatgttttaacacttgaaaatgtgtccaaaccgtgtggactgggaagaacttttcggatttgtgaaaggagaaccatgaaaaagtagtaattgtgttcctgattaaattgatatactggcttattaaaataatcaatgaccacaaaaccacgtattactttaaaaaatatttctacctaggcagctcttaaatgtatt

SEQ ID NO: 11240 - DNA, 1632 bp, Homo sapiens
aggcatgagccaccattcctggcacagaaaatcatttagagattttggaaggagaaagtgacaagatgattgtgtagttttggttgttgttgtttgtgtttggttttggttttgagacaggttttggcccaggctggagtgcattggcatgatcatggctcattgcagcctcaatttaccaggctcaggtgatcctcccacttcagcctcctgagcagctgggactacaggcatgcaccaccacacgcagctaatttttgtgttttttgtagagatgaggttttgccatgttgcccaggctggtctcgaactcctggggtcaagtgatctgcctgcctcagcctcccaaagtgccgggattacaggtgtgagccttcacacccagacttgtggtttttgtttttgttttttaatattttcccaagccaatcaattagatatcctataattggggatttaggtctagattcccggagtcagtttggcaatgtaaatttcagtgctgcattcacttagctcaggtttcagttgcattggtagataaagtgataatttaatttttctttcactatgaattagtctcaactaaatttgtgttctgaatatttgcattgaggtcagaggccagacatttagtagtggccaggcatcttgaattcatttgttgttttctttctttttttattttattttaaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtaagaaatctttaaaagttttacagttttctttaattaaaaaaattaatgcatgtttttaaagaaccattatgcttttcttaggtgaataccttgagaagataattcctttggtggtaaaattttgcaatgtagatgatgatgaattaagagagtactgtattcaagcctttgaatcatttgtaagaaggtaagtttttaagatctctattttttacaaaaagtttttccttaagagtagaatcataaggtctacattaggtgtgtgaggagaagcggccttttggatttcagatataacagacaatacagtatttgaaactaatgtcatcttgctattataaaatgtggtcatcacatttattttgaaaattttccttgtcattgttaggactttatttaaagaattttggaaaggtatttataattattttgggtttactttagaagggaagaaatgccagtgtaataatgtagtctgtactgaaagcccagcaggataaattattcgtcagaaataagtagtgaattgccttttcaacaatttcttaggtcacatccattttgctaggtcagtgattctcaatttggaaactgattctaatatattttttaaaagcttagtaaaagttgtgtatttgtgtactagaaggcaatacaagataagtaacattatttt

SEQ ID NO: 11241 - DNA, 1154 bp, Homo sapiens
cagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtat

SEQ ID NO: 11242 - DNA, 1052 bp, Homo sapiens
ttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctctaggactgaacaggagactgacatgcatatgttgtgtgaatgtcttagttgggtaaagttaaatccaaatacttcaactggctttttcttcagtttgtttgtttttaactttcaagatgcatgttttgttttgttttgctttgtttttgtctcttaagccaattcatttttctaacagttgaaattcttttagtactaaagaaatagatactgctcttttatggctttagtgtttatatacctgtttatatgcatacattaacaaaattagtaacagcagtgcttagaatttcaatgctgtgtcatactgatgattaactccatactcctagtggtgatgtggtccagatactggaatggaagtggcaggatgtggagtccagacatagtctaccactcatgctacttactagtaatattaaggtgttaaacttaggaatttgtcacatgtaggttcctgaggagatctaaaagttaatacaaaaccaagctgtttactgattttcatgagaacatttaagttagtttaggtctacctgatttattttaaaagaaggcagagggctggacgcagtggcttacgcctgtaatcccagcactttgggaggccgaggcgggcggatcac

SEQ ID NO: 11243 - DNA, 1028 bp, Homo sapiens
acttcaccagagccttcagtctgacagacagagctacatagagtcttagcagagtagctgctcaggcatgggtggagacccagaagccttagaaaatcaagctttccagcaaagtaaccgcaactcctgcaaagcgggagattagacccccgtatatacccgtaggaaagtggctgaatccaagaggctgcgcagtgacagtctgcaggccccacttccacagcatctcataggagaagacccacgggcttggaaatccagccagcccctggtagccgccttgcgcctccctgaaatggagctccctgggggaggggtgagccgccatctccgctgctgtttgggcaatttagccacgccagccttcaggctttggaaagtccaagccgactgggggtgggagggatttcccagtacagcacagctgcgctacaaaaatatggccagactgcttctttaagcaggtaccccaatcccattccttctcactgactggggcctccagccacccctgccagtgttctccagctgacagatacttgaattctccctgggagagagctcccagagggaggggcaggctgccatcattgctgtttgggcgacttagctgttccagcctttgggttttggagagtctgagccaaccggaggtggaaagggtaccccagcacagcacagctgatccaccaaaatgtgaccagactgcttcaagtaggtccctgatcctattcctcctcactgggtgggacctcctaaccagggtctccagccacctcctacaggtgtgtttgggccggcaacaggtccatacctccctggaacaaagctcccagagggaagggcaggttacccatctttgatgtttcacagtctgcactggaccaggtactagaaaatctgcagcaaccagggactagagtgggtccccagcacagtgcaacagcctgacagaaaagtggccagattgttacacgggtgccatttccatatctcttgaggtaggtcctcaaggcctggacctctag

SEQ ID NO: 11244 - DNA, 1034 bp, Homo sapiens
aagtttttatattaagactaaaatgaatgaagggaagaagggagggagggggagagggaggcaactagattcgtgagaaagaaaaacagactaggaggtcagcaaaggctgctgtggcctagtggctgaatgtggtgttctgaaggaggaaggagctcaagagcaagcaaggcaaactccctctccccctccctgcctttcttcttcccttcctttcatagaaattaaacttttactctctaagatggtatatttggatttggcatatttgagtttaccaaaacaaaaaaaaaattataaaaagtgaaagaggaggagaaggaggagatcaatccctgcctttgaggacattatgtttaattaggaagacaagattggacagaaaatattaagtttagaacattgaaagatgaaattcagaataagtgcaggtcatttgtgttgctcttggataataatagctttcagaaggtgggtctccagccaggacttgatggaattcagattgagagagagaaaaaggatattctaggagaagcaaattgctttaactgagggatgtcatgaatcattcattcgtatgtcatccagtatttactgagcacctacgtgtataatttttggcataatgcaaaggatgggcaaagagactgggtttgtggcagtgtgaagaagggagaataatttcttcggaaggtaggccttgtcctgtggtttttctcaaatgtgccatgttgttgtagccacaacacatgtgctgtctctgtctagagtgcatttgccaatctctgcctcatcctgtgagattcagcccagaccagatgtcactgcccctacaaagtcctctttaagctgaggttgagcaagatcacccttaccaaaaggtaacactggcaatctctctgctaactgcaaggtgagtagaactgagttgagaaggcagcagaatcctctcccctgtttccctccatccttcccattgggcacacactggcaaaaaaaaaaaaaagaaaagaaaaacaaaaagcaagtga

SEQ ID NO: 11245 - DNA, 1043 bp, Homo sapiens
tgagaaagaataacagactgggaagtcagcaaaggccgctctggcatagtggcgtggatgtggtgttctgaaggaggaaggagctgaagagcaggccagagcacggggtggaggcttgccaagtctggagtttggtgagccaggggaaagctcgtgcaggataaggagggacagaaatgcaatgccggaccttggagaaggccacacagaccatttggaggagctgggaatttattctgattacaccaggaagccattgatgcatgtacaataaattaaaaaaaaaacaaaaaaaaaatcattctggtttcctatggagaaaaactggaggggagccatatggagatggtgccactctatgagacagaggacttctaaccatctgggaggagttgagagagatcatttgatggaagaatggtcctccaccagaagttctgtttaagaagtgaagtgaggtggggataaggctacgcaggattctgaggataccatttgtgttgctatttttgtaattgaaataatgtaggctgaaaaaaagtgtttttacagcgtgactacgtaaaaattacagatgcaatgtaattaatctataaaggacatttaaaaccagtaagaaaaatgctaatattccagtggaaaaaagagacaataataccttcaaaaaatttacatgagcaacataaatggaccaaaaaaattataaattataaatcaaagtaataaaaattaaagccatgagtttatttttaacccacaaaatatcaacaattaattaaacaaccatttttattgctagcaagggtgtggagtgatataaagcactcgtttgatgctgctggggcataattagcagagcctttctggagggcacttggtaatctgtaccaagagctttagaaatgctcattcatttttacctgttgattctacttccagaaattggtatcagaatccatgatgtaaacaaagagttatgtacaagaataatcatatctactagcacaaacttagaaaaaaaccttgtatctattaacagaggt

SEQ ID NO: 11246 - DNA, 1063 bp, Homo sapiens
gatggaaatctggtttttgttttgctttttccagtttttggctattacaaatagaactgctgtgatccttcatgtacaagtcttggtatgggctgggatttcatttctttgggataaatacttagaagtggaatggctggattatatgataggcatatgtttaaatttttaagaaactgtcaaactgttttccaaagtgttttacagtatatgagaattccagtttctccacatccttatcttggcagtcaactctatcagccattctgacagctatgttgtggtatcttattgcagtcttattttacatttccttggtgactatttatattgactatcttctcatgtttttgtttgtcatctgtatatctttatggaaaagtatctgttcagatattttggtcgtttaaaaaattgtttttttttctttttattgagatttcagttttctttatgtattttggatacaaagctttcattaaagatatgatttacaaatgttttcttccaatctgtagcttgactttttattcttttaacagtgccttctgaagaatagaaattttttattttggtgaggctcaatctttaccttttttcctttcatggattatgcttgggtgttatgtttaccaaatatttgcataacctatgatcacaaagattttctattgggtttagtgttaggttttgtattgaagtctgtgatcagtttaaagctaatccttgtgtgtggttgaaacaaaattaattttttttgcatacatgtattcaattgttccaatgccatttgttgaatctctcctttcttcaccaaattgcctttgtacttttgccaaacatcagttgctgaaatatgtgttggtctatttatggactctattttgttccattgatatatttgtttatcttgattctaatatcagactgtattgattagtcttataataagccttgaaagtacacagttagttctccaactttgcttttctttgtcaaaattgttttggctctttttttttttttttttttttttttgagatggagtcttgctctgtttccc

SEQ ID NO: 11247 - DNA, 1106 bp, Homo sapiens
acatttaatctcaaacatattttttcatttctagaagtttgatgtatacattttaaatatcttttagtgtctctacttaagtttttgaacatatatagctgtaatagctgttttaatatccttgtttgttaattttaacatctgcctcaggtttggtttggtttcagttgattgttttcccttcattatggtcatgttttactgcttctttgccttcctggtcatttttttattgtatgccagacattgtatatttttttcctattgagtgttgaatttttttatttctataaatattcttgagcagttgagttgtttggaaacagtttgtgtttggggatcaaacctttatgatttgttaatcaggaccagagaagtgtttagtttagggctaattatgctccactactgaggcaagatttctttgagtactctaccaagtgattcatgaattaggagattttctagtctggctgatgaaagtaagcccttttccagtcatgtgtaagaacttgatactgttccccttaatcctgtgggatggttcttttccttatctgcggttgtttcctcttatgcatgtgataatcagtagtgtgatgaatacttgagaggatccctttacagaacttgccatcatatttttcatagagaatatcttgcattagctgattgaaatatttattcttgattggtacttggcagtcctgtttactacctgtcctgtatatggaatatcactgccaactttagcggggggggatgggactgggtgggcagttcctgcaaaaacttcaaatgactaattagaaatgtcagtggcattttctccctcagaaacatcgctgtttaggatcgtgaattttcttttactcatatttgattcgattatctttctttcaaagaatttttctagaatgaatattttacttgtatattaggaatagtttttaaataatcagaacacaactgctctcctcaattatcatcattctcattactcattccatttctctggctggcagcctatggaccactggaaggcccggccaggggtgtggtcatcaggacttcccaaaagcacatctccttcctctgtggcttga

SEQ ID NO: 11248 - DNA, 1033 bp, Homo sapiens
gcttgagcctgacagcgaaaaagtttgcctgaaacggggcttgcttgctccatttgttgcgggaagtggcaggaggaaggcagcggagagagccccacttagtctggcagcagccaccgtgtagagaaaaactgttaaaggggcctttcccttcgtcagcaagaggaaatctctttctcttagagggagagaaaatccaggaagtttgtcctcttctctttttcgccatctcgaggtgtctaatcctaaaactatcagcgccatgaattttatttaaaactacgcccagtgaaccgggctctccggatttttcttctgaaaaacactgatgtcttttggagaaaagatcatttttgcaagttaaagcagatggtttccttccccttcgctttcccccctctcccactctctttaatagtttagaaaaacattttggccctgtaacttctgattggtatgaatagaagcagttctgtgttgcagtaaggggaaatcacatttttacggggtagaaagttgacactaaatgaagattgtgattttagtattttaaaattaattccgtctaattggattttggttttgcaggcagcatctcatatatgtcgagtacttaacaatttaaagctctgacttgtaaatttatttttcagctctcttttttcgtaattagaatactgtttggacttgctcaacaagaccttatcttaacaaaaagtaacttatagaaaagggagacattcatttaacttcaagcccatattattcttaaaagctgactcttgaaatagtatttattgagtcatagtggagtcatgggactttttaagggccggaagggactatttagatcatccagtcccaccctgtcattttatggaggaggaaactgaggcctagataagataaccagttagtgggtccactgacctttaggacagtagtctatccgtaagagacaacatggagaaagaaatacaacgtttttatagtgaattatcatcttacaaagaatattcttcccatatcgcac

SEQ ID NO: 11249 - DNA, 1047 bp, Homo sapiens
ccagggcgggcggatcacttgaggccagaagttcgagaccagtctggccaacatggtgaaaccccatctttactaaaaatatgaaaattagccaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtaagtatctgaagaggctacttagaaactcagaattggttacaggaagtgactgcccactttccatgtgttcttcagatgctctggttattctaacagcctagttaaccacccagactttggttctcattgcctttatccatttgtttggtgtatatactaatgttcaacgatgcacacataatgcatgtgatgttttttggataccgtcttatcacttgtagaattgccatgataggcattttttggagctactttaagtacttgctggcctagtaattatgcaagtaagtaattaagtgtttattcatatgtgaaagcccaatgtaagcattatttatgtctttcagtgaagtgtggtgtgcctttcatttttctgagtggtctttattttatggaatattaaatggatctttgaataaactcaagagggtagattataaaaggaagaactgttaaattagtcaaaaacaactttataacacaattagctgcataagccagtgcgtgcgtaagcaggtagtataaatgcttaggttgagatactaaaattattattagagaaaattacaggaagtacctatgctcccactatgttttgttacttggttaatttttctcctctgaacttctggcaggtttactggggaattttccattaggaatattctggtccttaagtttcattttgaatgtataatataatcatgcagattacgaacccacaatctaaaatcaaggcattctttttta

SEQ ID NO: 11250 - DNA, 1056 bp, Homo sapiens
tatgtactgggggcttaccttcttgctgtaggttccctttatatatactgttttatcatcctcatgaatgatcttaaacaactcaatctgttaactaagtgaataatgtacctgtcacatagaggtattgaatgaatgttataaatatgatagctatctatgccagaaatcgttggttttggtagacagacttcagcattcagcacgatcattctcagtaattctttataggtgttttgatttgttttgagggggttgtttggcatatattttgcaactaattaattcatttttgtaaaaccatcagacaacagtgctagatgtttaaaatattctacagcagaaattttcaaatgtttttggaatcattaatacaaccctgtctctccttcacttaaaccacagtagccattggtaattgagaactagattctttccctttgagtcctagttgatctcaaaaatcattctcaacactgcacttagctacaggtagctgttaatattttgagttgatgactaagctgaaacccatttgccacctgtgagttaatgggcaaggtctatccttgtctcttccaggctctagcctatagtgcaagtgttggcaaactttttctgtaaaggacctgataactattttaagccttgttaaccatacagtctcttatcacaaccattcacctctgctattgtagcctgaagccagctgtggacaagacacaacaaatgaactatgttccattaaaactttatgagtgtgactgtgttccaacaaaattttatttaccaaaaaaaacaaaaacaaaaaaacagggagcaaatgggatttggcctgggagttctagttggccaacctcccctctagggcaagaaactggttttgattcattcaacaaataattaggtgtcttccatattccaggcactgtgttaagttttgattatatagcaataatcattacacgtaggccccaggtcatgaggtatttaacccttaactgagtatggttttggggctttttgcttttttggttttggggtcttttttgtttt

SEQ ID NO: 11251 - DNA, 1036 bp, Homo sapiens
agtgcagtgggagaagtaatgttacctgacttcaggaaccagtatttaaggcctctttttttgagacagagtcactctgtcacccaggctggagtgcagtggtgcgatctcggctcactgcaacctccgcctcctgggtacaagcaattctcctgccttagcctccctaatagctgggattacaggcgcccgccacctcacccagccaatttttgtattttggtagagacggggtttcaccatattggccaggctggtctcgaactcctgacctcaagcaatccacccgcctcggcctcccaaagtgctgggattacaggcatgagccagcgtgcctggcctacttaggcctgtttttataatttagggtcacagaatttcaaactggggttagggggtgagtgtagtagttaaacaacttgagattggagaactgcttttgcaaaatttccattttggttatacccatgaaattttttttttgttacgaagtcttgctctgtagcccaggcttgagtgcagtggcaaaatctctacttactgcaaattccgcctcctggattcaagcgattctcctgcctcagcttcctgagtatctgggactacaagcgcccgccaccacattcgagtattttttttttttgtatttttagtagagatggggcttcaccatattggccaggctggtcgcaaactcctgacctcaagtgatctgcccgccttggcctcccaaagtcctggtattacaggcatgagccatgacagtcagctattttttttggcatattttaagggacagaaattatgctttttaaatgttgcttattgcttttcaaggatttgattcttataagctacttcttcatttattaatgagatttaagaaagaaatcaggttacaaagttatgagcaattgtctctggaacccagaagttggttttaacactagagtttctgctgcagggcatttttactggactgtgattcctagaaggcaagtataagcactgtttttttgttgtttgtttgttttag

SEQ ID NO: 11252 - DNA, 1046 bp, Homo sapiens
atatcaaacaaccattatgaagttagagaaataatatttagattatattaaattttattaccagtgcaatttatttttttatagtaattaaggaatctaacttttttttgttttttgagacagagtctcactctgtatgcctaagctggagtgcagtggcgcaatcttggctcactgcagcctcggccttccaggttcaaatgattctcctgcctcagcctcctgagcacctgggattacaggcatgcaccaccaaacccgactgatttttgtattttttagtatagacggggtttcaccatgttggccagctagtgtcgaattcctcacttcaagtgatctgcctgcctcggccccgcaaagtgctgggattacagacatgagtcaccacgcccaacctaagatgcttttaaaattccatttatgtttaattcttcaaagtctggtacatgtaacattattataacaaaacattttataattgaaagggactttagggatctagtcgagaagtcaaaaactgctggaccagggttcagagctcttatctctcaaattgattttgttggtttatacaatattcataatttttagaattcaaatgactttacccgtaaagcattcactccctacttgaccacagtctatgttattacctaataagaccttaactgcttcaagcgtttacatggttacctggctgatgtaagtcatctgagtgttcagtatttcccctttccctcattccatctttttgtagacaaggaatctggaaaccaagaattaagtgatttatctcaaaatatacgactttttaaatagagcttcttaaattcaaagttaatgttactttctacagcttgttgtctccttagaaaatagtacaaggtaatacgtaatcaagtcctaaagtatttggtataacttgtcatgaaggagaatgatcactgtgggctgagttagtgcaagaatgcttcagagacatttccttgacactaacctcctaagaactgcatcttgagatatgctgccctgatctgtgttgt

SEQ ID NO: 11253 - DNA, 1231 bp, Homo sapiens
aaaagctaccccataagaccagtttttattttctttgattcatgtcttcaggattttctgttaactcagaattattatagcattcattattgttttgtgaaaatactagttaataatctccggttaatgaaataattatcttagataaatttactgaacttaatgtagaatatgttttttgtttcgttttgtttttgagacagggtctcacttgtcacccaggctggagtgcagtggcacaaacatgggtcactgcagcctcgactcctgggctcgagtgatgctcccacctcagcctctcaagtagctgggactacaggtgtgtgccactacacttggctaattttcatattttttgtagagacggggtttcaccatgttgcccgggctggtcttgaactcctcctgagttaaagcagtctgcttgtctctgtctgccagagtgctggcattataggcatgagccaccacccccttcttccactttcatttcaaacagttatgaagcagccactgaaaccggactctcgacaatgccaaaggaggttttgttttcttgtctttccatgtctttgctgtggtttgctctgaaactagaattaaacagctttttaaattgataaaaaagaaccaatgcaaataaaactacggtctgtagagtaaatggaaaaagttgtagaagtaataataaactacttttaaacaaatgagtaaggtagtagatattttgcaagaagtaaatagccaagtgtaaaagctgtcagttactttcatcaatcaggttagttgcagtcacgcaaattttaggtgattatataaggaactcaaattaggaatctttaaatgtaaatgacctaatactaaaaactacccaaaaaatatattcaaagataaatagaagaaatacttatgcatttgaaaaaatcgatgcattccacagttcctctgaatcaaaggtaaaaaaaaaaaacagtgtagaaaatactttgaacagtagtggaatttttagtattttgatagctttctttagaaatttaattgattttcttcatctgtaatcttagattgtgttggagaggcagtgtgaatcatgcataaagtttataattgtgtatgtgcctacatgatgtagaaattgcaccttttggctgatgaagtatcgtatagttgcactgttgataacattaagttcatttcgcatatatgctacagtcttttctgtttaacgcgt

SEQ ID NO: 11254 - DNA, 1031 bp, Homo sapiens
attggggtagttatagaacaacttcacaattcctctgttaacttcagtttttgtttcatttgttttataattttttctatttattaacaatagaactgtcaggaaaaaaaataagcaaaaggaaaagaaaattccctatccccccaccttgtcatgtattttttttcttttttttattccagggaattgaaattcattttctattataatctcaagattttttccgtactcttgaggtaatgtaataatgagattcctcctaggctgtcaaaattacagtctgcataacttgaggtacaatagatttcattaagacttctgtgattaatattagcggtcagagacaatgccaatattacaggatttttgtttagtaatgtgttttttaaatacttaaaagagggctatttcccagtcattatctctgaacatttttaaatgattcaaaatactgatgtatgcacaggtttttgcttttttatattgacatggagggttcttacatgtttttgagctagtagattaaagagtggaacagtgggccgggcacggtggctcacgcctgtaatcccagcactttgggaggccaaggcgggcggatcaggagattgagaccaatctggctaacgcggtgaaaccccgtctctactaaaaaaatacaaaaaattagctgggcgtgatggtgggcacctgtagtcccagctactcaggaggctgaggcaggagaatggcatgaacctgggaggcggaggttgcagtgagtcgagatggcgccactgcactccagcctgggtgacagagcaagactccatctcaaaaaaaaaagtcgagcagtgattctcaactgaaggaatagcagtcctctttagtgtactgagtggcagctcaaaccattgttactcttattttaaaagttacttttttttttttttttttttgagatggagtcttgctgtgtcgcccaggctggagtgcagtggtgcgatctgggctcactgcaacctccacctcctgggttcaagcagttctcc

SEQ ID NO: 11255 - DNA, 1031 bp, Homo sapiens
ccccgtctctactaaaaataacaaaaattagacgggcacggtggtgtgtgcctgtaatcccagctactcaggaggctgaggcaggagaatcacttgaacctgggaggccgaggttgcagtgagctgagatcacaccactgcacttcagcatgggcaacagagtgagactgcaaaaaaaagaaaaagaaaaaaaaatccagtctctgctggcaaggtgtttaacaagtcaatgatgggaaagaccagtcaaataaactatcagatctaataacttttctaaccataggtgattcttcttccattatccatactaaagcaagtgactcataataaaaattgttattttgtaaaatatatggactgtttgctttatattcccaactattacatctggttgactattaacaggtcaatgtcagatttcctgagcaaatcaaccaataatgaaaaactatgtggctggcagaaaaaaataagtgcgtgtggtggtgcttgcctgtaatcccagctgcttgggaggctgaggtaggaggaactcttgagctccggtggtttgaggccagcatggataacatagggagaccctgtcacttgacaaaagtatctttccctactggaaatggaatagaatcggatgggtatggtacagcaggtagttatggggagacctctactgttctaaatgagactaatagtaaatgttacataactaaagcaacagatttgccagctgtgtgaaagataacccagagaggggtaatggtagagccagaattaacacagccagcttgtcagctacctttgaacatgtattttctgtgcagtcagatttgaagggttggaccttggagttactgacattggaggcaactgaaaccatgagtgtgaatgaaattattttcgtaagaattacttggggttaaaaatagtaataaaaaggaaagcctggcctaaacagtcttgggatggggagaagggttggagtacaaaggattgctattacaaagacatgggcagagaacaaggcaaat

SEQ ID NO: 11256 - DNA, 1102 bp, Homo sapiens
aggagttcaagaccagcctgggcagcatagcaaaaccccatctctgcaaaaacaaacaaaaaaagaaatagaatgatgaagatccaaaagacaccaccaaatgctggagaggatgtggagcaacaggaactatcattcattgctggtggaaatgcaaacaactatagctactttggaagacagtctgcagtttcatacaaaactaaacatactattgtcatatgatccagcaaactcattccttgatatttacccaggtgagttgaaaactgtatacacaaaaacctacacagacgtttattacagttttattcgtaacaacttgaaagcaaccaagatatccttcagtgggcgaatgaataaactggtacatctgagcagtgaaacattattcaatgctgaaaagaaactggctatcaagccatgaaaaaacatggaggaaccttaaatgcatattgctaagtgaaagaagccaatttgaaaaggctacatattatatgattacaactatatgacattctggaaaaggcaaaacttggaaacagtgacaagatcatcagttgccaggagttagttgcgagggagcaatgaataggtagaacacaggatttttaaggcagtgaaaccactctttatgctataatgggggacacatgtcagtatacatttatcataattcatggaatgtacaccaccaagaatgaatcctaatgtaaactatggactttgggggataatgatgtgtcaatataagttcctcagttgtaacagatataccattctagtgttagatattgatggtgagggaggctgggattgtgtgggggaagagatatttgggtactctgctttctgccccattttgctgggaatttaaagctaggccaggcacagtggctcatacctgtaatctcagcactttgggaggccaagacaggtagattaccttaggtcaggagttcaacaccagcctggccaatatggtgaaacctcatctgtactaaaaatgcaaaaaaattagtggagtgtggtggtgggcacctgtaatcccagctactcgggaggctgaggtgggagaatcgcttgaacccgggaggcagag

SEQ ID NO: 11257 - DNA, 1028 bp, Homo sapiens
aaaaagccctcaacaccattagtcatctgagctaaaatgtacttctgtattaaggatttttgcatgtttttactgggattgtagtctgtctttcttcctttgacttgatttgattttttaaaaatagacctattaaaattacctcttaaaaaatttggtacttattatttctttcagggaaaatactctgcataccttaaaacaacggcagctgacttcttacgttggaagtgttcgtccgcttgtcactgaattggtaaatgttctttgaaatgaaagttgccttcaaagttaactgattttttttttcaggctgagaattttttctcgtggatctttgttttgctcttctaaaggtttgcacacactaacattttactctaaaacaactaagttgcattggaatctgatggaatatattgaaacatatccgtgacctttgaattgtaagtaataagttgtggaaagtatacttaacttgacagcattaaaaacaaattaattttggtcttatcttaagatttgactgcctatataaggtagtgactgacctatgaaagctcttttatgttgaaagcaagtgaaaaaaaactaaagccttattggtttgaggttagaacggttatttgaaaagtggatttgaaaagaactgaagctgaattattctaaaaacaaaggaatgaagctttatgacagggcacgtgaaatgtttatagtgaaaagagagaaataagtaacaattgaaaaaaacttctagaattccatttagtaacaaagaggtttttgatgaaaattgtttgggaaaaagaaaaagaaaattgtttggaaactactcttaacagcttaaaattgattatagctaaattacattgtagcaggcaacagctgaaaatcgtttaatcttaccagctggaaagtggtgatttccttttgccagaaagagaccatgttccaaaattgaattatgtgtttgcaaaatatttatgaaagtagtgaattgatctattatgtattccattttctgaatt

SEQ ID NO: 11258 - DNA, 1002 bp, Homo sapiens
attatttaataatggaatttgtatcaaaaattttgttactttcatataagcagtgtatttataattatgtctttttttcctatgaaggaggaagtttctattgaagttttaaagacatacatacaggtaaactttgagaacctacaacctgattgttttttactattttaatgaaaacaaaactcagaatgatgctattttaattctcagtggtaagaaagcatcagaatccataagagatcttttaattatcagcacagttgacctttgaataatgcagggattaggaaaacaacccccaccgccccgcacaatcaaaaattcactataacttttgactccccaaaaacctaactactgataccctactgctgaccagaaatcataccaataacataaacacacaattaacacattttgtatattacatgtatcatatgcagtcatccctcagtatacttgggggattggctccaggacccccacatataacaaaatctgtgtatactcatgtcccacagttggccctgcagaacctgcatatacgaaaaattggccttccatatttgcagatttcacatccagataacactgtattttctaagttgagttgaaaaaaatttatgcagaagtggacctgcacagttcaatcccgtgttgttcaaagctcaactgtactgtattcttatgataatgtaagttagagaaaagaaaacattactaagaaaatcataaggggctcggcgaggtggctcataccggtaatcccaacactttgggaggcagaggcgagaggactgcttgagtccagacgtttgagatcagcctgggcaacatagggagacccttctctctactacaaaaaatttttttaaattagcagggcacagtggttcatatctgtaaacccagctactcgggaggctgaggcaggaagatcgagtgagcccaggagttggaggttgcagtgagctgtgatctcgccactgccctccagctggg

SEQ ID NO: 11259 - DNA, 1044 bp, Homo sapiens
aacatacaaatcttatagcattttatacctgtcatttgcctcaagacctagctgttgcccagtatgcattatttttggaaagtgttacagaatttgaacagcgccaccattgcctggagttggctaaagaagcaggtaaaaatggttgaaaactttgtcttttggcctttctaggcaaatgttcattttggctgtagtaacatttgtccttatagttttaaatcttatttctgttgaggggaaaagaggaataaaattttcagggaatttctgttttaggactaaagttacttatgctgtaactcatatgtaaaatatcttttaattctggcattttcttttatataaatatctttcatattttacatattttatttttaaggaattactgttccaaatttactgaatcattatgactatttagagaatattagtatcaatgattaatctttgttttttgtcgcttcaaaaaattatttagatttggatgttgcaacaataacaaaaactgtagttgagaatattcgaaagaaagataatggtgaatttagtcatcatgacctggccccagccctagatactggcactactgaggtaatttgggatgggggggcagaggtttctataacttctaataatcttttatgttattccttggtgaacttctcccttcgtaaaagaagttctattaggttttcttttttaagaatgtgtctttgtcagcccagaccttttaaatttaaagtcttatgtaaaggattacttatagtagtatgttaaaggagcttctttaatagaaaaaaatctcagctttggcttgttgctcatcaggttattttaaatacttgattaatcactaacttatgtagcttgcttactcatattttcagaaaggaatagaaagttatatctaagaaaactattttagagtaacatttaaaggaatcacgtggttaagttggtaaggcatacaatatataattccagattaatattttctataatttatttttatttttattttcttgagacaacaaggtctag

SEQ ID NO: 11260 - DNA, 1050 bp, Homo sapiens
tcctatttttaagattatttcagaaattgtagtgtgtaatttctgtaatcccagcactttgggaggctgaggcaggaggatcacttgagcccaagagttcgatactagcttgggcaacatagggagacctcatctctacaaataataaaattatttttttttttaaatagaaaaattagccgggcatggtggcacatgcctgtggttcttagctacttgggaggctgaggtaggaggattgcttgagcccggagatcaaggcttcagagagccatgattgtaccactgcattccagactgggcgacagagtgagatgctgtctcagaaaagaagaaaaaggttaaaaaagaaaagaaaaaaaaaagaaattatgtggttggttactttctaattattttaattttcaaattttttgtaagtaaatgtagtgggcataagaggtttactcttttttctgtacttttactgttcacatcgattttaagaaagatccatgtatgtataaaggaatgccaattgttttttctgcttgttttccttatatatctgttctgactcattaattgtattattcaaatctataggttctgtttttctgtttttaaaaattatataaagaaattataaattccattttccatgtgtataagcaaagtagtctgcaatgaagttgaccctccctgtgtgcccctccccacatcgtctttttcccagcaacagtcattgctgtcagtctgttgtgtcctctcaggcctccttagagctatctttatttatatgtataaacatccaaaggagtggtgattgttttctgttctgatttttgctctaatgatattcagtttccaactcattctttttatgcatgtttttattcaggacatagtaagtttattagaaatacaaatgcagaagcattttattttcactgtcatacctctctgtagtctacgttgttcatcttcatacttttttgctgttaaatcttgtctaccaattacattctgggtttgattcagtacctggcttttctttttgtaaggatcttt

SEQ ID NO: 11261 - DNA, 1044 bp, Homo sapiens
actggtctttgaaatcttgtagaataattagacattttatcttcccctagtctataccccacattcccatctttgtgactctagttgtcgcatctttgattatgtgatactatttcttttgtgccagacatgttttatctcctaattttcagtgggtaggagccaaacagcatgaattacaagtgaactcaatgcagctgctgtactaccaggctccgatgtcatctgccatgttgctggttgctgtgcccttctttgagccagtgtttggagaaggaggaatatttggtccctggtcagtttctgctttggtaagttctaattgttttgatatctaagaaacagtataataataactcctccattattaatgtaatttttagttttcagagcactatgtccgatccattctcacatttatcgtcataatcaccataaaaggaggtaaggtaaggattctttttcagatgaagaaattgaggtacacaaaggtgaagggacttgcctagagtgaggcagctactcagtggcaaaagcagaactacaattaatgtcttccgatgcctggttactgttctgaccatgtcaagctagagcccacaaataatttggacatttagattaagttaaatttttttacaatgaaaacatagctttataatcactatttcgattttgaacatacgtaaaaatataaagaaagtgaaggggccaggcacagtggctcactcctgtaatcccagcactttgggaggatgagctgggcagatcgtttgagcccaggagttttagaccagcctgggcaacataggaagacctcatctctacaaaaaattaagaaatgggcagggtgtggtggctcatgcctgtaatcctgggaatttgggaggctgaggcgggtggatcacttgtcaggagttcaagaccagcctggccaacatggcgaaacccattctctactaaaaatacaaaaaaattagctgaggctgggtgcggtggctcatgcctgtaatcccagcactttgggagaccaaggcaggcaaa

SEQ ID NO: 11262 - DNA, 1070 bp, Homo sapiens
aaaaaaattgggccaggcacggtggctcacgcctgtaatcccagcactttgggaggccaaggccagcggatcacttgaggtcaggagttcgagaccagcctgaccaacatggagaaaccctgtctcaactaataatacaaaattagccaggcgtggtggcgcatgcctgtaatcccagctactcgggaggctgaggcaggagaatcacttgaacccgggaggcggcggttgcagtgagccgagatcgtaccattgcactccagcctgggcaacaagagcgaaactccatttcaaaaaaaaaaaattggtgacagactcaatgatggaatgatttgtcggaattaacacaaagcagattttattcatataatgacttttttttaagagtctcttttttaaaaaaacttaattctctaaaaccgaaatggttcatgcttctttttaaaaatgattgtataaaatgtatggaatggttagcctggtgtggtggtgcacacctgtaatcccagctacttgggagactgagacatgagaatcgcttgagcctgggaggcggaggttgcaatgagccaagatcgtaccactgcactccagcctgggcgacagagcaagacactgtctctctctctctctccatatatatatgtgtgtgtgtgtatatatatatatatgtgtgtgtgtgtgtgtgtatacatatatacacatatatacacacacacatacatatacatgtgtatatatataccatcccatatatatgtgggatatatatatatatatatatggatatggttatatatatgggatggtttggttggtcccagcaaagtatatgaaaattaaagttctgtgataatgacaaaggaattgctgttactgtactgcaaatatgctgtgggttctcggtgttcaaactcttctaaggaaggacacacagtagctctctgcttgctgatagatggtttcccagtgtgagatttgttattttgatcagagtattcaaatcagaatttaaatctagtgtttctattttagtttagcttcctgatttatataaatgaaatctcatt

SEQ ID NO: 11263 - DNA, 1035 bp, Homo sapiens
ggagtctcgctgtgtcgccgaggctggagtgcagtggcgcgatctgggctcactgcaagctccgcctcctgggttcatgccattctcctgcctcagcctccagagtagctgggactacaggcgcccactaccacacctggctaatttttttgtatttttttagtagagacggagtttcaccatgttagccaggatggtctcgatctcctgacctcgtgatccacccgcctcagcctcccaaagtgctgggatgacaggtatgagccaccacgcccggccagttcttttagtttttaaagcagtctcatttcagttattaatattgacttcttcattttgaaacttcaaataatatttgattcaaagctttcctcctcttaccagagcaggctggacctgtggccctggtgacctggaattggaaatgggggtgtgggatgtagggcataggtcttcttgtcacatcccattctgtcttcccaattattacttgtggtactcagaattccaagaatgactcccagtgaccttgcctatggatgatcccctcccctttaagcgtgggaggaacctgtgaatatgaggagatattactcccatcattctgttacattacatggcaaaagggagatgatctgggttggcctcatcaaatcacatgagcctttgaagtcagagtttttttctggctgatagcaggagagtaagtcaggttcaaagcacaagggtgattcaacaccctgttgctggcttgaagatggaggggagtgtgtagcaaggaatgcaggaagccttcaggagctgagagtggtcctcactgctagcaagaaaaaggggactaccgtcctacaaccacaaggaactgaatttggctgacaatttgaataagctagaaagcaggttcttccctagatccttaagagcccaagctggcccacaccttgatttaggctttatgacacctggagcagaggaaccaggtgagcctacctggatttctgatatatggactgtgagctaataatttgtgttgct

SEQ ID NO: 11264 - DNA, 1048 bp, Homo sapiens
acaagagaccctggttagtatttttgtctcgtgtaacttttaagaataatttattttatgaagtgataaactaaatttcgtatacctcaattgtagcatggctctgtaaataaaattgtatgtgcatagcttaaagtgtgctacctctggcgtaactgcgtggagttaaaaactgttaagaactggtcagtatttttttagccatttgccacatttgctttaaaaattagttccattacattgttaagcgtggttgaagttacgtttgttacgtgactgatttttttttcctttttgacctcccagtatttaatttttaaaaatggtttctaaaagtcaaaaaagttattcgtgcttgttttaaagatttttgtcattagagaaattttaaagtaaaacctgaaaattccaggctttttgctccatgtttccttttagattttttgtgtgcgtacccacatatatttacatttgaatttaaatctatgttattgtcctgtttgttgtactaacaagatgaaactgtagttgttctgtgacttgcatccttgtcaataaataaagtctacagaattctttttaatggctgcatagtattccacagcatgagtataccattttaaaaattatttatgcctttactgataggtttttaaaaattgcctcctgtttttgagtattacagatagtgccgctttgtacatgcatcccgtgtgactatttctgtaagaaagattttatagaattataggctggcctcggtggctcacccctgtaatcccatcactttgggaggccaaggcggaccgatcacctgagatgaggagttcaagactagcctggccaacatggtgaaaacctgtctctactaaaaatacaaaaattagtcgggcatggtggcgcgcgcctataatcccctgctgaggaggctggggcaggagaatcgcttgaacccaggaggcagaggttgcggtgagccaagattgcgccatttcactccagcctgggcgataagagcgaaactccgtctaaaaaaaaaaaaaagaaa

SEQ ID NO: 11265 - DNA, 1098 bp, Homo sapiens
aggacttcttgggcatccctggatcccaggttaagaacttctgcactagagatacatgagtacagtatactgatctttctgggatagaggtgagctgattcatgaccatatattctatctaatggttccagcattttaatgcattccccacctttaaatttgtgcacagaagcatgattttcagtgacagattgagcaaccttaggcagaatttcagtgtgattgaaatatgcctgttctctgtctctcccacttagtttatgggactcagattacttaaaacatttaagtttctttcttacaacggtatagtggggcaggaagagcttccatttttctttttcctctccagctatacttttagaaacttccttaaaggatgtttggtagaataaatctaagttctcttcctttttcctttcccactgctggacagcaatctgtccaatccacagtcacataagaatattcctttaaggccgatgcctgcttagccagttaaatccaaagacagtgtttgtaggaaagggccaggttaaatggtatttttaaggctaatttgggattgaccttattatcattggataatcagttaaggaaacaaaaaagtatggatttagcagtagatagaaatgagaaaattggccaaggccatcataaagacttagaatgcttatgctaaactatgtaacagtagtgtatgtattgtctgatatagttctcagttataggatctttgttctggggcacacaggaaggtagtgaaagctagtatgggtagtaaaaagagcgttggattaagagtcagaagagctggggccagtttcttcttcttttttttttttttttttttttttatgtgacagtttctcactctcttgcccaggctggagtgcagtggcatgatcactgctcgctgcagcctggacctcgtgggctcaggtgatcctcccacctcagtgtctgcagtagctaggactacaggcttgtaccactatgcctggctaatttttgtatttttttgtagagatggagtttcactatgttgcccaggctggtctggaactcctgggctcaagggatctgcttacctcggcc

SEQ ID NO: 11266 - DNA, 1062 bp, Homo sapiens
gaaatctttcagctagagagactttagtaattattaaaagtagctgtacataatcattgtgctactaattattgtgcttttaagtgcctacaagcttgccaatgataaatttggttttgaatgtgtgcagtagttcatactaagtatgtatgtagaagtctggttagatccagcttaatacaaatttttattctaaaatgtacatctcttgttattttttttttttctgtctacaaggaaaatatataccatgatctacaggaacttggtagtagtcaatcagcagggtaagttaattttgagcatcatggataaataccataaaaacgttttaaagacatttttgtttatgtgcatatgttttataattgtgattctctttaaaagttgctttaattaaatattgtaataaaagtatgataaatttattagaagtacatatgaactaaaaccacatactgaggttctaatgtaaagttaaatatcctgttagatcaatttagacttgggatatcagagttaggatttattttgaaaggtctgtaatttcaaaagctcctgtttaggagtgatctaccttgaaaatgtattgaaaggctttgggaaataatattgttacctaggtaggaccatgtgtaaggatgaaggatgagtctttttctttggttatagacaaaattttgtttaccaatttgtggaagtggaattttatgttcctacttccgtttcttaactggttatttttgggtcacatctctctttaataagctgataaaagcattgggttcttgttccagaaagatgcacatgtatatatacatgggtaagtcaataagtgttttacaacctactttccatgagaaaagccctgatttatgtgcttgctgacttccatagtataatactctcatttgaaggctaaaaacatggagttgggaagagatgtacacagtttgctttttttttttttttttttttgagaaggaatcttgctctgtcactcaggctggagtgtagtggcatgatttcgactcactgcaacctccgcctcccaggttcaag

SEQ ID NO: 11267 - DNA, 2869 bp, Homo sapiens
tcctagaatgaattgaccactcccttgtacttcctctattccatattcagattttattgtaaaattgctttgttttacttgtgggtttttttgtttgtttttgagatgggctctcactctgtcaccctgcttgaagtgcagtggtaatcttggctcactgcatcctccacctccagggctcaaatgatcctccccctcagcctcccaagttgctgggactacagatgtgctccaccacgcctggctaatttttctgtatgtttggtagagacggtgttgctatgttgcccaggctagtcttgacctgagctcaagagatattctcacctcggcctcccaaagtttaggggttacaggcatgagccactgcgtctggctgttgcacttgtttatatttttgttacctgtgtcctattcaggtttgcattgtgcatcacacactatagtgttttattaatatggtatttaataaatgtgttgaattgaatacttattcttccaaagttaggatttaaagcccagaaaagtatctccattttatcccaaaataaaagtagttattaggctgatgatttggcattttattgttttaaagctctttttttttttgagctttagattgtatcctttttatttcctttttttttaattattatactttaagttttagggtacatgtgtacaatgtgcaggttggttacatatgtatacctgttgttttaaagctctttaagaaattgtgtgatagctaaatatacaattgtagtatttgtagtagtagtttgagttttctgaagtatgtaaccctgatgtattcattccttcatttgtttaaataaactttggcacattactagaaaaattgtattattgagatggaaacttacaaattacttatttgcagtctgagtttggtttagatatcagtagaattaacttcagaactcctattccatgttctcaactttgtcacttttttttttttgagatggagtctcactctgtcacccaggctggagtgcagtggtgcgatctcggatcactgcaacctctgcttcccgggtttaagtgattctccttcctcagcctcccgagtaggtgggattacaggtgcctgccaccacgtccggttaatttttgtatttttagtagagaaagggtttcaccatgttgaccaggctggtctcaaactcctgacctcaggtgatcctcccaccttggcctcccaaagtgctgggattacaagtgtgagccactgcacccacccagcctagggcttcctttttattacatcttttttgtagcatctgtttatactaatccaaaattcctggacaatataacctattatgtacaacttaagaaaattagtgtaatgccttacccatagtataaagagaaaattaatctatgataatgcataatttcaaaatgttaatgtccaggcatgagttcactgttaagatgaaaatgtttccaaggggggtagtaaagggtatttgatgataattgtctgtatatcccaactctgaaactttgacttttgagctcaaagtctgtatatccaactacaaatgaaacctatgtgcctgaataactcagtttgttatcttcccatccaatctgtttatctttctaaagtttctcttttagtgaatggtaccactcatttattcacccaagttggaatcttggaatcatcttaactcctttcttccttgccttctatatcaaataccaggtcttgttggtttttacctatttaatttctctggaatttgttttccatgccttagtttaggctttaatagtttttagtttgtattattgcaattgtctaatactggttttcctgcctctgccctctttttcttatgttttgctagagtgatttgtcactcttctgcttaaaattaccatttaggggttcattattgctctctggatgtaatattttctgtgagctagaaatcagtttcatttcttggacaaaaatcctttttaatggtgagtggctgcaacatcgcattaaggaagattctgaagtatctgcggggaagaatgcagtgataagggaatgacagcatgagtcctgctttggctagaccacaggatcctttacagtctgaacctgcctacattccagtaataatgaactgcttgtggtgtcctgcaacaggaactgttgttagtttgcttttggatactttttcacatggcgttttcttggtctggaatggcctttcctagccctattttcatattgtcctacaaaatatttcctgattctttgtttctcagacactccctgtccctaccaaaataatgactctcctgtctctctgctaatttatctaacagtcttttaatgtcttgattatactttactcttctacattaaagttgaattattttatttacatctgcaacatttagtatgaggatgccacctggaaaatacatgtttaatgtttattgaaaggttaaattgcataagggtttgtgttagactgatagcatatctactgagtagcgccccgccgccccccgcccaccaccaagtttctgatcctttttcttttctctcagaatcatcggactcaggtacatctgtgagtgagaacaggtgtcaccttgaaggtgggagtgatcaaaaggtaatctaagtaaatttctcattctaatgtaatattatttgcaaattggaaaggttatttacaacaagttagcttactggttatgttaagtttgttgtattttatttttttcctaaatgcttaggaccttgtacaagagcttcaggaagagaaaccttcatcttcacatttggtttctagaccatctacctcatctagaaggagagcaatta

SEQ ID NO: 11268 - DNA, 1050 bp, Homo sapiens
ctagctatttccctattatttaatatctccatattagttatttatgaagtaaaaccacctagctgaatgttttgttttattcatcctaaacatcctttgtattgacttttaccattgtgggtaaggatttctctctcctccattttttccccctttacactcacttactctatttgatattgtctaaggctttctcatatattgtagtacatgatatttgtttaggacttattactaggaagccttctgattgaaggaaatagggcgatgaattgatgctaatgaatgtgttttattaggtatatcaagttactgtgtatcaggcaggggagagtgatacagattcatttgaagaagatcctgaaatttccttagctgtaagtatacatctacttttttaagaaataaaaatttcattaaggtcaagattaggagactatatctagcttctttctgaaatgaactgatttttataaagttaaaatgtttttgtaaagtctgaataatttaaagcatttttcttttatttgttgtgatgagacctgtagctataatttttatttttaggtgctggaatttgaacttttttttttttttttttaaacagggtcttacccttctcccaagctggagtgcagtggtgcaatctcagtgcactgcagcctccacctcccaggttcaagtgattctcgtgcctcagtctcctgagtagctggaattacaggcatgcaccactataccccactaatttttttatttttagtagagatggggtttcaccatgttggccaggctggtcatgaactcctgacctcaagtgatctgcccaccttggtctctcaaagtgctgggattacaagcatgagtcactgcccagctgaatttgtacattttgatgttattttggaaaatttcagtgtatctccagtatactcatcacccagctttaactattaccaacattttgccaaccttgtcaaacgtaaacttttttttttttcaattgagatagggtcctgccctgtcttccaggctggagtgcagtgatgt

SEQ ID NO: 11269 - DNA, 1026 bp, Homo sapiens
tatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaag

SEQ ID NO: 11270 - DNA, 2473 bp, Homo sapiens
attgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggtttttttttttttaaagccacacaataattttggaaaacaatgtatgggtagaacatgtgtctgttaattgcacacaaaaccacttttaatgggtacagagttaaatttgaaggaataagttctagctgaagtattatgaactccaaataatgctttgaggacctccaaaggtaaaagtactaatccctttggccatttattgagagagagagagagagagagtagggtgactatagttaatgtattgaatgttcttgctacaaataaatgatatttgagctgatgggtgtgctaattacactgatttgatcaatacccattgtatgtgaaacagtacatacaccatatttacaattatgtatttaacatttaaaatttctaatataagtatctctcaaactgtggattaacttcttgatttatatttaaatatgaatcttaagcaaaacagtgaaaataaccatcttgatttagtgtttttctcccatatgtgaattgtatatacttaggtgaagacaataaaatcaactgaactgtaagcttagaataggactgaggtaattctgcacagcaactttactaatggtacattgttgcttcaaaactctctctctctctctctgtctgtctcaataaatggccaaagggattagtagtttacctgtggaggtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaattatttgatcttaaatttttatgagttgttaaaatagaaattatttgaatatcata

SEQ ID NO: 11271 - DNA, 1025 bp, Homo sapiens
ctactgcattttatgtagtaacacatttaaaacaattaaattgtgcttaactgcaatgttcctaaaagccttatttttttgtatttcccaggtccctatgagaagtttaatgaaatattactggctaatgtggttttcccacctccattaaccatcatattcgtgactagttgctcaggctttttaaaaaacaaggaaactcaagagatctttactgttttatttttcaggaatgactttgtgcctctggtttaaatattagaaaacagaaaaataccagttggctttaaatgtttgctattcagttaaagactggatttgtttaaatgtaatacattgtaatcaaaggttaagtttttaaatctttgtgtttttaaaattgtgcttatgttttaaataataatacttgagttgtgtccattacaaatcagatacattcctcgagtgcaacacaggttctaacgcttataagacctctaggaaatttttttccttttatttatcaaatgaatataactgcgtttaaaagagggctgtaactgcaaggaacaacgattgagtgttcaagactgcctttattagctttacttacaagataatacattggttcacctttctatgcacaataaaagaagaattgggtctcaattttagaagttaagcttttttcagtacctcttaatgaaatatttttaggcttttgcatacttaatttgagagggacatctcccttatccggatagctgggtggattcttatccctgtgcagtagcaagtgctgactgggcaggaggtaaaaagagattagttttgtggacccaatgaggaactccttttaaatgtaagttttcaatgatttgtataaggtacctactgcattacgtctaacacagttgtataattttaccagtaaaatctttatatgtttgaatagattaatggcgaggataaatagaggcattgtttttgctactttgcatatcattggccaatcaatgattgattgatttgtatatccttttaca

SEQ ID NO: 11272 - DNA, 2076 bp, Homo sapiens
tatgttactgtcattgaaatatttttccaaaatcttaccagaattagaggcaaccacaaaataatttacaactgatttaatctttactagctggcgaccttatttctactagttgctatagtagactagaactcttgttttattgtcgttgagtaaaatactaaatagtagccagttttgacttactttggcttcaaagctgttgtaaacattaaaaaaaaaatctttgttttccagtgtaaactgcagttctcattggatttgtatactttgaaattcgggatagtctttatttccattttctactattttttgtctgtatcctgctgagtcttctattttaaatgtcatacttttatgaagcttttttgtattttggtaaggcacagtattatttcaaaaagtgatttgcatctattgaagtagaaaaaagtgaggcattcaacagtcttagcagaaactaatttggggatagattgagaataataaattagtgaagctctaatagagtgcctttcttcaccaggtgaacttaagaatggagaatgaaggggggaggaggcacaagggactggctactccttatgggttctctttagttcttagaggtctttggatgtcaccaagctgagaacagctggaaggggaatttgaacatcttccaaacctctctattacttgaagttgagaagaaagtgattctgtctcacagtagcatatcaattcagtttaaactgcatttatactcaagtgtagtaattactagcccaatatttagtaattgtagattttaaaattctggccaaaactaaataatttaaaagttgaattgtttagcgcgagtgtggtggctcatgcctgtaatcccagcactttgggaggccaaggtgggcagatcgcttgaggtcaggagttgcagaccagcctggccaacatggtgaaaccccatctctatcaaaatacaaaaattggccgagtatggtggtgcctgcctgtaatcccagctaatcagtaagctaagcaggagaatcgcttgaacctgggaggcagaggttgcagtgagccaagatcgggccactgcactccagcaagaccctgtctcaaaaaaaaaagattgaattgttcaaaatacatttgttgagtgtctgttatgtgccaacaacgagggatacaaagtttaggtagtctctacccttagagtacactgtaggggagctgagagatacctacatacagtagtgcacacgtatccacagttccactttctgtggtttcagttacccgtggttctgaggtctgaaaatattacatacaataaggtagtttgagagatactatatttagctaacttttatgacagtaaactgttctacaatcatgtgtcgcttcacgatggcggtatgttctgagaagtccatcttaggtgcttttgtcatttgtgatcatagagtgcttttgcatttcaaacctggaaggtacagcctactacacatgtaggctatatggtgtagcctgttgctcctaggctacaaacttgtacaacatattactgtactgaatactgtaggcagttgtaacacagtggtatttgtgtatctaatatatctaaacagaaaaggtaagtgaaaatcttgatataaaagataaaaagtggcacacttgtgtagggcactcatgaaaggaacctgcatgattggaagttgctctgggagagtcagcaagtgagtggtgggtgaatgtgaagatctgggacatgctgctgtagacttcataaacactgtacagtacactcaggctacactaaatttatttaaacttttttcttcaataatacatgagcttactgtaatgttttcacttgattgattattttctcactgtcatccagtctggagtgcggtggtgcagttgtggctcactgcagcctttatctcccaggctcaagcagtcctcctgtcttagtctccagagcagctgagactacaggcatgtgccaccatgcctggctaatttcaaattttttttgtagggatgaggtcccagctagtctccagctcctgggctcaagctgtcttc

SEQ ID NO: 11273 - DNA, 1026 bp, Homo sapiens
cttccatctctgcatcttgtcccactggaaaggtcttcaggggcagtatgatgcatgggctgtcatctcctaggataactgccttcttctgtaatacgtggtgaaggactgacttgcctgaggctgttttacagttaactttttgaagtaggaagagtacactctaacataatgattaaaagtatggtatagttggccttggtgtggtggttcacacctgtaatcccagtgctttgagagcctgaggcggcagattgcttgaggccaggagttcgagaccagcttggccaacatgtcgaaactccgtctctatttaaaaaaaaaaaaaaaaaagtgtaaaaacaaaaaagtatagtataataaatacataaaccagtaacacagtcgcttattgtcaagtattgtgtactgtacataattgtatgtgctattcttttatatgactgagagcacagtaggtttgttcacaccagcattacgagcccaaacgtgaggaatgcattgggctaagatcgctaaacaatagtaatttttcagctccattataatctgaccacctggaccaaaacattgtcatgcatgactaaattgttctcttttattagttattttttacagtgcctactttataaattaaactttatcgtaggtatatataaagaaaaacatagtatatttagggttccttgctttccgtggctttaggcatccactgggggtcttggaacatatccctctcagataagaggggactactataattatagcacactgacaggtcctatattgtagttaccattcttttatgttttatgtgtaaagttttgttgatctggagaggaaagtcaaaaaaattctgtgaactttagggaaacttacactgcttgcattgaagtagtatgttttgttgcttgtttgggagtcagaaactcttaatgtggaatttagtttctgctctgtcaggccatcaccgatagcacaaatttagtaatctgaccacccagctttaaaatggaagtgtaggcc

SEQ ID NO: 11274 - DNA, 2011 bp, Homo sapiens
acttgaggtcaggagtttgagacctgcctggccaacatggcgaaacccctgtctctactaaaaatacaaaatttagccaggtatgatagtgcacacctgtaattccagctacttcagaggctgaggcaggagaattgcttgaacctggggggcagaggctgcagtgagctgagatcaggccactgtactccagcctgagtgacagaacgagactttgtcacacacaaaaatagattaattacttttaaaagaatggaggtgtatagaggcagtagttggaacaaagaattcacttaggagttacggacctggacatccgataagtcagtttttatgtcatgaatcattttgctttacgttcagtcattatgtatgtattctagccaattgttgagccaattaatgaaaataaatttcttggacaaatatcagagaaacattgtttatgatttatttatgtttactagaaaaccatctgaaataaagctgtcaggttgagaatgagctaggtagaattgattcagaaaaatggatagaaatgttcagggaagctagaactcttctctattttgttatttatgggtgcagttaatttagttgcctgtgaattgtccactatggtttatgtggcatatttttagtaccaaattccttaccattatataaggaagggatttttacagggattactagccagttttaataactactgagaacataattagataaaaccagaaaatgatatattttctttaaaaatgtatgcattaggttatctgctattggattttgcatactagtatttcttttccgaggtataggatatattttgtaaatgcaaaatgtaacttccccccttcatatatttctctaaatggaaataatttaaaataggctttgaaacaagtggcctttgctgtgcatttactgatagtatcatataatgcacgaattttgtatgtatttatgtatttttatggtagagatgggatcttcctaagttgcccaggctggtcttagactcctgggctcaagggatcctcttgccttggcctcccaaagtggtgggattaacaggcatgaaccaccatgcctagcctcgaatgatattactgtaattttagaaccatcaaaaaaatatcaggcctgtcagggagaatgatgaatattttgacagccaacaagttcatcccaatagtggtatacagtatgtatcgtatatctgtgatattaaaattgtaagaggggtaattagggaaaaaatgtctaaaagtaacttcttgaagggagggaggagacagggataatgaaaaggttgagaagccatactttaagggaactaataggattttggtcattttgccatccattttctctggcttggcaacagatatttgtatatcatgtggagcataatcttgttgtgtaaaatgttgagagaataccttgtctaaagaatgattgtagtgatttagaatggtagggaatgaaaaaaattagtgagttttttttttttttaaacaaaccctaagagctgttgtttattccaagctttatgtaacatagctggctagctactatgaacagcagataagattgggcaacatttggtatcaaagataattagaggaatgatgttgatattttcttgttttttgaatgccattaaaattaaaagtaataattgaaaagacccttcatgtaataaaaaatgataccgtgaaatatttctttgacaaactggaaaccttttttttagtctgttcagtaggctcacagagctttatttatatatgacctgtgatatacattttgcataatttctcatgcaaacatcatgcatattttctcactttatgaagtaagaacaaagttcagtatgttctgtatttttttttacgctggaggattgatgtgatatgaagctgattaaaaggaaggttactgataactacaaaagagtgtgctttgagtttcatttttagtaatggcagcaaatgtattcagattc

SEQ ID NO: 11275 - DNA, 1059 bp, Homo sapiens
ttttcatgtacttagttacaaattgaaccctcttctatttttttcctgctcctgtttctgtttcattttagttttccttttccctgattatcatttaggcatgtaagtgacacccagtagcattgctttaattctgctggtgacagtgccaaagctttactatactctttttgttgtctgttgcttttctcttgctaatttgcttgactagataactaagaattcaggtaagcattagctctttgttcactgagaataatacaacttgcaagataattaatttggattgttctacatgtatttcgtttatttctctttaccttgttcatttattacgacattttgaattatttacatacccatatttcttctttcttttatggctcagctcactatgcttttttttaatactggtagcttcctcaaggttggaaaacaagatctgaatactatagaaaataataactatttttctgtggtcatattaaagatataatggctttggattttggggtgatttttctactgtcagtttaaaaaaaacttgtctatttgcatttgtgtgttattacttctagttaagagtatttccaaggaaagtttcatgttacttattttgtttccatgtctttttccaaaagaacttattttttatattataataaatatcagtggaaaagtaggtttcgttatatagaaattaactttaggctgggtgcagtggctcaagcctatatttgggaggccgaggcaggaggattgcttgaactcaggagttcgaaactagcgtgggcaatgtagcgagacctggtctctacaaaaaaaaaaaaaaaaagaaaaaaaagaaaagaaataaaggaaaccccctttttttgtttttttgtttttttttgagatgaagtcttgctctgtcgcccaggctggagtgcaatggcacgatcttggctcactacaacctccgcctcccaggttcaagcgattctcctgcctcagcctcctgagtaactgggattacaggcgtgtgccaccatgcctggctaatttttgtatgtttagtag

SEQ ID NO: 11276 - DNA, 1060 bp, Homo sapiens
aattggtaatcattctgattattttaaatttgtttttctttttgaggtataattcatatgccataaaatgcaggcttttaaatgtacaattcaatgataatttattatatttatgaagtttagcaaccattaccactgtctcattccagaacatttcatcactccaagaaggaaccttgtacctggttagcagtcactcccatttcctctcttcctatctgctggcaactgctaacgtgctctggatatgcctgttctggacatttcatctaaatggaatcataaaatacgtagtcctatgtgactggcttttttccttagcataatgattttaaggttcatccatgttgaagcatgcatcagcatttctttttatggctgagtaatattccactacatggatatagcacttttttcttttaatctatcagtcgatggacgtctaggttatttccacttttggctattaaggaaaatgcccctgtgaatatttgtgtacccattttgtgtgaacatgtattttcagttctgttggatgtgtacctaggaatggaattactgggttaatatagtaactctatgtttaaatgtttgaggaattaccagattatttgccagaggcattgtgccattttattaatacgtgctcatcagcaatgtgcaatggttccagtttctccacatatttatttatttatttatttattgagacagagtctcactctgtcacccaggctggagtgcagtggcgcaatcttggctcattgcaacttctgcctcccaggttcaagcgattctcctgtctcagcctcccagcgtgggactacaggcacacgccaccatgcctggctaatttttgaatttttagtagagacggggtttcaccatgttggtcaggctggtcttgaactcctgacctcatgatcctcctgccttggcctcccaaagtgctgagattataggcgtgagccactgcacccggcctctccacatctttaatacttgtctttttgattatagccaccctagtgggtatggggtggtatcttgtggttttgat

SEQ ID NO: 11277 - DNA, 1050 bp, Homo sapiens
gttaagaaatatttttagtttttaaaattatttatttttagagacaggatctcactgtgttgcccaggctggagtgcagtagtgtgattataggttactgtagcctcaaactcctgggctcaagcaatcctcgtgcctcaaccttctaagcagctgggattacaggcatgagccactgtgcccagctgttgttttagataaaagcagattaagacctttttacagaagaataacagtaataatattgatctctttttactttgtatcctcaccccttaaacactttttaggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaagtaagcagtcctcagaggcttttattaaaatatgtacattttaaccagtgcatttgttaggtgttatactagagaagtcatcttaatactagctcactaggaactccatttcacaaagtccatgctttgaattagatttaatcactggttatgactgtgggcctgtgtacgagaaacctactcctgttccatttttctccagatgtaacagacccaatactatacaacaatgtgcaagttctatagccctgccattcttgtcctattatttccatcttagatacagaaagaaactacattctaattcttagattaaaggagagctatgtggatgtgtattatggtgggggagagatcactgataaccagaaaatgttcattgatttttctgcttggcaacaagacctttcaccacttggtaaactgaatatagaaaagatttgtcattatacatttaagtacattatctttaaagagatgagatggatgattatgtaattaacagaaattcaagtggttccttttcttttaatgttttagcacttaagacttaactgaagaagtgtgttacaaaatttaaatgatgtaatactgaaattaagatatctgttgaa

SEQ ID NO: 11278 - DNA, 1052 bp, Homo sapiens
ccaggtgccccaccgccagctccgcatgtgaacccagctttctttcctccaccaactaacagtggcatgcctacatcagatagccgaggtccaccaccaacagatccatatgggcgacctccaccatatgataggggtgactatggcccccctggaaggtaagttagtgtgtatctgtgaaagtacttgatgataaaagataggaacaatgactgtaaatattagattgtaggtatataaatatgttatttctgccttccaagaagatgaggtgtttaagctgctaccctgttttagctgaaagatactggtataggagaatttttagatttgttctctttgttggaaaagtagcatgcttcaatatggaaaagtaactactatctctaaagcacatgtcagaagcagctagtatgaattgctatacactgttgtgactaactgaggaaatctgttgagtatgagttaaggtttatgtttttgttttacagggaaatggatactgcaagaacgccattgagtgaagctgaatttgaagaaatcatgaatagaaatagggcaatctcaagcagtgctatttcgagagctgtgtctgatgccagtgctggtttgtgtatttcttgtattaatatttcttatttatgttattaggaatgacctaaaaatgtaagtacaatctagaagataggtcatttacatgtagtagttctttttatattcccaaatcattacctacgatttatttaaaaagcattgaaaaaagttgtgtgtcacagtgtagtggggaaaatccaaattttaagttatttggtatagatttaagtcttacccttgacatttaatggttcaggggcctcatgacaccttatttattcttatatttgcaaaatgataatgtgcttcacacacgtataataagttgagtcaatatcatgagcatgaaaggcttttgcaaatggtgaaacactgaaagaagacattgtcttgcatagttattttatagcacagtacttttgtaaaatgccttatcactcttatcccaagtggtttga

SEQ ID NO: 11279 - DNA, 4989 bp, Homo sapiens
tctaacttcttagggtggggcttctcccaagttagtctgtcgtattgttctttttatttcttccatagtacttaccataatcaattcttacttgttataaggcatatttttcctcattagaacacatgttgaatgatggcaggggatttatctatcctgcttactatatttcttttcttttaagagatgggtcttgttaagttacccaggctggtcctgaactcctgggctcaagtaatcctctcagcttggcctcccaaagtgttgggatgataggcatgagccagtgtgctcagccatgctcgttataatatttctaatgcctacagagtgtgtggtacagaatgagtgctaaataaaaatttctcgaatgagggagtgactgaatgaatgaatgatctatcttttaggtagttcctttttttttctttttagcattgctgctaactttgaaattttatatatttttgaaaggcagacctaatcttcacttggtattcttagatatgtctttagtgtactctatctggtagtaatctgtaagagaaaagagcttgcctttgacatggtccccagttttgtaattattacctttttgacccggtgtaagaatctttgtgtctaaacaaatttgtcatagatatagttatcttgtatcatctttttaagttttgaagtccaaagtaataattttttaatcccaacactttgggagaccaaggcaggaggatcacgtgagccccaggagtttgagaccagccttggccacataaggagtttttctacaaaaaaattttaaaaatatctgggcctggtggtgcatgcctatagtcccagctacttgggaggctgtggtgggagggttgcttgagcctcagaggtcgaggatgaaatgaactgtgatcatgtccctgcactccagcctgggtgacagagagagagagagagaccctatcttgaaaaaacaaagtaataacttaggccttgatcaaggattttagcacctaatgtttgctaagcttagctgtctggtgcagaaatacaagacataaatattatttcgtagacagttattatttccttactgtgaatttagcagaatttatagaagtcttttgggtagtaagctttggttaaattatttgtttttaaaaaatcgcagttcatgaaacatttctacttattaaatacaatgtgaatactatatctattcttgctactggtcataattgttagccctctcccatgcctcttctcctcccctgaatataacatgcgtattagaaggtttctttgtgttggatgctgctcatgaaccatatgttaagaggttgtcatattcatgtatttaagccccattgtgtgttgtgatttcatgacttttatatctaaaaaaaccatattgtagatgttctttagcttgaaacacgagtgctttgaaattttccctttacctttctatttgtgcattcagtaaatactacacatctgttttaggctactagtttaatagatgatgtgatgcatttctgtgatgtgtctggttgctgatttttttgttaatgtttttaatagtgaaatttctggttcatgcttacctggtgagttggtaagtcgttattggcagctcaggatagtaagtttaaaccagatttacaaagaatttttgctgcctaagtttttttagacatcaaaaaattgaatatttttaggctatctaattatggagagcattaatccagtaatttcttttagaagacgtgaacgatcaagagagagggaccatagtagatcacgagaaaagagtcgacgtcataaatcccgtagtagagaccgtcatgacgattattacagagagagaagcagagaacgagagaggcaccgggatcgtgaccgagaccgtgaccgagagcgtgaccgagagcgcgaatatcgtcatcgttagaaggtgggtattccttgttccctgttaaatgtgtgtgtattcttaacagtaactataactccaaggctactgtttatacagtatatacctacattttaaatggtccaactacttgtgaatttaatcttctggaaacatctgaaacaaattataggtaagtaatgacaggtaaaaattttgaccctttatcttatgaatattttattgctgagttatcactttcaggtttcaaatagttaatggtcttaacaaagcaaggaaataatcaagaggactcattgtgtacttctaaaatctaaaaattggggttcttgtatcacatacataggttgcatgcaatttaaaatacaaaacacagggagttatttcacatatatgttatgtgtttggatttttaaaaataaatggaaagttactatttttgaactagttttatttgtccctaaaaatttatgagaaaatctaacacaataatagtttataatacaggagggtgttttctcaacattcaaagagaattttcctttaaaaaaaaaatttttttttttagaagagacactatcctgacatctgctttttgtttttaaaagaaacagtatcctttaatttgcaaagaagatgtaaaagttaatcaattaaaatgggtttagggtgcactgatttatatctaaaaattttaaattgtgtcaagccatatacccaagtttagaataccttgaaataattttctttgatgtttcattcataaatcataatcattgtctttttttctgtattttaaaactttcttgtgtacatttttcatgaagtgggaagagttgtctgtttatgcttcattttcacatgtaattttattttttatatttgttaatagcatttattcatgtgaagagctgggggagggcactataaggcttatgcatgtgacacaaaggttattctgtaaattaaaatattttttctttatatgttggttggcatattcaaattaaattaaggctaaacaaacccctcataggtaaatactctttatgtgattattttcagtaatcatgggaaacttactgaaaattcagtcatggtaattgttagtatttaaattgttatgggcaaaattaaaggttttatcaagtgtatgtaattctgtgacagaataccaatttctttaaccataacagatacgcaaatgaagtccttaaatgcctagaaaataagcatgctatttttatggaacacagatataagctcctacactatttacaattttaagggctttttgagttaaaaggctggttttgatactttgcattttgaatatgcagattgaatatcaaaactttaatttgtagttttccatgtattacaaaatttaatataaatctcaaaacattcttttaatatgaggcaaaaaaaccttttacttttaaaactaagcttattgaaattgatattgtttttgaatgtaaaaattgaatgttgtattatgtaaatctaaacactaaattttaaagatgtagcacttttttcccctgagttaaatacatctgatcccatcttaatgaaaaaattctcaatatccatcagttgcttaaactggattgtgactgggttattagttgaaatgcttacctatgtcagtcatttccattatagaagggtacaggttctgtaagttacctatttttttggactttataagttatcagcaagcttcttgttagtaaaggcatgataatgaaacttgaattcatctacaaaattggatgtgcccatcaaggggcctctaaaccaatttaagcccaaagttaactaattacaatttctactggttttagtaaaactagcatagtcaaccaagtaaacaaagtccattgttaatcttatttgagttagctaacattacattctagtaatgggtacacctaaatatatcatgacttgagtttcattacattcagacataaactacaaattcctaatgtgcaaactattgttgacatttttcttaatcactgatgtaccataccagaatttccatgttttgtttgtacattaatcagaattgagttgtaatactgtatgtgccttcatccaagaaaaattttacataagcatttctagtgcaaaaaattctgttatcctggattattgtacgtttgctatatcaaacagtattgtggatgtagacttgaataaaggggtggggactgggattaaatatattcaagtaaatctttaaaacaaaagctatctgcaaatttgatcaccatcataataaggtctgttgacctttttagaagttttaaaatatgagtccttttgagctttcatgtaaatcttaaatggaccaaatggactgagtgatttgaaagctaaagtgaatgtcactagtaaggctgtatacaaataaaatactaatgtaatctattaaagtgatgatgaatggctaaaagggcaagttcttaactttttaactggaaacgtaatgatcttggcaagctgttaatgtctgtcccatcttaatttttttttgtgtttgaactgttggtaatgttaattgcattctctcattttaaaatgtattggtttttctaaaagtattcaatatctaagttcaaatagataatattttaatgagaaaataccaatattgtaaatttcagtatgtaaatacgttgtgcttcatattctgtaatttctacctctattctcagaccactctgagcaaaataaaagtagttcagtgctttacgattgtacattttttactgaaataattttagtttcatagttgagttacttaaaaggttacgttcctcttgtcacttctttggaacatccctactcagcaaatttgtgttaacaattcagcttttctttgtttactgaaaccaaattatgtttttttaaaatactctttattcaggcttttcctctctctattttatgaggttttacaattctcaaatcatccatgacaatttttaagcattgggtatggggtctggattaaataacttgcctttgctatctgattacttttt

SEQ ID NO: 11280 - DNA, 1031 bp, Homo sapiens
gaatatttagttaacgttgtttaaagaaacctaataaccaaaaaggggtaagggtgccatttatgctatccaaattttatgaatttgtggtagcatgttttgactctccatgaattataaataacaggttattttgagatgttcattttgtaaatcttttgggaacaaacctcatttttctttgaatgtgattaagtttatttctattttactgggttgtaagagcaattatgtatgtgttttatagagtaataaaatgctttacttaaaatgaggtaagtactatgtacagaggtagaagaaaatatgaaatgttttggtagcaagaacttcttgtaaatatctacaataactagaattgtttttatgtaatatgttctagtcaacacaagaaggaattttgattttagagttaactcatatgtagataattatttctcttgcccacctcatttccattcctcttattaaggagaaattttcagatagagaaaagtgaattttatttcgttgagttagtagtgcatctctaaaattatgagaatccttttaattcagtatattaatgtgaaaatctataaaagtgccctgtcaagtatttatttaaatcttaaaagatgaatttaccatgaatttaaaatactaattctaacaaatgtgcatagataaatttctaacagaaacagttataatttgagttgttaataatggcttgatatagtatcttaaaatacaagtacttctctgtgtgttgaaattttacttagtgctcactttagtttacagactttattaaaaaggtgtagattccatttatcatcttagttgttttaacatctgtttacataggcctttcttttataattaatagctaaagcaagtaattgtgtggctttgacattacagattttaccaaatgatacattgaaaacatggacgttgaatgtatttgtcacttttaagcttctttttgatatctttgttgatgtagttgcctacttagacatttgagagtataatatggaattgga

SEQ ID NO: 11281 - DNA, 1057 bp, Homo sapiens
gtgtatgtgatatgttttatggaagagttgaatatttttgttttgctatgactttaaatagtttttccctcttaatgactttttatcccttccagcgcaacagaaaatttagggagatagcattcttttgcagttagatttattaatttcccagtaattattatttcaggttagaacatatgccttgtctctctctaatacataaacctgttttttaatagtgtagtgcagataataaaaataaaacatttgaaagctgccattttgtattttttccccattaaatagtttcactaaatagcttcatcaacataagatgaagatgcaataaaagataacaatagtaatggctgaagttatctgaaagatacaggcatatagaaactatatatataaaagagaagtctggattgtatttttttttcttttgcagttttaaaattttaagttattactgctaggcagtgtgaatgcatatatgtactgatgctcttaagatacaacctaggaaaggacataatagaaaaatttatagcagtggcagaagtaactcttaattgtagagcaaaaagtatttttcagttatttttatttcaaaatatcactaaactgtgccctatgaacatgttcaaactgaaaaaaaattttaaaaaaccttctgccctcttgactcttaaatcactttattattgaagtggtttcttgtcatttatactttcattaccgactgtttcagtggttacttatatccaagttaattgaatgtttcttgtgaacctctacctgaagtttgcatatatatgtattctttaaattttagtttatcaactttattctattttttttcttttatgtgagttttaaatgaactttatcattgtagattcccacttagcttgttttggttagtttataatactacgttaggtatttctatataggtggaatagactaaaagtaaagtaaatgttttaaatttgtattacgtctaaagatttgtacgtggatgtcattaatttaaatgtccatactctatttataaatcttacttacaaat

SEQ ID NO: 11282 - DNA, 2576 bp, Homo sapiens
tgaaaaatatttacataaaaatcatccaagcattttccatttatttttgtagtatgcatattttagaaaatgacttatgaatgtttccatcatcacagaaacagtagctgctatgttttcattactgcttcagtcattaaatttataaggcaataatatttaagaagaatgaaatcagaatgtctcagtttaatcatcaggtaaattggaacatttcaccaccacaaaggcagctactgtttcagttaattcttattttgtgttagaatacataacagtgaagtagatgcacgacttgtgtatgtatagttaagccagcgtttttctgtgtattttggggaatagcaaaatctacatcacaaattttgacacattacagctgaaggaagaggatcaccttccaagacaaaacagtcttcatgggggaaaaatgacgcttgtccagcagtttgcttcttgtgattgaactgaacctgtaaggattcatggataaaatgaacaggaatagatctgaataaagcaaatctgcataaatggtaaccagtagctctacttttattttttatgttgcttaactgttttatttgaaggaaacctgtgtgatttaaaaagttatagcttttgcaactttattactggttatatacatttggccattatgatgtgcaagcaattggaaaaaaagtcaagtaaatgcttgtttttgtagtagtttgttcttgttaaaaatgtttatatgataatgtctgtaaacagcatcactttgattacaatagatgtagtgttgtaataaactgtttaatggggctgatgtgtaaagctgttcaagttatttgatgtttacacctcagggaaagtcttgtgttcagcaatatctaaagataatgttactatgacaacatttttactgtcctttaaagcattgcaatagcgtttttggatatgcctcaatctaatcttgcgttcagtgaattaaacatagtaattaagtgtcttttgcccttgattttgatattagaataggtgattacatggatatttaatatttctatattctgcttttctagctgtttttacctagttagcttgtgactttgctgaatggtatgtaaacttgtaaaaatagagatttgacagacatagcaatctagtcaatgtgtaaggggtcaaaaaaacagaggttttaacacataagtaaaaacccgtacatatttgatgtgtaatgcaggttaattacaacacagatgtaccgaaacacttaattgtgaaccgctaacattgaagaaattttgacaattccgatttgatgctgcaattacttgctgtttttattgatcttatggtttatttcttaagccatagtcagtgtaaatacagccctgcagcaggtaaatgtgagtaaagagagccttatattttccaattggtataaatttttgaaggatgtgatgttcattaacattcggttgtattccccagtatttgtaatgggaaattacagataaaccgtgtctgcacagtttaaggaatactatgtatattcatgcaccgtattgattcatgctatagttacttaatcaaagatttttttcaaacctgccttacatataggcccactttaaaagcacctgactagcatgtgttcttgattgcaaaattggcagaggcagggtgtcaacttgattaggtgtttttatgggaatgtaatttgaaatcactacttcagaaatttgacttaaaattcttgagcacgttaatatgtttttaagatctgattatctttgagagatcttctgttaatacacattggttgttaaagagtacccaaattctaggacaatgcttaaagtgttaaaataccctagatactgtgttatgtgcaactgtagaaaccctccagaaatttccactgctgttcttcactttcatcttgtctgctatcaaaccacttctgacaaaattagctgttttgaattacccatatcactgccagttttattttaaaatattttgtgtttgaagtatctgtgcatgggatcgttgatgtttatcagaactgttcactttcagaaatgattttttaaagcattttgttgaaaatgcggttgcttttttaacattattttagagttgtatcaaaattttcctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaaccttttaattgctccttctatatcactcttctccttgcttggctgatctcattacatgactttcgttacagacagtgtgagtgtactagatttgtttgctgctaatccgttattttaagtgttgtcagaaggaaataacttcttggtttgaccaagtaatt

SEQ ID NO: 11283 - DNA, 1063 bp, Homo sapiens
gatttctaggcaagtataggcagtttcattgttctaagaattttcaaacaccactcaaaattacagacatctgtcttgaaatgtttttattgcctatatccgcatgaatgcctctggaagtctgaataataaatttagggaaggacagttttacaatgtaattgtaagaatttcttaattgtaaaagtcagttgtgcacatggttttaagagaagatttttgaaataagtgtaagtcttctgtgttagttttctggtaccataaactgggtggattaaaacaacagaaatttattcccacagatctgaaggctagaagtctgaaatcaaggtgttggccatgttttttccaaagcctttaggggagcatctttccttgcctcttccagccccagatgttccttggcttttggcaacatatctctaatatcttcctccattgtcacatggccttatctttctccctggtctctgtgtcttcttctcttagaaggacaccagtcatattggattgtggtccaccctaatgacttcattgtaattacacctgcaaagaccctgtttccaaataatgtcacatccacaggtgctgagaattagggcttcgtatcttttgcctgcatttatagtcccagttacttgggaggctgaggcaggagtatcatttgagatcaggaattcaagaccagcctgggcaacatagtaaaaccccatctcaaacaaaatataccttttgcagggaggtcacaattcagcccataacatctttatcccatctttgacctcttttccaagaaaactgctttttaacagttacctgttctcaattcctctagaaattactcactcctgtgcatctcatatatttaaatccctaatactggatttctcagcttcagatagtatctttcagtgcctaatgattgattataggtgatcctttttcgtcctctttccaagtttctttttttcattttgccaaaggaattttttcagaaaggatgcctgagaaataaactttcagagatattgcccatctgaaatgtccttattttttcttcata

SEQ ID NO: 11284 - DNA, 1060 bp, Homo sapiens
tataggtgaagtgtgtttcctggaggcagtacatcactgggtcttgttttttcatccattcagccactctgtgtcttttgattggagactttagtccatttacattcactgatattgatatttacattcattagtattgataagtaaggacttccaccattttatttttctgattgtttgatggtcttctctttcttctttccttccttcctgttttccttttagtgaaggtgattttttctggtggtatattttaatttctttttatttttgtgtttctcttttatgtttctaggtttgagcttaccatgaagcttgcaaataatatcctataacccgttgttttaaactgatgacagcttaacactgattgcataaacaagcaagcaaaaagaaagcaataaacactttatattttaacttcatctccccacttttaactttttgttgtttctatttatatcttattgctatctatgtcttgaaaaattgtagttattatttttgatcggttcatcttttcatatttctacctaagacttgtgtagtttacaaactgcaattacaatgtaataatattctttgtttttctgtttacttgccagtgagttttgtatcttcagatgatttcacattacttattaacatgcttttctttcagattgaagaacttcagcatttcttgtagggcagctctggtgttgatgaaatctctcagcttttgtttgggaaagcatttctccatgttcgaaggctattttcaccagatgtactattctaggacaaaaggctttttttccttcagcactttaaatgtcatgccactttctactggcctataaagtttccactgaaaagtccactaccagatgtattagagctccattgtatgttacttgtttttgtgtttatttcctcttgttgtttttaggatcctttctttatccttgagatttatgagtttgattataaactgccttgaggtagtcttctgtgtgttaaatctccttggtgttctataaccttcttgtacttgaatattgatatttttccctgaatt

SEQ ID NO: 11285 - DNA, 1032 bp, Homo sapiens
tgttgaactgtgggcgctgcctgggggtgctgctttaagttattactctgttgattagccaacaagataaataactcgcctttgacatagtgaagcagcagaaattggctttccatttcacttcttctgcaggaaagatagagcaagaaaagcctttttattaatacagcaagtaaaccttgtacaaatatcagtattcaaaatgctttctagagaaagaatagtgcagcactgtgcgtaatgggttatgtaagtggagtcacagaagtcctcctggggacacaaaccaattatgaacataagtgcttattgaaattgcatcagttgtctagatgaggagcttattgactccctggttcacttgggtgggcaggcggctgtgggggagggacgggggggggtgtgggggtggggaacttaaggtgcaaacctagcctaggtgactgttaaattaaggcttaacatttgtttcttttgagtgtttttggttgcgtaattttaaaagttgggaatgctatagaaatatttaaattctattagaatgtccaaggcaaaatgttcaggttaagtagaaatagcttggaccctctgttaattttaaagaaaactgtgggtttgctgctttagatattaaaatgatatgggtttatagagttatgttgtgtatcattgttgctggtaaataaaaaatgtttaattcatttattttaacagtgcttaaatttttctcttaaagtactcccaatggcagaaatgtggatgaatagtaccctcagaagtctaggaatgcagcccaaagtgtgcctgctataaattgaagtttttgatgcctgtagggttttatattttaaaatttatataaatgttgcattttgctatcttacatgcatgtcgacagtattttaaaatactttttttttttttttttttttggtttgagacggagtctcgctgtgtcccccaggttggagtgcagtggcgcgatctcagctcactgcaagctccgcctctcctgggttcacgccattctcc

SEQ ID NO: 11286 - DNA, 1028 bp, Homo sapiens
gcgtttttttaaacgtaatgctgttgcacacttaatagactacggtacagtgtaaacataacttttgtttgccctgggaaaccaaaaactttgtgacttgccttattgcaaaatttgctttattgctgtggtctggagcagaacccgcaatatctttgaggtatgcttgtatataaaatccttccacgttttcatgcttttcctcctatttgaagctgttttgacatatacctaattccataataactttaaaaaatactagcctctgaatctttttgaacttttcaacataattttcacagaaacaacctttttcctcataattcagttcatacgatcttaaattatataattaacaataacaagtgcagttggcataaactggtttgggaatggactgctggctcttattaagcattaagtgcagaagggtagggacatgttaagaaagtggtctgcttagaagactactaggtgtaggtgatgagcctgtgttgggcattagggagtgatttatggagggattggagagctttacttttgtaagtttgatacagtagaagtctgttaaaagagtttctactgaattattattcctctttccattttatagatgaaaaaactgaggcctcagagagttaagtaaccttcccaaggtcaggcaggtgataatagtggagccccaggatttttacctagatgtttattggttcaaatacagcatgtactcttaccttctgtgcaggtgtttgatgccttttagggaatctgatttacccagtcaataggtaatcttgagtggtcttcaggtagtgtttggggtagagttctgtaagttgtcccacatcttagatactggcttcattttgctccttggttcttttttttgcaccaactgtgtaagaaaaatgagggaacattccaagataaaaattaagcttacaagccttggttaggtggcttccgcctataatcccagcacttttggaggctgaggtgggaggattgcttgagctcaggagttcaag

SEQ ID NO: 11287 - DNA, 1081 bp, Homo sapiens
ttttataagatttactaaggctgctttgaagtattaaatatgatactgttcttatatttattgtaggcttcctgttggataaaaaaattggagtaaatcaaccaaaacgaattgaaaatgctaaaattcttattgcaaatactggtatggatacagacaaaataaaggtatgtaactctactttttaaaaattaaaattactgcccaggcagagtggctcatgcctgtaatcctagcaatttgggaggccaaggtggtggatcatctgagatcagaagtttgagaccagcctgaccaacatggagaaaccctgtctctactaaaaaaaaaaaaatacaaaattagctgggcatggtggcgcatgcctgtaatcccagctattcgggaggctgaggcaggagaatcacttgaacccaggaggcggaggttgcactgagccgagattgtgctactgcactcgagcctgggcaacaagagtgaaactccgtctcaaaagtctcaaaaaaaaaaaaattgctggattctataaactcaggaatcaattgcactaaaaagcttggaataggtatgaatctattgtgtatatacacatatatatacgttggtaaaaatgttgaaatatgctatgggactctttaaaaagagtaatgaggcctggcgtggtggttcacgcctgtaatcccagtactttgggaggccaggcgggcggatcacaaggtcaggagttcaaggccagactgaccaatgtgagatggtgaaaccctgtctttactaaaaatacaaaaattagctgggtgtggtggcgcacacctgtaatcccagctgcttggaaggctgaggcaggagaatcacttgaacccagcgggtggaggttgcagtgagccgagattgccccactgcactccagcctgggcaacagagcgagactcaatctcaaaaaaaataatgaaactgatgctctctttatgcttcgtttgtcttagatatttggttcccgggtaagagttgactctacagcaaaggttgcagaaatagaacatgcggaaaaggaaaaaatgaaggagaaagttgaacgtattct

SEQ ID NO: 11288 - DNA, 1007 bp, Homo sapiens
cttacttttttggctaagaagtttggtctctattcagcagacagggaaaatcaataaagaatttgtaagatgccatttagctttgaattcttcagaggaaaaacttgagtggtacactcaagttagtttccatgtaaactttgtgatataattgaatagttacatgaactgttttttgcttatggagaacctgaagcatatgtggtattgttagtggctgggctatgataattcaagtttattgaggccatactctatgtcaggtacatagtactctacaaaatactttacatggattgtctccttcaatcctcacagcaaccaggacaagggaggggctagtgttatccccattctaatctcatcagaggagaaatttaaggcttatagaaatgaaacacattatccaggattggatcctgtacatataaaggatattattggaacaattagtgaaatttgaatggggcctgttgattagatggtaattttaatcaatgttaacttccagattttgatgatgattttgtggttagatagaatgtccttgtacttaggatacacacacacatacacagatacacgggcacacacacacacacacacacacacactgtgtatatgtatacattgagatattaagtgggcatcatgtctgaaacattcttaaatgactcaaaaatattaacaatttcataatctgggtgacaggtatgagagagtatgtgtgtgtctttaccgcctttctacttactctaaccaaggtcatgtataatcagaaagttaaatataaattcaagagatctatggtacagcaggatgactgtagttcctgacgatatattgtaaattcttgaaaaatgcagagagtaaatgttgagttttctcataacaaaataatggcatgaggtaacgcattcgttaattagctagttagctatttcacaatgtgtatgtgccttcaaacatgttgtacatgataaatacaatgttctctgttaaaaaaa

SEQ ID NO: 11289 - DNA, 1040 bp, Homo sapiens
caataattcataggtttgtttcttttatgtaatcccatatttctcaacgactttgttcattttttaaaattattttctctttatttttgtttgaccaggttaattccaaagaccatttttcaagccctgaaattcttttttctgttcggtcccatctgttgctaaagctttcaattgtattttcaaattccttacgtcagttttttggttccagaaactctgatttctttttcttttcttttctttttttttttaagacagtttcactcttgtcacccaggctggagtgcaatggcaccatctcggctcactgcaacctccgcttcccaggttcaagtgattctcctgcctcagtctcccgaagtagctgggattacaggcgcctgccaccatgcccagctattttttttttgtattttcagttgagatggggtttcaccatgttggccaggctggtcttgaactcctgacctcaggtgatccacccacttcggcctcccaaagtgctgggattacaggcatgagccaccatgcccggtgcagaacctctgatttcttttgaatatgtttatttcttcttttatttcctggattgctttagaagtttcttctatgttgattgtcaactctgtcttggatctcattgatcttccttgcaattcatgttttgaattctttatctgtcatttctgagttcacattttagttaagaactgttgctggagagctagtgctatcccttggtggtgttactacatttagatttttcatcatgccagaattcttccactggtttctcctcatctggagatgattgcacttctaatttttgtaattaatttcatgtgagtaggattttttttcttccctataattgtttttttcttttcctttcttttcctccctattggggtgtgactgtagagaattctgggtaggatcttttggttttgcttctatagttctgtgcacttctttcagcaggttttatattgggctgtgcatttgacctacaagtcagtaggccatgcttattgata

SEQ ID NO: 11290 - DNA, 1050 bp, Homo sapiens
aatgatatccttttgaacaacctttgagtcaaaaaatcaaaagggaacttgaaaagtttcttgagacgaataaaactgaaaacacaacgtaccaaaacttaagagatgcagaaaaagcagtactaagagggataaaggcctacattaaaaaagaagaacaatctcaacctaactttatacctcaaggaattagaaggagaacaaactaagtccaaacttagcagagggaagggaataacaaagatcagagtagaaatagagaataggaaaataatagaaaatattaagaaaacccgagtttgtttcttgaaaaaaataaaaacccttagctagacaaaccaagagaagagaggactcaaatcagaaatgaaagaggaggtattacaatggatgcttcagaaataaaaaagatcataagtgacttttatgaaccacatgccaatcaattggataatctagaagaaatagataaattcctagaaactgactcagttttctggaatcaaattctggaaaatggaatcaagaagtagaaacaaaaaagcccaagattagatggcttcacaggtaaattctaccaacattcaaagaagaatcagtgccaattctttttacactcttacaaaaatagaagagggaacccttccaaactcattttatgaggccaatatcactctgataccaaagccagtaaatgtaccacaaggaaaaaactatgggccaatattctcaatggacataggtgcagaagctcttaataaaatgttagaaaatcaaattcagtaacatattaaaaggattatacactgtgatcaaatgggatttgtccctgggatgcaaggatgcatcaacataggcaaatcaatcagtgtgataaaccacagtaatagaatgatataataatatacattataatcttaatagaagcagaaaaagcatttgacaaaattccacattcatttatgctaaaactctcaacaaaatagatataggaacttactttaagacaataaagaccatatatggaaacccatagctaacaatcataat

SEQ ID NO: 11291 - DNA, 1051 bp, Homo sapiens
ctgctaccaggtattatgctaccaggtattatttgagagtattttttaaaaaggaaaactgctaccaggtattgaaccaccaagagtggttcaatttattattttaaatgaagagctttttttcagtgatgtttaaattagttttggttttgtaaagcggtttttatgtttatacgttttaaaacatgtttttgtgttttcctttggtttgttaggctgacttatccttgtataatgaattccgattgtggaaggatgagcccacaatggacaggacgtgtcctttcttagacaaaatctaccaggaagatatctttccatgtttaacattctcaaaaagtgaggtaattttttttcattttagtaggaattcattatagttgtttctgtacttcttttaaactaaatcatattacatattttaatatctcttacataaataagttattataaaatgtcatgttttgctatttttgccattccgtactagaatcatgataatttcttggcattcagttactgaacatcttttcttatatgagcagaggatcattcacactcaaatgtgtactgcattggtgtcaggtattaaataggtatgggggataggacttatttcttgatttgcagtccaaggttcagtgtaagggaagttctctacacactctgttaaaggcatttgttgtgtctatctgtacatgatttaaaaatctaattttttatctttaaaacaggaaaagtaatgccttctttgcctgtgccacaggattgttaaaaggataaaatgaagtggattaagtagatgcaaaaaccttagaaaaataaggcagtataaaaatttaaagctgtaattttaatttgttcttacatgtgaaaggtttgtctacaaatatccggtcaattaaagtataagaaatttaatcctaagagttttatgttaagtctttcaagcatttaattataacgttgcttaccaggagaagttaagatgaacatttttcacacttttggtatgaatatatcttgttcattgtggctctgtatctggttt

SEQ ID NO: 11292 - DNA, 1068 bp, Homo sapiens
acctaatctgatctcagggaatgagaattgcctgtttaaccaagcaacaaatacagcctatacaatttttcaatttctataatactttaatttacatggtggaaaaatgagggcaaaatgcttgtgtatgagtgatttatatccccaagtacctgctcttgaagataaaactcagattgtggcttatcttctgatgctgggcaaaaaacaaaaacaaaaaaattcagaatgatacaacttcccatatacctccctacaagaactaattacctttgtttttgctttataactttggatgttgcactttttgatttttcagagatgctttacagttattgtaatctgaaaattatttgttcaaaagtaaataaaattttcaggtgtatgaatagattttattagaagtgattctaacccagttctcatttgtattcctttagtagatactggtgttaaaagtacctgtattttgaaagaccattacagaattttttacaacctgtataagttatagttttatcttttctagtgacagacttacttcataagattttctgataatatgaataaaatgtatgcttcacatgtatatatgaaataatgagtaagcattaatagaccaatgaaaagaacttagcttacaatttattttcttgctctttaaaagcagtggtaaataatagcttttttttgttgttaaaatttgtaactgtagaaagttcattctgttgggatcacatatttgaaggcaaactaacaatgccatgtgcttgcttgaataggcatttgaggacaggttattttcctgagatttcaggaaaatataccaccaaacatttatgatgttatttgttacctggatctgtagtggattttgtaacacaaagaggcagaatatccagggtaccaggtagggcagtttaggggcagagttaatatgaggtgtactgtaatgtttgagtggaattacatacagtgttaatcaagagatctagtgctatggtagaacttattctgcttgatgatacaggtgactgttcttccttactaagagcagtttctacctgt

SEQ ID NO: 11293 - DNA, 1064 bp, Homo sapiens
tacaatgtgtttgagagaggagcatttggttttgtgtcatatctggcaagaatgtgcttttgtattactttctacattgtaaattataatgcctatcctgcatacaaattttgtatttagttttctgcttgtaagaatctttcataggtcagtaaaataaaatattaagtttactatgccattccaagcacctgactacttttggctttgctacttaatatttttaaaatgttttacagcttgcagagaggacttttatatacattatcttaattttatatatattaaaataagtttaaaacttagcatttatgtttataaacaagctattttggtcaataagaaaattagaagttgggaattatgaaggccgttttcatcttcagactggactcagagtctaatttctttctcatttattttagcgctactttatagagaaaatcgtgatttattaaatcaaatagatgttaatggaagacttgtttttgtttgcatctgatcatcttgcagatcctggatatttaatcaaattgatgcagaagtttgaaagacaagcagcagtaggaaatttttgtttcaagcttgacttttctgacaatatccaacagctgctcatatttttaaaaattagaaacattcactgagaaacgttaaaaacttaaaagcaaatactgtgttataatgagaataggtaataacatatcattgatgctacactttacatattattgcaccattattctgaggtaatcatatgccgaacagattactgcacaaagtaatgctttaggggtgtagtttttatgggaatgaacatgtctggcctgaaattagaaaaaaaattggagccataatctttctaatctatgcttgcttatgagaaattctaggtatatttatgtcaggccaaactatttgctacagcaaaccggttaacctgacatctgagatagtctttaaagtgtttaagtttggtatacaatgcacttgtgtgtgtatatgactcatcctaaaatggatggatgtgtgtaaaaaaattgtaatccaatgcttaaatgaat

SEQ ID NO: 11294 - DNA, 1030 bp, Homo sapiens
tgaaaattttgaattgcacaatttttcaaatattctcaattcagtagcagtgaaacaacacatattgaggttaaagttctttacattaatagtatactaccactgttcttagagtagactcatacccctacttctttgattctaggtttactctaattttaatgtttctcctggaaatgtaagtcctaagtttttatagggctttttagttgccttcttcctcctcataggaaaatatccatttgttaaataaagatattaatatatacagaaatatgtttgtaaccaatattcttaaacctacacttaactgacccactcttttaaacaaaccattattttagattcttagtcctgagtattctgagcatttatagctagtaaactactctctagtttacccttgtacccttttctccaccaggttagttatatgcctaacaagaatcagtttttatgccaatgttaatgtaatttttactttaaatgtgatctaagtgaataaaatatgagcacagaaagatagaactattgttttaatgaaaagcacggtgaatggttcggaaggacttatataaagttctttacaaattgctaaaggattaggtgtggataagcccagaggtttaggaaacttttggttcaattgactaaacagtatggaaaactattttctcacatatctggaggaatggaagcttttgtgtggttggttaatgcagtggtttaataattaattccagggtcagattctttctgtttgttctgccattgtcagagtgtcagcttgtccacaggctagctctctttatggttacaagatggatatagtagctctagttgtgctattctgatataacaacacctattggggaaagagggtctgttttttctttctttcctagaatcctaccatcagtttttcccttatgtctcactagccaggattggtttaaatgccctttcataaatcaattactgacaagagggataggattaccaaattggcttacactgatcacatttcctt

SEQ ID NO: 11295 - DNA, 1026 bp, Homo sapiens
tggggcatagttgctgagttgtatggtaagcttgtgtttacctttataagaaactgcctaaccttctaacatggctgtacttaccttcatttttgaaagatattttagctgggcttagaattctttgtagatagttttcttttcttttctatactttaaatatattgaaccactctcctctgatttgcattgtttctgatgagaagtctgatgtcattcctacctttgttactctatgtatttttttcccctgctttaagattcttgtttattgctgttttgcagctattttactctgagatgttgtgatcatgtggttttgtttttgttattctctttagaggttgttgaatttggatctgtgggtttatagtgctcatcaaatatatttaaaaaatttagttccagtttcccctccttgtgcttcagcctcaaaactacaggcagtgagctgggtgtactacgtttgttctttttcttgacgatctctgtcctgagaagattgttgtgtgatgtctggaaaccattgtttcatatattttgtctagttttctgtttatttaaggtagaagggtaaacatagcctccttttttcatcatgaaatacatccttgccttatagaaaatttcattgtagttttgcaaatatttgtcttttctgaattcttgaatataggacttggtgggagaacagtgtataaaccttaataaattttggcacctagggtgcatgctgtctctcatacttgttccttttcacagattgtgtctctctttgacgtattgtacatcctttcatttccaatatgaaggttatcaacagaatttattgctgaatatttttatttaatatagtacagtgaagatagtggtgacagatgttaacttttcatgtttatttggaagaaaatacagtgtcttcagtcatttttcttttttgtttattaaaaggagataatgattcttagttcactatagaatattagctcccacattgattagagtatataatggctatggattgaa

SEQ ID NO: 11296 - DNA, 1034 bp, Homo sapiens
agaggtcttctaggaatgtatttgggagtgtttataccaattttgagccccatcagtagtcctcatattcatctgacatttgataatttcagaattaaaatttttttccatctattgaggttgtgtttgagatatattgagatattcttcatagtcttttaaaaaagattttttgttttgtcttccatatttaatctacctgaaattgatttttgtacatggtgttagaagtacagtttcctttcccctgcacctaaattatcatattagcattgtgtaccaatttattctaacctccttaactattcagtagtgctagctctattgtaaatcaagtttctctttatatgcatggatttcttatgtctctgttaccttgatgtgtttgtctgtgcctataccaatatcatgttttcttaaatactaaagctttgtgttaaatcttcatgtctgtctgtcaacctttttcttcataagagtcttgacttggccttttgctctgtgacaaatttagaatattcatgagaatgctcccctccaacacaaaaagaagtattgagtttgtaagtggaattgcattgactttagttttctttgtggaagaatcgataagtttatgtattctttcatgttttctctcaaagttttatatttttttcataagggacttagaaatctttagtccaatttatgactacttttgttgcttttcttggttgtaaattaaaaaaaaatttttagttataggtgttattgaaatatagttgacttttaaaattgatttttgtatctcaatgttgctaaactttttaatttttataatttatctgtaggctttttggggggttcatataagtaaacacatcctttggaaatgacagttttgaaattgtcaccagttttgaagttgtcatcattaaataatatttgatacaggattttttttatagatatactttatcagggtaaagaaattgttcataatgctaccttatatatttttttcctctgtagcatctttttcttcttaaggt

SEQ ID NO: 11297 - DNA, 1046 bp, Homo sapiens
aacttccagatgcaccacttcacctgtaataagacatattaacatcatatgcactcatatattggaatatatgcatcacatatgatgcacttgagaagactacatcagctctgtggtgatgtggctttcagaatgcataacttcagtctaatgagaaaacatctgacaaaccccaactgtgggacattctgcagtgtgtatgatataacatcaatattatgaaagaagaaagactaggataagtctcggattggagaagactaaggaaatgtaaaactaaatgtaaggggtgggggacaaagtgttgtaattttaaatacacaaggaattccttactgagatgacttcacacctgaagtaggtgaagtaggaagccatctggatgtctagaggaagagcattcctggaggataacaaaggcaagggcttggagacaggagtatgtccgatgtgtttgaggaatagcaaggaggccagtatggcaggagcacatgaagagaaggggagaatgctaacaggggagattagagataacaaagagtaaggtcatgaaggccttggaggccttggtaatggtgcaggagtccattgtaaatgtgtttcacctctattccgtttgatttctgatgttcttttattctgagcctgaaggggataaagtgtataagtataaaatgtaatacctaacatctagcactgtgtgtagtagatgctaactcagtgattattgaattagtgtacatggtgagatgtttagaaacattttaaagatcatgtcttcccttgctaaaggaatacttttcatttttaattacttcctgtaacataaattaggattctgatacctctgtatatttttaaaatgtaaaggttttaaaataatttgtcaccttcaataatatctatttatgctattgaacagatgtcttaaataagcttctatttttattagttttagtatttgtaatagagtttatttttctttgaaaataactcactttttatattttcaaggattcaacatttttgtaaaagtgaattgattt

SEQ ID NO: 11298 - DNA, 1088 bp, Homo sapiens
ttcttgttagatgtgaaataagaaaaaaaccttaataaactattaatattataatgcaaaggaaggttcttacatttttttaaactttatattctccacagtgtatatagcaggtccagaaaacccatgttcaaaaaagaagctaaaaaaaaagttggggaaggcctaagtccatagactataattttgccatatgtaacttggtctcaggaggaggcaagttttagttttcttccactagctttagatgtgctattttttcctgaggtattaggcaggtagctatgttttaatctttacagaaatagaaatttcaaacatctttttccttgaagtcttgacaggaggactggaacatttctaccaatctctaggtttgaagttaacaaaaataagtatagatatctggtacgtaattcagcaaatgtttgttgaacgaatgaataaactcatcagatcctgtgtcgtgtgtgtgtgtgtgagagagagagagagatgccaacactcctggcattttctccttgtctgccttgcactggaaatcatgatctaaacatcacagatttaattttgtagggatgtagctctgggtcttcactaccttacttttgagcttcttctcagaaagctttcaaaacgtgtttctttcgttctcctacatctatcccatataattcatgttcattgatttatagatttttgcacatacaagacattcacattaaacccaagaaaaacagactcttaagatggcccatggttgctaagtttcttcagagaaagtatgtgagggttaaaagagattggggttctagtgtatttggtatttcaggtctcaaaacaagtcatcaaaatacagacttcccagcagtttgtctccctttttttcttgagttttttagataactggacgctctatataaacacatctccctcagcaaagtacatcccgtttttttctcaatatgtattcatattcccttccttcctccctctttatcagacccatctttgcctaccgtcttttaaggatttaaaatattctcattagaagattttccttctgtatgcatagaggatttgttttt

SEQ ID NO: 11299 - DNA, 1034 bp, Homo sapiens
aagccctggaaatcctactatgtaagtttttatgtcagctacctgatttgctagctgtgtgtcttaggacatcagtctctgtgtgtctcagttttctcatctgtaaaataggaacaatagtacctagctcatgaaggattttttttttttaagtgggagaatagttagtgtttgtgaggggggcactgaagtgactgctgtaattaagacagactgtagaaaataggttagcaatgaatattgaaaacctttaaaatgtaaacattccttgagtcagtcatatgtctttccgtaaatttgtacttcagctgtaacctgacattcagacaatataatataatgccatacttgtttttaacaaaaaatttgaggctcaagtgtttaaggaattaagtacattgagtattacactatttttcaaatgttccttatgtaagcttaagaatattttaatgaaaattatttgaaatacctagtagatgcatatcatcagttacctgatttgtaagctaccctgttctgtgacttaatgactattttattttactgtctgcctcctcccttgccccttttctcttttgttcttgtttgtttgtttgtttgtttgtttgttttgggggatattttgagacagaatttcgctcttgttgcccaggctggagtgtaatggcacgatcttggctcacagcaacctccgcctcctgggttcaagtgattctcctgcttcagccttctgagtagctgggattacaggcatgcatcaccacgcccggctaatttttgtatttttagtagaaacggggtttctccttgttggtcaggccggtcacgaactcctgacctcaggggatctgccctcctcagcctcccaaagtgctgggattacaggtgtgagccaccgtgcctggccttgttctttttaatgtattaccttctcatagttttctttttttgtgcctgtttgctagatttcattagtttcatgttttaagttatccgttttccaattttaaaggttctttagcttctgtcta

SEQ ID NO: 11300 - DNA, 1025 bp, Homo sapiens
aaagagtagtgctgctgtaactcaagttagtgtgacttttagaaaacttatagtattaaaaattaatttcatttctacagtttggttttatcgaattgtgatattctcttaagaaacatggaatatattatagaatgtttgttttatgtttttctgaagaatgagaaaatgttagattttcacatttatggtatgatttacagatttgtggagtgtaaatgcaatgctctgctctgttttctttatgctctaatataattaatttgtttctagatgctggcatcaccatctacatcaggtcagctgtctcagtttggggcaagtttatacgggcaacaaagtaagaattttgtatttattctgggatactttatttaaagagaaaaataagtaactaccaaataaagaacaaccagtacttcctttgtgggtttattgtatgacttaaaaggaaaaatgtttaattttcagagttttattttacttacatagcaaaacctcattatttcagaccttattgatcctatggttgctattacttggatatagcatagattgaaatttatttcaacatcttttacatctgtaaattttttgcagtatttttgaagaatttgctaaactaaaaatagacattctctgtgttttcaattaaaggaagttaaaagcttttttagtttatttgactggctactctgtgtgtgtgtgtgtgtgtatgtgcacgcctgtttattaagtaaactcattacttagcagtttgtaaaatgttctttgtttcacaagtatttcttaaatatttcttcttttgctttagctcagtctggatatagaatctagatttttgactcacggtttaatgcttgttccgttttgcaggcttctacttctatttttttaaagtgttgtaatacttttaaagcgcttagcacagagcctagtgcatagtaagtgctcaataaatgttagctattatcacataaaatttttataaaactaaacaataaaatatctttatattttctcaa

SEQ ID NO: 11301 - DNA, 1374 bp, Homo sapiens
tgtaaacaccttggtcatagcacttatttatttttaagtagtcttttatatctctagaacaagagaagggaaagtattcttgctgaggagttagatatgagtagtaaaggacagatttgaggaaaggaatagagaaagaagaaagaagattataaatcagatatgtagtgtgtaaacagagtaaaatgcttgttaaggttagaaaacatctttgggtcttgacagaattttaatactctagaacagtggttctcaaccctgactgcacccatggaaacacctggggaatttttaaaattccactgccatgattgcccaaaatcacaattgctggagaggagacctagacattaaagttccctggatgatgcaaacattattaactaccattaaaaaatggaaaatgatattggttgcaaaaaaggcattgaaataggagtcaagaaattggatcattgtctttaatgcctcattacttgtgatcttgagcaagtcacttaatgcctagtgtgaattctttatctgtaacctacttggataatctctggagtcttttctattctaaaatactttgaatttaatgaagaaaattgcataaggaaataattttacaggaatcattaaccagctaagtgcaagacaggttgaaggtaagaagccattgagataaagcaccatttatgttgtcctttttagtatgggcatgccagtgagttcctagaggaagctggctgctttgcaaatggaaaaggggacactttaaggcatcagttaaggactactctctcctgcccctataaagattttaggggactttatttaagtatgaatattcagggatttggttgctatgattttattttttcatgtaacttaatattttttatttctagcaaaaaattgaataaagaatgacgtattttgccataagtgtttaagtgatgtgctgttaatcagtttgtgcagtggaaataattaatggaataatttcttagatcatattctttaagggtttctgaaaaatgatcaataaggaatttgactaacaccctgccagataagaggtaggaatctatttagaatgtgttcgtatagtcctcctaatattgtgttgttattatcaattgttagattgaaagaaaaatttgactcaaaattataaccttttaaactttttttaaaatttgtttttattctttgtaaaaaggtgataaccttttttataagatgattataagaaggaattgagaggaagtagtatagtgctttgttgataagtgcccaataaattttaattttactgtccttccagtcacctgctcatatacaagctcatttatacatatttatatttttgcctgttttagttttttt

SEQ ID NO: 11302 - DNA, 1034 bp, Homo sapiens
ttttacttagcatggtaacgtagtaatttgtgttataacatcaggattatttccttaacacctggagagagcctacacattaacttagttagtatttatgcctcaaaatattttgcttcatagcttttactgtcctcagccctgtcactgtgagaactatagcttagactaggttgggtggtatgacattctggctatggagatccagattgaagagaacctttaaaattgtatggaacacttacgttttttcttaatagttttaataatactaatgttggcatttaacctttatgaattgttgattcagttttatgtataaaatttagttacatggaaaaccaactctgattttgacagtaaaaaattccttcagtcttttggtttatttcttttatcaactgcttcagatagaagagaacaggaagctttgttgctattttgctttaggttttaccttctccaccctacagaccctttcctgagaaaggaaataaaggatgttatgatcataggagcaaaaatgaacagcattattggagaggattaaatgtaaaggaagtggaaggtaaaagaatgctcactgaaatggagcatttgtagaggcaagagaagatttaataaggaaatgtcatttgtagctatgagcttttaatttctaaatgttaatgtatgctcagcagcatagattaatcacacaagattaaaatctttgaaaaaagattccaaattttagcatttgtaagtggtggcttgtgttcaagatgtagtatgaaatactgtattccattctttctaaaatgtacatttcttcataatttaatgtctttgaaatcaggctacatctgcatatcatagtttaattgtagtttttttctaaatgtgatgtaaattaacagtaaagatgtctgacagtgccatcttagattctgcattatggttttatacagtgctataaaacttgagaattattttttaaattctgttttaactaagcatattttatgctaggaaaattcccaattctttcataa

SEQ ID NO: 11303 - DNA, 1048 bp, Homo sapiens
ttatttatgtcttaaaaactacctcatgacgttggtaggaaagcatttctttacatggaggtttattttgtgggacattacctcctctggatgttacttcctcagtttacaagtagtgtaaattctcattgattcttttatgaattgtaatggattttctcttagcttttgagaatttagaatctgaaatttgaataaaaagtaaatatattcagtataatttttcaaaatgctctagtttcaagatagttaaaaaattatgtggaatttacataattaattcaaatatagtttgtatttagttccttatcaaataatgcaaatagttggagatacctcaatttcttttgagtgttaagaagagcaagaaaggagtgaagtttttgcaacacattgtgtctttatttggtctgcctatgtttttatcacattgcttataaaacttttaaaatccttgtttgtataaaaagtttctttagttaaataaaagtgtgtgtattaattagtgtgccttctggacaaattaagaaatattttttctatatttcaatgcggttgtatttaataacttataataaatgagtaggaagcattcatatttatttattttatgtgtaattttttttttccggaggaaagctttacaaaatgtagaacatgtttgatgtaagccacaggaaaaagttaattatcttttcttttaaaaattgaagttttaaccgtgattggagataccacaaagaagaacgagtatggattaccagggcaccaggcatggagccaacaatgaaaaccaatacctatgagaggggaacatattacttctttgactgtcttaactggaggaaagtagctaaggtatatttctttccatgtgcaaatgtataaatctaaacttgaaaaaagaagtgtcctcttttatctgtttataagtaccaatacatccagttccagtaatgtgccacatatttgccaactgtttaattccatctccttggcttgacactcttagaagagtgtcccaaaacaattggtttcactgatagtt

SEQ ID NO: 11304 - DNA, 1016 bp, Homo sapiens
cttggggtatggctgtctcagcacaatactcaacataactgcagaactgatgtggctcaggcaccctggttttaattccttgaggatctggcaattggcttacgcaaaaggtcaccatttgaggtcctgccttactaattatgtgctgcccaacaactaaatttgtaatttgtttttctctagtttgagcagggtctgaattttttcatttatttccttttttgccagcagacagacttgagtctgtaaagacaagcaaatacactgacagaagtttaccatagtttctaaaatgtaaaaaagaaaacccccaaaagactcaagaaaattagaccacaaattttgcattgttcattgtagcactattggtaataaaataacaaatgtttgtgcatttttatgtgaagatccttctcgtatttcatttggaaagatgagcaagaggtctgcttccttcattttacttccccttctgtttttgaaaggcagtttcgccaagcttaatgcaagaatatctgactgtttagaagaaagatattgccacaatctctggatggttttccagggttgtgttattactgagcttcatctttccagaatgagcaaaacactgtccagtctttgttacgattttgtaataaatgtgtacattttttttaaatttttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaaagggccagattttcagcagccaaggacatccatacccaagtgaatgtgatgggacttaaaagaagtgaactgagacaattcactctggctgtttgaacagcagcgtttcataggaagagaaaaaaagatcaatcttgtattttctgaccacataaaggcttcttctctt

SEQ ID NO: 11305 - DNA, 1065 bp, Homo sapiens
atatctcatatttacaagttagtggattcttttcccatctaaatacaaatactgtattttaaaaatcagaagattgaagcttccaaagcagaactagagagtagaaaaaaggcaatgagttttgatcctttaaattttcatttttaacctatttttctatgaagagtaaaagtctgttggcattaaccaaatcttttgaaaatgaaacatttatgacattgctgtgtttgtgtaccaggaatataaagtggcttaaaatttacctttttctatgcattttgagatatgagaaacactataaaaaacaggattttctatctttcataattaaaccaaagcatctcctcagtaagaaagatagcactatataaatcattttatctattgtgcacaaaccttcacagaacactataccttatttgacataaaccagagtcaaagcatagaaatcaatctagaaaaaaaaagattacatttttcctagtaattcactttgtaaaataaaatgtaatttttcctacataaccacaaaaaacaagtaggaagaaaaatgtggaaggggatctttattctcatgaatataaacaacaatatagattgaagtctcagctgaagcgtgatcatgactggtactgatgaatgactccgaaaaataagatagctcataccaagtggtttgttgtcttggctgtaatctttttttctctttttttgttaactgccatatacagagttttaaatgcacacttttccatttttttgagttctttttatcctgaatcatcaaaatgaagaaactcttgcatgttagccaactttttataacttgttaatatcagaaattaccatgctatggacttcaaaatacaaattactctatttgaaatatttaaaacactactttgaactttttaaatgtaacagttataatacgccttgattttataacgtggttatacatgtaaagaggctgaatccaactaattatatttcacattttctttcaaagctttaattctgttaatttccccctatatagctagtgaaatagatgtgtacactatg

SEQ ID NO: 11306 - DNA, 1034 bp, Homo sapiens
atattttcagcattaacatcctaaatcaacatttccattttctgaggatgtttctttagcactaggcatcgctgagatagaaaatgagttctgagagactttctttggaaacaaaatggctcacccttaaatttccccgtttctggatgaaatctgatttaataatacagtattgctcttcaaatatgagagaaatcattgtaaggaagaatgtgggttttaaagaatagaatgggttggataaatgtttttataaaatagaagtgaaaggatcagaaatcagcagtatcaaaacaacaagaagaactgattaaaccatgcacttgttacctctgaatttctctttgcagaaattctacttcaattttaaaattcagaattaaaaaaaaatattcaaaggatagttaatgaacaaaaactttaggaaagtcaaacatggtgtggcataggattggggctaaagtgaatatgcagtttagaattgctagtgacattgtatcataaaagaactgagtaaagaagaaccaagaatctttgggcacatttgataaaaaataaagttgaaaaggaaatatcaaagatgtattacaaagacaaaaaggatattctataaaaagtaaggaggcacttagggaggatggatattaaaattgcaaagtgttattaatgctgtggttaggaacagcagatagtggtggaaatagtggagatctacctaggcaaaggcacaatgtaggaaaaggatgaaggaaagagaagtatttcataacgtgtgctaatctttgggcaggtgtgtcttgtatgtaaatgcctgtcataaaaggcaaacactgaaaaaagaatgaaaaaagtaaatcttataactcagattgtagatctgagttataaaatagaattaatagaaaacagtttattccctaggttatttttaaatacttctgttgatgatttaattctgaatgactaactgggaaaggggatagaaaacttgtgctagtaaggaactgattacagtataggagagcggtttatgg

SEQ ID NO: 11307 - DNA, 1059 bp, Homo sapiens
tattgggttagaaatctttataaatgtttctatcagcctttaattagaatcctagttttctctctaatccagtggcaaaatctccaaatttatcagaaaagagtccttttcaggaaggaaggagtccttttcatgaaaccccaaagaagcaagggacagtagctgattataagtcaatttttgagaagaatccatgcaaaacaacaattgtggatgacaaagtcttaggacagcaatagttaaagatacaattgataaagaaatttggttatttctatggtatacaacaatttaacataataatcataataattactgacaagaaatattaaaacatcagaatttcaggaatctcaaacaattctggacacttattaacaacacatctatataaatgtaacacaaaaaaagctaaacacacctaagattttgacaatgcttcctgcataattctaacataataaataagcctaataaggctaataagtccctcttggacttcagtgaacctaatatttgaaaaagttattttgaggtcaaaaagactgaatttagaacttgaaattttgctcttggaaagtctgccacctatcaaaggtttaagacacttgatatcacaaaataggattataggtgactataaaatagtcattcatttagcaaaatgctaaaacaagaatattcatactttaatagagaagatgacttaatttccaaaacaataagacctaataaagacaatatgaagccaactaaatctgtcttttgccctcccttttttcattcttctgtagttttattcaaaaggtaaacacaatattttattatctctcacctgaaaattttgttccaaagacaaaatcaaatttttgctttgtatggtgtattactaatgttaaatgttaataaaaccttataagcaaatctgtctaatgttaatcagtttgaccataaggtaagatttccataatctttctataccctattaaatagcatatcaatgatccaagaaaaccctgttattccaacagacaggcccagatgctggccttgcattag

SEQ ID NO: 11308 - DNA, 1032 bp, Homo sapiens
agtcttagtttcgtatctcataggattcttggagggattagtccattaaaatgtatataaaggcaatgagtgatgctggatacttttgaaatgtttccattagtattgtatattattattataactattatatatggaatcaatccaaatttgtttgcttggtgccttgaaaaccctgctctcaagcagctcacagtccagcagggaaaacagaacaaataatttcaatgaaatgtgccatgggcatgagaaatgtcctgtaggtacagacataatgccagggagcaggaagtttatggagttaagttagggaagaagtcagcagcaggttttagaggcaaagagagggtcactgccttttttaaaatttaattttttttttttttttagtcttctggtatggtaaaaaattttaaagtaaaaaaggtgtgtaatcagggttacaaaaattgtgtaatttacaaaataaaggatttattttgtaaaatttctttataatgcattatcggtagattgatttaattatgggactgagtttaaagttatatggagcatgtcttcatttcccattactgtctgcatctttgtgactctacatttaactttatttgtagataaattgaagggctatattcacagccctttgtgagggtgaggcctgggctaataaccttcccttttcccaccacctgtcacccccaggatgggtcctgggtgttagagtagagacgaaaaccattttaggggagaaaatggaatatacaggagcaaaaatataaaaaacagcaatgtgtattctggaagtcacaagtgatttaagtcaatgaagcataaattgcaaggagaggagtggttactgctaaagctggggagaaaactacaggccaagtcatgacaggcctcatatgctcatcaaggagcctgggttttgtaaataattgggtgtcactggtcaatttctgaagcatcatggtcagttttatattttagataaatcattctggtggcagtgtggaaggtggatggaagtgc

SEQ ID NO: 11309 - DNA, 1048 bp, Homo sapiens
ccattttctagctacaaaatgtgcaacggagtgagactacttgatataatttctgatataatcttataatgtgatgacagagagattctttcctctaaatttggcagactgattgtttggaatatcccaagacagaaggaaaaaaattcaaaaagtgctgttgatgcttttacacgtagttcctcatttgaccctcctaacaaacagtaaaatagttgttactatcaacatgagaacatctcttgatgttagaaatgagaacatttcttgatgactatttcagccttatcttcagtgaccttgacaagttactcaatgcctcagttttctcatatgtaagatggcaataataatgacatctacctgactaagttgttgtgaagactggtgagataatgcacataaagcactttgcatggcaccttacttgtgtaggatgcattaaatgttaggtgtaattatttctgttgatgatggtgcagttattatcacactaaactcatgcttttcaagtatgccatgttgtctgttactgttattccctaaattagctaaattaattgccctgaatgtttaaaagtataagtgtaattttcattaaacaagatttcttaatgttaaaaacaagaaaagaacgaaaagaacagcagaaaggcacctactaggtaaagaactagaggagaaagaaggggcatcttcaaatgaatttggcatcacccaacaactgttataaataaaaatattctaacttttgtttctgatccttggtatcaaatagacaaaagattatgagttttaaatgaggtttcatatttgcacatgagtatgtagcattttgaagacactgcacaaatctccaggatagctgagggctgagtgaacactttgtcacagagagtaggctgatggcacaatgttaggagtctactcctcagatagaatttaatgaatgacccagaatttgtagtcctgggtttgaattgcttttatcctttcctttttttttttttttttaatctcatccaccctcatgactttttctgactgt

SEQ ID NO: 11310 - DNA, 1088 bp, Homo sapiens
ttgataaatggtagctactatttatatgtccaaaagcactatatgtggcatattgaaagtgctctaagaaattgctgaatttaagtttgatatgtaacaaagaaggaatattcctcagctgtttctagtctggttttgtgactagctatcttggaatagttatgccagatctgaagcaactgaggcagtatggccagctgcctttggaaacaagatcaaacgatcaataaatatcagttgagctccatactctgtgcatgcaataagactcttgagcttaggagtctataatcagactacttataaaagggtaccaaatgagctaggcagagtggtgcgtacctgtagtcccagctaccagagaggctgagttgggaggatggatcacttaagcccaggatcttaaaaaacaacaacaacaacaaaaacaaacaaacaaacaaaaataacacctttaaaagaaagggtagagggtagaaaatcaaccattataggctacattgtatagaatgtatcttataggagagctgttaaccgagatggttaaggaagattccataaaggaattaaaattgaacttccttagtctggttaaagaaaccacaggggcagggcacggtggctcacgcctgtaatcccagcactttgggaggccgaggcaggtggatcacgaggtcaggagatcgagaccatcctggctaacacagtgaaaccccgtatctactaaaaacataaaaaattagccgggcgtggtggcgggcgcctgtagtcccagctactcaggaggctgaggcaggagaatggcttgaacccggaaggcggagcttgcagtgagcccagatcgcgccactgcactccagcctgggcgaaagagcaagactccctctcaaaaaaaaaaaaagaaagaaaaaaagaaaccacagggccctatgcacattaaagtatctccttattgacttgaaagagttcatttactcagtccagtggtcttagtccttaacaattcttagcccatgaaccttgaaatctgaatgtttttattatatcaaataatgaaagcaaaatgcacagctcatgaatacacagtt

SEQ ID NO: 11311 - DNA, 1032 bp, Homo sapiens
tgaatggtgcctcacaaataactgaatttcctgatttaactggaactgcaaacctggagagtctgtaagtactgagtagactcttgactttgcccagaacatacactgccattagagcttgatcagtcttaacatcagtgagtcaaaatatgtcactgtgtgatgcctgaatgaaagaattatgtctggtttgtgttttaacaggactttaactggagcacagatctcatctcttcctcaaaccgtctgcaatcagttacctaatctccaagtgctgtgcgtatcagtaaggcaataatgttgtgtaaacaggcaacttccatttaggggtgaaatggcagacatgatttcaataatctctttaaaagaggagaaagtttttcctttcaggtctgcaggaggtcaagcctcctttgccctctttggtccaggctctctgacatgatcctggtaacaaatggtaatgtaccctttgttttctaagtcccaaacaagctcccactagactttcagttggcacatgttttctttcagaaaagatatgaagaggccaaaatcactttatttccccctctaaaggctttgcagagcagaacaaaataacataatggatcaaccacccaatatggatgccaaaatcaaaaactgagatctcagatccacacaatccttgataaaggtgatcaaacatccttccagtatagttgtcaatgccatgttctaatgtttcctgtaatggttaaacagcttgcatatgttatttctattgacttgggacttttttcctctgcctttcccatgtgttatgaaaaaaagtagtttacatggattcaaggagacttgttttgaccttccatttttcagccttctccctcaacttccactcaacacaatcattgtcctctcaagcatgttgggacttaataaaaggactcttaatcttttgccatggctctgcactcacatagaaggcacctgtggcaattgagcgcctgcaatttcactataagctttacttagcagcactcagaa

SEQ ID NO: 11312 - DNA, 1047 bp, Homo sapiens
ttctgtttcattttacaagaactatcctgagtttctgtggatggaaacattacatgtaatgcagatatagtgaacactggaaagatttattaaagaattatatttgtgtatactttataaattagtccctcattagatttttttttcttaagcataagactgaacttaaatgtgttaattttagtagaatcaggcactgctcgcagaaggaacacagattgtagagattaacataaattgttcttgttctaatatatatattttttcatttctgtcgtgcttggaaaactagtaaatattatgtctaagataaaatggaatggcccctggatttacttcttataagaagcagtagtatgtaataaagctattagcatgagcaattaagaggctataaagagattatagttacaaaagaaatactgccatatttttaagttaataacttaaaccttctcaaatgggttaaaagttgaatgaattgacaccctgatgttatgatgttggaattttaacttaaactgggaggcattctgtgagccttcactttaccttctttaattattgtccttgctaaactcaacacagacttttctgttatgtgtttttgaggaagttggggtgggaagagtcagggagataagctaaaattgtcttcttttatggggtaattgtactctgtagtctcttggtttcctgtgaagttagtatttatgtgggggtgggggaaggtagcaagaatcatgggtatcacggtactttgtttttgacctcctggctctttcagacagagtgaagaaagcttttccattcttactgttgtagaagtagataggaaataagcttttctcattacagtgaaatatgttttaaaaactagagtagctgggcacagaggcatgcatttgtagggccagctacttgggagagtgaggcaggaggatcacttgaggccaggatttcaaatccagcctaggtaacactgagacctccatctcgtaaaaggcacaaaaactagttagagatgaaattgagctttattttaaa

SEQ ID NO: 11313 - DNA, 1035 bp, Homo sapiens
tgtgtgttcttctcttttctctggtactttctcctgtgaactctagctgtattggcatcccctatttcccacatctctctcctcactggacaccttctgagttttctctccctttcccatagctgggaacacacaacataaagctagacaattgtattgctcacttcatttggttcctttctctcaatagtcactatccttcattgtttgctggggagtatcatgaaaactattgtttcacagattggtcagtatttttagtttagtttattattattattatttttctggtgggaggttaaatccagcctgtcattccatcttggccagaagtggaagtttttatatagggtttctttttcctttctgtttttggtggaattaatacctatctcttctgtacatcttttttccccttcaatcgtaggctgaatgtttgtgttccaaatttgttctctttgttgttatgaactcttaagatggttttttctcccaagattttaccatttccttcttgttggcctgcattaattctcttttctgttctgtaccttctgacaggcgacattatcagcaagatattcaagaattttaacagatggtatgtatttagagaatgtgccagtagatgtttggatagctgaaggtcatcatcatatacatagagtggttttataccagtttgtaatttgtattaaagtgtcttttttcttccttctcattgatagtctgtataatcttccaaaacaattgcattcctctcccccccaccttcttttgcagattcgcttggtgacaggtggtgctacttcctcaaatctttgatctgttcttccctttctttttctcaaggtatattttttcattgttgaatttgtatcatgttttccatcagacaaaattccttcagtacccttgagatttgatttagatcctatttaagactttacattttgtgtattagtccgttatcacactgctataaagaaatacctgagactaggtattttataaaggaaagaggtttaattgact

SEQ ID NO: 11314 - DNA, 1031 bp, Homo sapiens
ccacgtaccaccccttgtctcctaagaaacagttatcctaacttttatcataatcactttcttgcatttctttattagtagtagtattaaaacatagctattgtgtcttttttaaaaaatggttcttccatatcttctacttagtattactgggtttttaagagttttgtttttcttaatcagttgcaccttttgtcttgttattgtatgtggttttttttgggggggggtatcttgttcaaatttcaatttaaattcatttaatcaaatacattatttcttgattttaaaagattggaccatacagaaattatggttcaccctgcccccatactgccaaaccacccaacttgattttgacactatgtatcctttgagcagttttcgtattcattgttctctgccagatgaactggaagatgaaatgaaaacgtcatttatatccccattagagatgtattttagataagtttttgccatataatttgttcccttgtaaaatatctcaaattagtaagttgttaggcttgggggtcttatatagacttttagtaatatctcagatatggtctgggaaactgattaggctattccgtttttacatattgatgcctctgtatccctaaggtaacagtcatgagaatgtattgcctatacattcttttgctgttttagatgcatggtgctgattctttgtagaatttggcttcttatgggaggagtctccaacatgttgcatgtctctggtagtgtagacttttgtttaagtctttttcttcttttagccttcaatttgccagattcctgattgtaatttccattgacctttaccttcttgggatatatatttttttcttttttttcctgacttattttttttctactgttcctgtgagctcttcattttctctcaaatcttaggtagtagaaaggaagaaagggactgctgatgctctttctttgcttcctgtagtacagaggacctactcatgttcacagcactggtagttggtgaatactacagattggga

SEQ ID NO: 11315 - DNA, 1035 bp, Homo sapiens
atttttgcgttagagatcatgaataaaactagagtgaagaaattgaaagcttattctactaacaaatgttatgtgagatgaaattattcacatcataattgttccctgtaacaaaataatttttttgtgacaaatatgcatagagataacttttcaaatatcaattattacaattgataaacataagaagcagaatgttctatggcaggatgatactactcaggaatcaattcatgacagagtaattaagaaatatcttcattatatattattgaagttttagttggactttaaaaaatctagattttgcttttatttttaattggcacataataattgtacatatttatggggtacagtgtgataatctgatatatgtatataatgtgtaatcaaatcttagtatatttatcacttagaacatttattctttgtgttagaagcattcatgatctgctcttctatttgaaaatatacaataaattgttaattatatcatgtgatagtgctgtagaacgttagaatttattcttcctgtctagctgtactttagtattcattaaccaacctttgtctattcccctttccacaacccttctctgcctgtggtaactgctgttctactttctacttcgttgaagccaactgttttagcttccacgtaagagaacatgtggtatttatctttctgtggctggtgtattttacttaacatatatcctcaatgctcatccatgttactgcaaacgacaggatttttttcatttttatggcttaatagtataccattgtgcatatatgcaacattttctttctttcttttttttttgagacggagtttcgctcttcttgcccaggctggagtgcagtggcgtgacctcggctcaccgcagcctccatctcctgggttcaagcgattctcctgcctcagcctcctgagtagctggaattactggcatgtaccaccacgcatggcttattttgtatttttagtagagatggggtttctccatgttgatcaggctggtctggaac

SEQ ID NO: 11316 - DNA, 1058 bp, Homo sapiens
gatgaacagatatgtcatatgaataaaacataagatcacacccttaaaaaatagattgaaggactacaatattcaatgaatgatctaaaccaagatgatatgaaaagggttaagcttcttgtgtagaatatttaggagttcagatgagagtaagggtttttgtttaaaggccaaatgctcctgcattggtttataaatgtagacatttaaaaattggtttttagttctgaagcagcattgttttctgcatttaagccatttcaggaactgttgtcctctagggaagccatgtggaaattttctggtagtttctttaggcaataacagttatgatttaatggatgaatgtgtcaggaaatctgtgattggtgactttactgaagaccacatatttatccaaggaaagactggattacagatttcctggcagttctttcctcaatttattcttttcataaaatagagatgtagataacaatactggttttgacttattcagggtggctgtgaggatttaagtgagatcagggtactttggaaacaaggtgctacaggttgattatcccttattcaaaactggggacccaaaagtgttctgaattttggaatatttgcagtatactggtggaggatccccactccaaatacctgaaatccacaaagtgttcattaaaaacaaaaaatcatttatttattctttagagacaggatcttactttgttgcccaggctggtctggaactcctgggctcaagcagtcctctcattttggccttccaaagtgctgggattacaggcgtgagccaccgtacccagccaaggaagtgttccaaggtccatttcctttgagcttgaagctggtgcacaaattttggagcatttcagatttaagatttttggattaaggatgctcaacctatatttaagttaaaacaattatcactaagtgattttatattggaagtaaattatgtaccaatgcaactatttttttcctgtgcccttaagtcttataaaatataagactttgtaagatttagtagctattacaaattaata

SEQ ID NO: 11317 - DNA, 1034 bp, Homo sapiens
atgatgatttttctgtgtgcattgtctgtttccccatccatttaatctgcctcatcctataactccagaatagtatcccccaaagaatggatatcccaggatatatttgataattttcctatttgtgaatatttagatgcataccctccctttcctcctccccttctcctccttctccttcctctaacattataaataatactgctgtgaatattcttatgcatatttttgtacatttatctgtaggctttaaaatttttcatctctgtacaaacagtatagaattatctcccaccctttctcagctcatcctatccccatgtaagcttctgtttatatgctggtctgatgcttaacagctatttcaggaaaggccatcttacttaggtttttgaaatcaaaacttccttggtgatcttaattacttaaaagactgtttcctgacataagtccatatcacagttgattaacataacacatccgagagaggcagtaaaagtaatgtggaacctttataatgtagtggctaagagcgcagttttctgttgtcagactccttgggtttcagtttcatcaccaccggttattatttgcctcatttgggcagttatttcaccactttcagttgtcttattcacacaaatgggcttctcatcccaatgatgtagtagaatgtagttatataatctgtgatttagggtggttgtaaggattaagttacaatataaggagttcctagtgtataagtgttccgtaaatgttagctaaaaacaggaagatacatacctatttacatttatgaatgaaggagtgatagactctgatagtgcttgtcttgcattgctgacccatgatattctgaagactaatattaataaaaggtctacagaaatagaataatatacactattgaccagacttatatatgtgaaaagttcttaggtctagaagtgactgttttttacttattttcataattaaaaaaatttttaaatggtttgaaatgggtctcaagaatggaatctcaatttata

SEQ ID NO: 11318 - DNA, 1059 bp, Homo sapiens
atgttaattctatttaaggcatatagagacttactgaactgttctgctcttacaagaagagtagagttgtttgttcagttcttctgctattatatttagtattctcatgttagtgtgttggagatagtttttacatgtatttggtaacatagtaaattcattagaactaattaattttctttacctttgctttgagtagaaagatattttgaattcactcttgatttccgttttcctttgtaaccatttctatttctggctagctatttgcagcagaatgctttgcagtttagttttatgttgacttgatactaggttgttaattcacttattcaacagatagttcatctttgactacttactgtatgctagccactcttctagcactgaggatatggctgtgaacaagataaagttcctgttctcatgaagcttttattctagtggagggcctagaatatttgtcagggctttaaatttaaatatttcttcgtcacagctttaaatgtggaaatgtgtgaggcattttcttttgtatgtaatatatgtctcttctgttaatgagggaaaaatctatgtaaaacctttactcttgaatatgcataaactcctgataattcatatagcatacatatagtatttaatatacttcatatgattttcttgcattaatttagataaaatactctgtgcaacgaagaatttaatttaaaaaattgtctatatgtagttttttgggtttctttctttttttcttttttttttcattgctgtttttctgtgaaatatttttggtctttgcagataagccagcagtatgtatctgttctaggtagtctaagtacattcatacttaaatgattcatgaataagttgaaattctagaactgttctcacttagatatcagcttgaagtggtcttatgagctctaaaatataaataccagtgaaacattatgtaaagtagtcaagtgggcacatggcacttaatctggtatctcttacatgtgagttcactgtccaaactggtgtgaaagctgctggtcattgtatatagat

SEQ ID NO: 11319 - DNA, 1044 bp, Homo sapiens
tgacacagggaaaaatggtgtgtcacccttagatagaaaggttgggggagtgcctgcggttgtactggacatccacactcttttttaatatccacagcacctctttcagccacctgggaaattacactgtttatgaaatcaatgtttaaaagaagtgattgtaaacaaaagtcttctaagaacgatcaggaatcaagaatcctatcatttttgcctaatgtgattcaatccctattgatgaaatcaggatgttagaataataggaagtgaactattaagtatgcctctccctctcaaatgatctagatagtatattgcccctcacataccccctctctctgcaaaagatgacagaacgaaaagaaattccagtaagctttgctgtgatcaatgagcagcagtcagtttagcttagctttttaaattaaaaagacctattaacttctaagatggacttttactgtgacagtcaataatgtgtccaatatcacactagtctgattggaagcacaggacccagtacagtaggttggtagactgctttaaaaatagaaatagagctatttttctatggctttgagtgttgttttccctgatcatgtaggtactagaatcccttccattggtgtaactgactcactttagaaagcaagttgctctccagtaggagagccatcaaggtacttctgaatgtcagcattaacactgcatgctacctacagtcactgtcaggggcacgaatatggagtacgtaccgaaagattttggccacatgttttgttagctaagtcaagtcttaaatgagccaaatgtagtatttgctgactaggaagtaagtcatttgaaattaacagtatttaggctgtacatggtggctcatgcctgtgatcccagcactttgggaggctgagacgggaggattgcttgagcccagaagtttaatgttacattgagctatgatggtgccactgcactccagcctgggcaacagagcaagaccctatctcttaaaaaaaaaaagttaacagcatgtaaccctaatag

SEQ ID NO: 11320 - DNA, 1022 bp, Homo sapiens
gaatgacccagccctgctctcaactcttcctttatgattcgtgggtaaaatttgcagaattcattcattcaaaatatttactgagcaccacctattcattcatatgtacagattatggagcaaagtgtcttatgtgagggcatgtacgtttgtgtctcgtgtgtgtgaatatatatgtgtgtgtgtgtatatacacagacacataaacaagacacattgtgatagaaacataatcatgaacaaaaaaatgcacacatattatgttcatatgtggattttacaatcagaaacagaagacagtaatgaaataatcataaaattaatggaaaatgttagtttatcagttataatgattgctgttaaggagaagtattggctctggcagtatcacaggctgtctgggaaatctttcctgagggagtgaagtataagctgaaatcctaaggacgatgatgaggtaatgtggtgaaggaaatggatggacatgatgtggggagggaaaagctttccaagaggaggcaacaaacagcatacgtgacttggaaggatggacaggtcatcagcagagtggccgtggatagcattatttctttcctagtgtgtgtttggaccttattcatgccttgtgcaaatattaggtccatatgggccagcttcttgattacagagagttacatttaagccacataattatatggggcttaattaggaaaacacactgtcaacaaataattgagtctgtttatgactgggtttaccagaccaaaggggaaaattatagaatatcaaatatgagaaaatatccaactttaacaatattagctatgtataatacactacagatatccattccattcaactgctattaattgagcccctgtatgtgatatggaaatgtgccaaaataggggcatttcccttcactaatgcccaggctagctgggagacagatctgcaaataaatatatcatgtactgtcagaagatttagccaaactgagattttagccaaactctgagaag

SEQ ID NO: 11321 - DNA, 1006 bp, Homo sapiens
cctctgttgagattggaattggaagagaacttaattttttgtatttaaaatgcagtgtcatgcctataagcatttctcctatataggactgctttgctagtgtgccctcttgctgtgtcttacttcataaggagttgtatcttcccacctccatttcaatactgccggttaggacctaagtagaagagcagtaaaggctgattgacacacagggggatggagttggtccttgtccattctctcacccttgctgtgcatgtatcaatccttatcccagaaggtactatttagactgtatagactgatttagattacatactttagaggattaaggaaaccatagagtttgggccttggaactgttactgccttgtcctagagttgtcctgatcaggcttggggcctagttacagattagtcttaaagaattgcattaacttaaaaaaaatcaaaccttggcaagagctaaaataatttggagatatctttgcccttgacttgtagacgacatctaagaggatgaagaaaggagagtctaagtgagactctggcctacttcctaacaatgtcttggaagtgggatgatggtaaaggagaaaggccacagtccaatccctctgccttcagatagggaactcaaatcctgaaattactgttttctttctggccttttctcctggttagaggaggaagcggaaagtagttttgagtagtattttgttcatattaccccccttttgttttttgtttctggcccctctaccaatagggcagtagcctcctgccctggatgggtataaggtgggcttggtccaacaggtgcccagagggtacatactcctttctggggagagaatgctccctaccatatagttgacagtggttaggaactctccctttccctacctaccttccttttaatagcagaattcctatttttcccttgattatgtgtattgatcaccctgcaatcctattatgtatctgagtgtgtgtgtgtgtgtat

SEQ ID NO: 11322 - DNA, 1029 bp, Homo sapiens
cagtgaatttctcaatagtaattactgccttaattataacagtagctcactgttgtcaaaagaaatggtataggacaatggtggtaaattatttattttattagcaagtcactgaaatgctaaaatcaagctcaaactttacactgtagaattaactccataaaatgtgacacacgctaaaccataatcttaaaaaaataaagttaccaagcaatttatgttagttatattaccaatcagctttgtttttgctaatcctaatataacaaattctcaggaataatagactaggactctcagggactgagtaagagtagttggaaggatctaacaaactgcactgctccccagttcccgaacactcctacaaccagatcttttaaaaacctttattttctaatgcttaaaaactgttacaaatcgtcccattaaaatagaatcctagggttcactgtacctgaaactataaaaagcacgaagtccaaacaaaaaacaatgttttttagaaaaacgtccactgaaattatgtgtactgttcacaatgccagtgggactgaaaaaacaaagttatccagtcaataggctttatttattaaagactttaacggagagaaacttgatattcaaaaacaccaactcttactttagctatcttaaatttaatagaaagcagcactaattttgctcacctttgggtcatagtctggatcattttcctcatctccttcttcttccccttcctatattaaagttcaaaatgcatccatgaagtatgtacatagtaggtaaactggctcataatgtagggaaaatttaatacaagttactctacggatcaacagattttcatgattacagactttgatgataatacaatttaatttgaaagcttctaatatgaaaaatttcccaacacaacttgagacatccagacagcttttattgaaaatagttactgcagccaacgttggaaaagtttactgcagcttttgacttcttcaaagagctgataaccctgcagcagaacaa

SEQ ID NO: 11323 - DNA, 1031 bp, Homo sapiens
ctcgttgcccaggctggagtgtaatggctcaatcttggctcaccgcaacctctgcctcctgggttcaagcaattctcctgcctcagcctcccgagtagttgggattataggcgggtgccaatagtaaatgacgtatagagtgattcaaggaccagagggtttaaatgaaaatgaaatataggcctgcgcctatataaatataggcatatgccaccatgcccagctaattttttttatgtttttagtagagatggggtttctccatgttcatcaggctggtctcgaactcccgccctcaggtgatccacccgcctcggcttcccaaagtgctgggattacaggcgtgagccactgtgcctggcccgaattttttgtatttttggtagagacagggtttcgccgtgtttcccaggctggtctcaaactcctgagcacaggcagttcaactaccctggcctcccaaaatgctggaattacaggcatttgcctctgcgcctagccaacacaaatgtaaaatgaactaaatgaactacttgctatgttaagtgcaacacacggagtgtagagacaagttggatattaatgccaggtaagagaattcaccctgaattgctacattttcagtgcagtgtctcactgttctctaatttaattcctgagtctcaaactttgagggtaaaggtgcactaaacgtacctcttggcaaatgcagaatggttgtgtgttaaaatcaacatgggactgacactgaagtcagaaattgccatcatataatgaagtttagggacacaagaatgaatctggactttaagagtttgaattttaactataattctattaaaaacttgagtagcagcatcttaagatttaacattatggtgtacaaagaaagcgttcgagcactgtcagctgcgtgattgcttccatgtcagtaaaacacttatttgtgatgctaagtaactactgactttcagcgggaatatatgctagaaaacacaatttttctgcaatgtatttatattgactttcaa

SEQ ID NO: 11324 - DNA, 1069 bp, Homo sapiens
tgttccagcacaccttttcttcactcagttgcagtctcaaccttgatgttcatcatgtttcctaggtacactggtttattgatctgtctgcctgtattaacactgtataatctaattactgtagttttgttcttaaattatattggagcagggtaatttttccaagtttgttatttctcaggaatatcttagctctttttggccttttgctcttccatttagattttttttttagaataagctctttgagttccgcgaaaagccttaggccttttttttttttttggcagtcttgctgtgttgcccaggctggagtgcattggcgcaatctcaactcactgccacctccacctcctgggttcaagcaattctcccacttcagcctcctaagtagttggaattacaggcatataccaccatgcctggctaatttttgtatttttagtagaaaaggggttttaccatgttgtccaagctggtctttaactcctgaactcaagtgatctacctgctgtggcctcccaaagtgctgggattacaggcatgagctaccatgtccagccagtcttacgccattttgattgaaattctatttgagctgtagattaatttacagaaagtaactacttttgatacttagaccttttatgttttttaatgaagtcatataatttcttatgtagaagtttatatctcttgttagatttatttttaaaagaattttaatttttttaaattatgaattttttatttttaattaaaatttctgtttgtgtctgggttatagaaatgtagctgattagttattgacaacaaccttgctaaagccttttattatttctaataacttggggtattttggatatatgacatggggtaatcatatgtataaagactgaattttgtttttctttctactctttatagcatttagctcctttagtcatcctattttattagctaggatctcagtacactgtggaatagacacagaatgagcatcctcattttgttcctgactttaaagggtatcatctttaaaagattgactttaaagggctagtatttt

SEQ ID NO: 11325 - DNA, 1036 bp, Homo sapiens
tacttactgcagagaaagcagcagcggtggaagctcctgccatcacactgcacctcttctgcgtggtacacggtcctcccacaggccccacacttgtttccacctccccagacaggcattctgaaggaataaaggattcattagaatgtccctgtgctggtcgtacggctccctagagggctatttaagcccagggacagctgcagattttcgtttctttatgaacctctctaaccacatctttcaaaggcctgcgttcctccaaaataacctcatctcctctcccaaataacaactctttcattaggaaactggcttgtcgtgcacaagattttttttttttcctgccagacaaaggacctgcattcagtacaatagtacaggtcaccaggcacaaaacaagctatgccattagaatccacaggagttaagaaagaagcgtggggaggggaaaggcaagccttgtccccctccctaatatgcccatttttaataaacatatttttttgaactcagctgaagatcttacccttgggtggaggttttcattacatgtttaattaattgtaacaacactaaattcttaacgtttaacatatataagctataacacgctttctagggaacaaagtgtgttgccctgcaagaacaagttttatatttgtttgctgaaattacacgattgtagcataaatagctgtgtctgtgactcgtacaactgcatgcacggaacttttgccgtaaccacaacaaacgcccatccagatggctccggcttaagtttctatgcttcactaaccccaaggcccactagtgcagccagcagttgggttttcctctttggcaagtcagtcaggccatacagaatctgctacaagttcccttcctaccagttgaactgtttgctgagcatgcaggaatagcctctgaatagtatggcctgctgtaaagggcaagctggaagtacagatcctagggtgtctcactgtcatgtagggccaacattttctcgtctcccttctcaacaaattagtct

SEQ ID NO: 11326 - DNA, 1050 bp, Homo sapiens
ttctgggctatgcagattagaataagcaaaatgagctctctggaaaaccttttctgtaccagggaagagatcgttgcttaatcgctcctacaactatttgtcatcttttatgtaagtctaggccagagtttcccaacctcagcactgctgacattctgggctggataatgctttattctgggaggctgtcctatgtactgtaggatgtttagcagtatcactggtcccatccacgagacatcagaagcattctcctactcccagcaaccaaaaacatctccagatttgccaaatgttccctgggggacacaattacttctggttgagaaccactggcgtaaaccttagtcttttgtttctctgatggatactgccccctttcaggtaacagtggacttttctcatttattctttcttactgccattcattctctcggctccctccttttccctcttgtactgagaacaaccatttgctcaggttgaagtaattactaaagtgctctctgtcagtgcaaagatctagaataaaagctattttaaaagtactcaatgattctaaaattctcaagggccataacaatcctcagaaagtcaaagtagtaagtattcttgctcttctttagcttgttgagggaatgattagatgttgtcaaaattgtgaggcaagtgatatttaagacaaataccaccttcactttttctttacttcctcatgtcttgtgatgctccctttctaaaacttcaaatttatttatcatttatcctctgtatgcacatttttcttttagtccttatctcatgagtcccacatgtatgggatcttagctcattattaggagaaacaggtgatcaatctaatttatttaaaattggaaataattcctaggatttactacattgcttctctttgcatttgtgttttgttaagacaaaactttgtaactcaaaggaatgagtctcatggactgtactgaagtgaaacgaattttcagcagatgggaaagatagttttagacatgagtcttcatttacctcttaactcatgtg

SEQ ID NO: 11327 - DNA, 1076 bp, Homo sapiens
acataagacacatctgtccagattgtagtacaactctgattagcccatttatcataagagaaccctcatttgcaagcaattactgattgttagtgtgctattccaccaaagcgctttgtttcataataaactgacaaagcgtatcttaatctaatcttttgtttggggactctttttgaaataagacataaacatagtggttttacctgtggtcagcctagagaaccttgagtactgtctgttcaaaatagtagttgtagtagctcacctttatggaggacttcatagctgccgggttgatcaagtgtttgtttactcatttcatcttcccagcagtcctacaaggtaggtgctactaatactctcattttacatataaggaaactgagatacatgatcatattgtccatgatcatatatctgatatgtgattgtggctgaaatagattaataccaagattgttcagacttcagagtccatgtttaaccattctttgagtacatacattatttttaatctttcaaaaacccttattgaagtaacatattcatcattatcatcgctgcataaactgtttaaaatgtccttttctttggactgaaaggacaacaaattttttttaaaataaaggtctgagagggaaataacaaatttgagatctttggtggggaactgagataaaactaatatttaaagcagaacctaggaattgaaacccatataggctgaatccagtttattaaagtgttagtttacacctaacatggttaaacaaaatgaaaacaacaaaaaaaacttaaaagttggctatctttggtcaagatgtgcagttgctagctcatttcactttccatctaccttacttcctcctcattgagtgtgtcgcccctggcttaaagagaagctccaaattagtttcctgaagtctttgttgctgttagtatttcattcaaaatccaggatttcttttgtcctattttctgtttactgcactttcttccaacaatatagctttaaatactgtgtatggtatctagttcttgaggttaggaagttgtattcaccatctcttctg

SEQ ID NO: 11328 - DNA, 1030 bp, Homo sapiens
aaatattttctaggtctatagcctaatttgtccaagctggtagcaatatttcctcagctgcatagatccaaggattttagaatgaactgggagttctctattttaagtctcttcatctggtcatttgtcaagtcccatcaatcctccctttgaaaatcttggctgtatttttttctggcatgcagtgtgacacaggagaactacccctagactgggagtcagagagtctggctttcgtttagctttttctccaggcatttgtatgacctccatcaagtcacctaacatttattggcctcagtttccccattttcaaggttcttccagatcacattctgtgatttttcctgaaaacatatttttaatatacatacatagaagtggtaatcacatttttatttggtgtccctacctgattctctgccttctaatacaggacctctgaccactggcatataaatattttggaaacattgctttatctgcttccaaatcttgcaatactatttatgttctggtaatcctttgagtttcacacagatgatttgtgtacaattctatgcatgggtgtcatgcttcaattaaagaatcaaaaccaaaaccaaaaaactcttaaatgctttcagtggcctcccgctgaaatctgatacatcagacttgcatttaaggccccctcaacaacctggcatcactttaaattcccatttaagctcctacaactccagtagttccagagcctggctacaaagcaatattacctggagaatttttttctatggattaagagacatcaaatgtggaacggaaaatttcttttattccttctagttgattctgatgctgctaatccactgttaaatgtttgaagagcattgtatctacctcagtatgtctttatgacagtgatgcttaaacttctgtccacatgataatgacccagaaggattattaaaagttagcttatagggcccgatccctgagttgctgatttaataagttagagatggggcctgagaatttgcattttgaa

SEQ ID NO: 11329 - DNA, 1032 bp, Homo sapiens
cttacaagaccagtgattctatcaggttttgttttcctctgccttgggatagatgtgttgccagagtcatattccttataatactgttatttggctccagttttatactaaaaccaaggacatagtcaggtaatgatttgtgaaagaagaaaataaacttataattgctggcaagaatagaaaatcttttatcaaaatatttaaatatgatattctgaataatttttatcaatatcgggaaaagtttttttgctgaattaaaaacaattccaaacctgaataatttaattttccttcttttctcagttagtgatgaagctcagcctacaggtggacattttcatatacatatgaatctcaccatcttcatatttctagtcttttcatttgttcctgaaaccacttatgcttactgtttttttaatctcaacaaagactatttctgaaatttatacagatcacaggtctcttaaatcacaattaataatttctagtttatagctttctaatatggctcttgtaagatatgaatgaaatacatgactttaatttaatagaggccacatatattttgacctctttgctcattcatacctactctgtaccaactgtgtgctggggataccagggagcacaaagccctctgcttacgttgatgggatcttcttttcttttcttttcttttttcttttccttccttcctcccttcctccctttctctttccctccctccctgtgcctttcctttcctttcctttcctttcctttcctttcctttcctttcctttcctttcctttcctttcctttcctccctccctccctccctccctccctccctccttccttccttccttccttccttccttccttccttccttccttccactctctctctttctttctctctttcttcctttattttctttcctttttctttattttctttctctctttctttcttttcctttttcttttcttcgtcagggtcttgccttgtcactcagggtggagtgcagtggcgtgaacacagc

SEQ ID NO: 11330 - DNA, 1031 bp, Homo sapiens
caaggatgaaactcattaattctagagtagctcatgatacgtaagtcaacctgaaacacagaaaaactatctttatatggaaaacttttaaaaagaaaagtgctgcaagataatgttatttgacatttgaagggaagagatacatattccattgttcaaaaatgatgcaaaatctgctccattacatgagtaatattatatgagccatagtctatacaacataaaaatacacaagtggacattcttagtgttctaataacatacatacaattttaacctgaaagatcaaattatatatataattgtcattggcaattaggcataatagaactaaatgttttagaagagattttatttttttggtaaaagatttcaaagtttaaatagaatcaactttcacttaaatccatttaatagtttgtaatattgtcctatcttgagtctcaattatcattgtatttaatcatcttataataagaaggccaaatatgaattaagcaatctcctaagatatctcataaaactgtagcttttttgttgttattgttcttacctgaatacatccaatagtaggcactgattacttggtaaggcaattttttgttccaggaccattctaatcttgagaaatgtcttcctgttttctgtgggccagaaaagtttatcatctttctttagtaacatgttgccatgattttaaagagattaattatctggggccagcccatagttccttcttagtagaagtacagaaatcccgcggggggcgggaactgacttacctacacacttccacataacatacaatgggttttgccattaagatcagctttaggagtaagaatccaccaatttcatggagaattggaaactctccctatccaaattatctaacttgtatgttgacagtggtgtcccggtggtaattgaaggaaaacagttgtaatagtaatagctaaattgtcttgaacactcactaatatcagctttacattcaatgtttccttcaaagtcatacaatttatgtttac

SEQ ID NO: 11331 - DNA, 1023 bp, Homo sapiens
ccatgtcacagaacatggcttattttagtgctctgccctatcaactaaccaataaataaattataaaattcaaataggaagctctgactcagcaagtaatttttggaaattcatatctcgtgtttttcatctacattagcatcattcaaggagcagtagcatgctcttggctgtggtcctaagtgtttttgaaacttcatttgcaacattctctctagaaaggcagcaaacaatttagaggcaacatgatggtgttatttgtcaagaagattcttatgtatatctatagtttcactttctgagggttatttttaaagagtctggatctttgacgtatttttctattttttgtctaaaagtgggagactaatagtgctgaccaaaaccaggataaccatgatgtaaacggtttctgacagcccttctaatgacaagttcaattttgatttatatcacctttccttttcttttctaatccctccagcctggaagaaatagtctactttggatggaatgtatatctatcagaatacatgtgattaatagcaactggaattaaaataatcacactctcaatatttgaatttgtgtgttttagagaggataggtacatgtaatgcagggttcagtgtagcactttggcccactgaattgaggtaattcaggaatcagtcactgtcagtagttaatatattcaatattagtgagaatgggagaggggaccatcacaaggtgtagaagcttgctaatatccctacaaagaattcattaacttcaatatgatgtgatttgagagaaaacgttctaatcactacacattttaaataagcacttgcacttaataggtgccagggtgccgattatacaactggatattatttcatactaagaaatgctaactattggaaatgtatcagtgaagttcatggaaatatacaaaatgtttgaagtgtgaaataaatgcaaacattaccaatattagatcagattatattaaattggattggggcgtgttagaatata

SEQ ID NO: 11332 - DNA, 1026 bp, Homo sapiens
aaatttattctctcacagttctgaagactagaaatccaaactcaagatgtcagtcaggcagtgcttcctctgaactcctttagggaaggctccttccttgcttcttccagcttctggtagccccaggcacttcttaactgtggcaacataactctaattgctgcctctgtcttcacatggctgtcttccctcattgtctttgtctcttctgttcatttaagaacaccagttatgttggacttaaggcctaccctactcaagaatgacttcaccttaattacatctgcaaagaccctatttccacataaagtcatattcatagataccggggattaggacttcaacatatctttttaagaggcacaattcaacacaaaacacttactcagctaggtgctcattaaaacactggatttctgccattctgaatttaaaaggtaatgatttaattaaaacatcagagaataaaatgacatattgttttacagtttacagttctatatataggcatatatatacacagctgtcattatttcattgttatctgtagaatttcttattctgtctttaaatataaaaaggattatcttctatgaacaataaaaaagataaactaaatttaattaccaattaaagatggggtaaaaaagagcaacaacactctaaaacagaataatcatggatattgtgtaacctctctctttcgtagtttgttcatactgggagactaatgaaatagaatgataaaatcttgtccagagatgaggaggagtattaaatgacatcctgttcatttaatgtgaatataataaacttcaaagtcaaaaatgtgactataataaagtttgaaatttttgaaaatatgacacataagcataaatacgtacataagattaacacattttatctataagttatttaaatttatatacatatccaacctgaaaattgtttaatatttgagttttttatagtgtctaagaatgcgtaaatggtatgcaaaaatattttcaattttttgcttac

SEQ ID NO: 11333 - DNA, 1051 bp, Homo sapiens
atcacaaaaagatggtggggttgaatatataggttttataggctaaatatcacaagcaaaaattgatgagaatgtactggctccaatataaattagcagcaattacaccagacaatttttagactctattatcttaaaggcattcagatcttaccaagtccacaagccatctacttggatataacagctcccgagaggctgcctagcagccacaaggatgctgtagactaactaggttagtaccttccactttcaatacttcgtcaaaacagtttaagatgacagatgggacaaggaatttaggaatcctgtaatggatgtgagattggagagtgtctacagccaagacatgggtttatgataaaagcagattaaagaggatactattgtgactagatgggggatttaggtcatgctgtaaaactcttcagatggtatagagctatatgttaggtcagtgcagaggctgagggtggtgggaatgggtctgtaaaggaactgataaaagtttgggactgaaaagattttaaaaagacagagatcttggaagagctatatgttatatcaaaagctattgtgtgcctgtgcatatgcatgtgtacgtgtgtgtgcaccttgcacacataacctgctgcttactactcagcccccttgtgtcttctccccttccagagtaggccatatacctatgaacgttttaacgctcatgtataaaatctataaagaaaagaaaaaagcaaattactacatttttacctccacagtggaatctgagacactgttatgtcacacaaattcacttttttttttttttttgacagaatctcactctatcacccaggctggagtgcagtggcatgatcttggctcactacaacctctgtctcctggttaatctgattctcctgcctcagcctcccaagtagctggggttatatgcacctgccaccatacccagctaatttttttattttttagtggagacgggtttcatcatgttggccagtctagtctcaaactcctgctctcaggcaatcagcccaccttggcc

SEQ ID NO: 11334 - DNA, 1057 bp, Homo sapiens
tttcataggagaaattatttttccttattgaatccaatatctgaagctttgtctacccagtgttgctagtcagtgttttattgcagactaacctattaatgacctctttaaaagtaaattccaaccacagaacctgtcttcctgtgtaagactttaggtgcagcaaatcatcatgcatctacagcaagttttccactctatattgctactgccaaagaatctcagatgagatatgagagaaaataaattagtctcatatgattcaaaatgtagtgaacactttgcaaacaagtattttttagcatcttaaataaattttggttgaattacgtctcatttacaatatcacatttcatcctaatttcagttgttttccatattgtctcctattgacttctactccatttctcaagaagagtaaaccttactttaatttatctccgaatagaagattgaaggaagaccctgctataagcatagcgtcctacacaaggaatagctagagatgtaggaaaatttttattgattggaaaaaaaaaagtgagctgacctccaatattttctgttaggttttctctgtaatatggcacaggaaaaaataaataataatttgaaaaaagaggcagctttttcatattgctatggagcaatttatgaataggacataagtccttttttcctcctaaaatagggactttatggggttttcatcttcttttttattagtggttggattatctgatcatttacattataagaaacacacgaaaatctagaaaacattttacattttgttacagatttacaaatagcatgttttcactttcattctaaaactaattattgatatcagaaatttgtatcttacctagatcattggttaacaagacagatttttaattcataaactttaattcttcatatggcagtctgattgaaccaatacattttttaaaaatttatagctaattgaagtataacatgaattaaacacacatagacttcaaaataaagcataaatagaagtgcatggaaagatgtaccgatgattggttct

SEQ ID NO: 11335 - DNA, 1020 bp, Homo sapiens
gttgctcctctccccctccagtgaggagggcaagtaagattctatctgggctcctctgaaatccacgagcagctctccaaatagagaagcactgatgtagagattgttgggtaataaaattaatgaggaagccatggtacaaaattttaacacctttcttttctgaactaaagttaaattcttgagtgtaggcgttccttcttgaaagtcctgttactggagagattaatctaccagcaatatacaaagacagattagtgagagatggtggtcccaataaaatcatttataggctaattacattccttcttcactcagttttactacaattaaaatgtaaaaggtctgtttacatttttggtgcctcaatatgtattgagaaatacaatattgttaagcaggttttcactttgcatttctctgctttaatataatgaagtcattatccatgcggacccacaatgctccgtgttaaattcgccaactgctgttctgtacattccctcagccaatttatttcaatttcagaaggagcaaccaactccacagtggatgactgctgactgcagttccacaccatcactcttcaagagtaaactcaaatcaaggaaaaagcttccacatgtgagcatgggtgtgctcaatctcctgttagctgcagccacagtttcaggcctgatagaccccagcttctgcccatggggtgcagagctacagacagctcacctgcctctaccacaggacagatcacaggacaggctgtgtgtgtgtgtgtgtgtattacatcatatatatatatatatatatatatatatatatatatatatatatatatatataaaataaataggttgcatacagaagattttcaaaccaatcattaacacatgtaagagctaggtcatattatttatggcactgttggtggtagccagatatcataaatgcagtgtcataaatacttttgtatgaaattatataattcttagggtaacaccttaaaactcataatttgcagag

SEQ ID NO: 11336 - DNA, 1045 bp, Homo sapiens
tagagcttcactctcttcaaccaggttgctcatcagagtgttcctcccagaggcataaacaagctctagtagatgcaattttctccatcttctaacattccaaaaataaattttagtgcccttcacacattggctttctggcaaatgcctgactggcccacacttaatctgactttgacttaacatagcactggttgcaaaagatgtgaaaaacatgggcagttcttacgaaacagattgtggttctagagcttagtcatatttaagagcaagagttttgaagccagtgtaggtggtaacagccatctgaatgtgggaaacttacttaatgtttctaaagctcagattcctcagttgtaagataggaataatgatagtacctagctcagaggagtgatgtgagaatatgagtaagcactgaacaacgttgtcttaaggcctgagcagaatagtgaacatgaaaatgactatcacatagcagttcaacatgtctgttgttttcatgtgctgccaacatcctgcatttgtgtgactgtttctgtttccagctgtctttatccagccacacagaagacgaaaagctcataggagtcctagaaaacaatggttactttgtctttatttcaagcaatagaaggggaccttctttaggaatgcatgttggatcaagttggagaagttgattaatattgtttaatgttgtttaaattcagctgtttaggaaatggaatgcctgtgctgataataaaaaagatcatagatagatagatgggtagataggtaaataaatgcatgatggatgaattaggtagacagaaaaacagaaacagtcataatatagatgagtggataagtaggtgggtggatggacacagagataaaaacatataagggtgcatagatggataattagatagagagattagatagatagaaagatagcctgggcagagtggctcacacctataatcccagaactttgggaggccaagacggggaggatctcttgagcccagtagttcaagaccagcctgggcaacataag

SEQ ID NO: 11337 - DNA, 1030 bp, Homo sapiens
cctaaggggtcactatgtgccaagcactatgctgtgcactttatgtaagtcgtctcctatattccttgataacacggtctaaagaaggacttcacagccaaggaactaagatgtaaagaacttgagtagcctcacaaggtcagtaattgtcagggtcaattttccaaaaagcctgtctacactgaaaactctgctctttctattgccgttctcgttcctctgcaggtcagctgacccttcctttggtgtagtcaaataaattaccagttggacagcagcacccgccatcaccaatgaataccctgtgttctgtgttctaaagagctaatttggcaggcatgtatcaaaccctaaagcagagttccctcatagtccactactaagtctatactttttagcctttttaaatcaaggggagtatttttcaaacatttttctcattgtttgttaagtaggtgctttagagctcaacatacaccttcatttcttcaatcaggctgttggtaggatattgaatgagaaagaattctgggctgtgccattgttgtatgactttctatcttttttccaccatgacacagataattgacatacatatctgtatcatgttcacaatacccattgcactcctaattctgaagcttcttttccattaaaaaaataagatcacaagcataaaataaagtaagcatggtattatcgtagggacaacatcaaatcagttttactttttaaaggaagtaattaagaaatgttggtgctttaccatcggggataaattactggtgtcccaagacactactgcggaggaccacttagcttgaagcattcacagagaatttagtgggcatcttttctttaaaacttccattgttccaccaactattaattcatctaaactagattgccctctcattcttcatttttccatttgcttttacaaaaaatgttgcaagaagttgtgcggatgcctcactaaattaaaaagtatgtgagtacgaataaatatttattactttttcatccacat

SEQ ID NO: 11338 - DNA, 1051 bp, Homo sapiens
tcctttcaagctaatttttctggctgttttttgttccatgggtaaacagagaatgttcaggttagatatgtaccttctatttgtttttcaagctgttctcaagggtcaatcaatgcttactaaagttttcgagcaagcactaaggtagtgagttctgtgcctgctgggcataattacaggaaacaactttgtttttaaaatctcataacaagaagcacaagcacaatccacaaattacaattcctttgcagtgtgtttgtacccttagcagctcacagcagggccacatcatcgtctccgccagccaccatttttctagctaccttcctaaaatatcagaaacaacaaacttcccagggtgaggaaacatcctgtagttttgcccacatggatcagtatttttcccattctgtcattatgttgctatgaagtagacaataaattattatgaaaatatgaatagaaagaggaagtgagtcatgtaaatcattattagtattctatttcacgtgatggaaaactcacagggatcttggtgttagtccagaattcactcatgttttccctttattttaaatgctgaaaaaaacataggttgtaatgttatcattgtacttgtagaactatatgactagatatgaactaagttacttggcaacagttgagctccaaatggaacttatgcctttattagttatgtaacattagatacctcacttaacctttcaagggctcaatttggtaatatgttaaataaataaattgagctagtatctggcatgagaatcctgggtttgaatttggcatcatcagtttctggccatgtgaccatcagcaagccacccactgtgcagagagattataatgagatgagattagcatgggcattacaaagatttttgccattgctgttgtcaccaacagataattatcttgcatgtgtcttctatagcacaactgaaaatcactgtaaactatattaagagataatatccagcattcagaatatctaagatggtcagaattaggtaggttttaaaactcttatgtt

SEQ ID NO: 11339 - DNA, 1102 bp, Homo sapiens
gcatgttgccaatggaaagatagtaaaaatcttgctactaatacctgcactgctctgctgaaacatttacctcaggtagtgttagctggaatggctaattattgaaaatacaaagtactgcatattgtttatttccattagtacaaatttagtattattctaatgctgcttgcattatttgaataagataaacaattctcagtcactgtgacttcaaagaactattctttattctccccaaagtttgatttactcattctattgtttattcatgaatagctgtgtactaccaaatgtcttgcctttcagtttttcaacagcaatctttactttagaaccttactctcaccttctgatatatcattaagtttgaacatgttgaatgctttgacggttgtattatacatgtaaaattgcttgtatttcatcttttatctagacagcttttatagtttgggtttttttcaaccaagttttcaacatttttaagttatgaagtttaacaggaattgctgacaaatgataataactggcatttttaaactcttcttagtatccactacactaagtactttacatattataaatctatatattatcacaaatcatttacagggtttttatgcttatctcttctctccacctggctctcattttatacagaggaaaactgaagttcagaaagtttaactaacttgatcaaatttatttggcaatttaagtggcaaagctaggagtccaaatccatgaaacttcttatacttgatactgccctgttgttgttatgattaatagcaattatgttttttgacaaatgattttcactgatttggagtaaataatttaaaattatttcatttaaattaagcctgatagtactatactaactgatacgtttacaaaactaaactcttcttagctgtaatatcattagcatttgctcaattttcagcagagacacaaaagaatgccagaatatatggaaagagtatgaaagctgaaccccaaggacctaaatctgatcccaactctaataggaatcactttacagaagctacattttagatccccaatgttatcatctttaaaatgaagataatgt

SEQ ID NO: 11340 - DNA, 1052 bp, Homo sapiens
gagaggttaatttttaagtgtttttactttatcaaagtattcctgactggtgttcagcaatcattggttctagtaatgtttatttggctttttcttatcatttcagtgcccagtatcttttttttttattacaacagacaaatctaattacttctgattaatctcaatagctgtgatttggattatgaatacttcccttccaatctaactgaaatcataaatgtttccatgtcaccttattttttataagcacatggtgtaaggcataccaaataagaaaatatattaacttttatcagagagacaactgtaatagaaaactcaatgtttattttagtatatttatgtatatatgttctattattttaaacagcctgtaaacctaagcctctcctcttatctaaaaatcatccgtcctcctctcattgcctttgcattttcactaaactcccctctgtgtatttatcttgctttttaggtatttacttgtgtgagtagtttatgttttttcatatgtcctgagctctctgccttacccaccatgccttgactataaagaaatgatagctaactttggccaggtgtggtggttcacgcctgtaatcccagcactttgcaaggccgaggcaggtggatcataaggtcaggagatcgagaccatcctggccaacatggtgaaaccccgtatctactaaaaaaaatataaaaattagctgggcatggtggcgtgtgcctgaagtcccagctactcgggacgctgaggcaggggaattgcttgaacccaggaggcagagtttgcagtgagccgagatcgtgccactacactccagcctggcaagagagcgagactccatctcaaaaaaaaaaaaaaaagaattgatagctaacattaattgagctcttgctatgttccagatgcattaaaagctttttaacatattaatccctttcatctttaagccagatgaaatgggtaccactgtaatcttcactgtatagaggaggaaacagaaactcagaacagtgaagcaatctgagtagagtcacacagc

SEQ ID NO: 11341 - DNA, 1031 bp, Homo sapiens
tttattgtatacacaagtcaaacctgaaaccaatctttatctttttagaataatctatttaatattttgacttaattatttcaaacattacaagcaacagctatgactccatttttcccttcttataaatttcacttatgtgcagttttaaaattgtctcagttctgcaccccaggatcaggtatatcatcaaagtatttaaactctttttattttaacattttgttcctatttataaagtttatttttatctccatgccttctactgatatttgttatctctaaaaacagcataaggaatagatagcaccagaaaaaaaaactaagcctttttttttaacattccgccctgatatgctgcaagctctcatgacttgagcagtactgttttattgttttgtttccattagagaataagtctatcacctcggctttgtgtaaaatttggtaaagagtgatttttaaatgagattctgtaatctagtgcaaatggaaaaaaattgattgcagaattaaaacaagttggaacataatttaattagtatccaagcagaagggaagagaaactactttaatgctttaatggaaaatcaattttgcaagaaaatttcacatttttaagcctaattagaaaaagatttacttcacagaaaagcatgtgaagaatacatattcaatcaaatggcaacagttttttaacttccaatggtcaattccttagtacttccttggaatgagttaaagtcattattccttatggcatcttttatgcccaaggatcatgaaagaagtgatgctatttctaagtacatttagcaatcagacggcaactatgctctccaagaatctccacccaacgatcaatgccctgattggaaatccttataaaaggttaattgttggaattttaaacatggatgccaataagaaccttcctggtcattcattcacaacctatcacatttgagaaatacaacaaaaacattaatttgcatccatagcatttcaggaattatacttgtttttcttta

SEQ ID NO: 11342 - DNA, 1034 bp, Homo sapiens
taaaaaatatgactcagaaaaatgcgagcattggtaatttagttttgggctttgtcaaatatcttttaaaaaactcagctaataatacactaaggcttctcatacataatttgtattgttgattaaaacctaagaatggaaagaaaaggctaagtctaatttttttgctaaaagaatgagtaaaaagtaatcagccatgttaatatttcaaacagcaaactatttgaaatgcatttctgctttgaaaggaaaatttgagatgaacaagttctattatacactattgataaagaaagaagatataaaaggtacaatatactcttaaaaatgattgcactttcaaggaaacataaaagaatagcttcttttttggccagtaagaaaactgaagccctgtgtagtcataaatagcaaaaatacaacgaaaatcctaatatgtgtgtgtgtgtgttttctcttcttcaagattcctataatatctaacaatgatatatttgtaacttactctgaattgcaaagcatgtatcaattgtcagttatcaaaagtgtctctgaaaatttgaggtagcaaaaaacaaagaaacaatgaacatgttcatttagtcttccctgcttttacaatttgtcattgaaacctgtgtcttcctcctaatcatattttcttaaattgtacttttatttaggatttggtgattgagagtttgcgttttctgtttgctagttgattgcttaggtggccaggtggttggtttctcttcatccaattgcatacaatgtatttctaaaaggatttttaaggaaatgtggaatatcatgtagtaatatgccctgttgctcattcctcctaaatctctctcttatctccacctctgcctcctttcccgcaacctgccttggtttaggccctcaccacttctctactgatgacaacagcctctcaaagcccagcccccttggctcctgccttgacgttactaccaatggcctcatcctaaagcaaaaatctcattatgcctctctcctgtttaaaatat

SEQ ID NO: 11343 - DNA, 1032 bp, Homo sapiens
ctcctgggttcaagcgattctcctgcctcagcctccagaatagctgggattacaggcacctgccaccatgcctggctaatttttatatttttagtagaggcggggttttgccatgtttgccaggttggtctcaaactcctgacctcgtgatccacctgccttggcctcccaaagtgttgggattacaggcgtgagccactccgcccagccgccactgccattttcaaaatggtgaaaacatgtctttgtcaaggaagatgttgtagacggaatgttttggttttctgggcacagattgagcacctgagagtctcagtaacacacctggtttggctgctttgctgaagacactccgtacattgtgacttgttgctctcaccatcaacaggaattgggctgtgcaagcaattctgaaagaagtgttgtctactgctgtgaaagtcatcaactttatcagaccccagtcctgaccccagccttttcaagaaattttgtctagaaaaaagatcacagtagaaaattattctctattgcacatagtttactgactttccaaggaacaaatggtaaagtatgtaactgaacttcatgggggcagagggaaagcaggtaactgatcagaacggtttaggagttctttcatggttttgttacatcatagatgtttttggtcacaagactcagataaattttttgattcaagatcgtagagtattatgtatgctgctaaaagaaccaactcttatagctcagccatcgtttctttagttcctacctaatggagatgggttataaacttcccagcatggaggaaggactttctattgtctgaagcccattgagaaagtcttattcatttctctgcaagcagatgtcttcaacacctgaaacaccacagaattcttttgagtgttacttgtgctcagatgattcatgtttaatgagtacctcaccaaagatggctccattgatttacaatggttatgatgagatatgaattcaattcagtcttggagttttgacctatatgag

SEQ ID NO: 11344 - DNA, 1031 bp, Homo sapiens
atttaaattttaaatggccacatgtggctagtagctactacattgtacagtcagatctagaacatacataattaacttaggtaaatttaccatccagagggcccaaattactctacaaaaatgtctaattttaacttttgtaaaatgtatatttacacaaaatatatttttgaattttctacggtaggcatttattcctttgtattattaataaaataatgtcaaggtcattaatgaggaatttagctgttgaaaaggttactattttttttttataaaccactgtacttcttgaaacaataggaagatacctgatgcctaagataactataaaatatagatttatactaagatttgttgtttcaattattatcatgtttaaaaaagggcaaatcacttagtgtagttttgtttactaaaaggaattgagagttaaattatatttgattaaatatttatgatattatattgtttcattaattatatcttattcctaaattttatttagatttgtattctgtttatgttccttagtattatacaattagcagtctgtaattgataaaataacaataactttttgatagtttgaggaattttaatacaaaaataaatggatagtttctagcatatttagggaaagaagtcatccgtaaagtctttgacatttttctaaaccactaatgatctcacaatttttcctttgcattcaataaatagtaaagtgattttaatggaaatggaagggatttttctgactttcagagatgaaaccacttttgtcatccattgtgtaatattgtacctttcaatttattagtgccagcatgacgattgctataataatgatattaaaaagaacagtaaacaagtttaggaacaaaagcaataggaatatactgcaaaaacacagtaataaatactaagttttaaaatatataatagtgaaatttgccatcagataagtgctcaatgctaatgcatggtttattattataatcacttacttagattaattgtagtttgtgtgg

SEQ ID NO: 11345 - DNA, 1031 bp, Homo sapiens
ggtcacacagcatgaagtgtctttccttcttattcctttttcagcttcatgaacctattcttcaagatcaaaatcatagatcagtttctgcatgtcaaattctttgagcttactcctttctcatgttttcttttgtacaaaatgtctaccacatattgcatatattgaattctttgttagatgcctctacaggacgatttgaatgataccatcacctgcttttatcctttcactattctgggacctcattcttttagttttatctcttttatttcttcccccacttctcactctttttcttattctcttcgctgccatttcccagcaccatgtgtcatatttaatagcaatcacctctgtaatccaaagggaaccagctagacatatgatgtccctctataagggtggctttaattccagagagaaagtgaagagctgagattttctattcttaatgattaagattaaaggtacttttgatatgattaggatgacctatttttaccactgaagtacattttaggttgggcttttcattgaacagaggttttaatatttggtgattgttaccaaccttcgaataattagatgaaagccaaagacattctcctgggaaacatacagacaagttctacgttaaatttcagggggttcaaaagagtcctcagtgttcatgcaccccatggtgtgttattcttaatccccagggtctacaggtatatataaacttactcagacctttcttgtaagaatgagtgatggtatgaaaatgtgtattgtccttgttcttcaggaactttgtgcagatatttaaagttttgtgcaacagctctggaagcctgtgtccttaaggcttagttttttctgggagacgacgtatgctttcatcctgtaggcatcaattaattataagaatatattctctctattacaaattgctagcaccttattttttctcaggaagcaggaggaaatgcaggttagcaggacatcttcttttaaaaatagaagttgctaacataattgacttc

SEQ ID NO: 11346 - DNA, 1047 bp, Homo sapiens
tttttttggtctttttcttgccttttggaactggctagaacttgggataggatgttgaacaagactggtaagagcagacacccttgtcttgatcctgatcttagggtaaaggcaagaatggtgctaactgtaggtatttctgtaaacacacactttatcaaactgaataattgtttttgtatttctaatttgctgaagtgttatttttaattatgaatgaatgttgaattttatcaaatgctttttctgcctctattaataggaatatgtgatttttctttttaacaatgttacgtgaattacattaaataattttcagcttttgaaccagtcgtgcattcctgggacaaactttaagtgattgcaatgaattactgtttttatacattgattcgtataattaataattattgttattattattaatcaatagtaattttccttattctgaaatctactgtttgtagtaatcatatagccattcttttctttgaatcatgtttgaatcatagatcttttttcattttttcatttttaatctatctgtattatgtttcatgtgggtttcttgtagacagcacctacttagttcatatggacagcatctatttgtttttatgtttatccaatctggcaatctccatcatttagtgttttcagataatttacatttaattattgatatagttatatatctgcctaccagtttattattattctttttgattcttctctttttcattctcttatttcattctcccccttctctcttttaacttattttggttctttttttgtagcttttattaatttgtgagaacgtctatgattccattcataccaagagtttttgcacattcttcttgggccatggttattgcttggtttttaatattcatctttgacagttttttttataagagtgtcatttccaccttaccctaggtcttattatgacccaatgaaagctaatggcaatttttcctacatgagtagccagattctccataaatgaaagtttaaaaaatgatttttctctacttaaaa

SEQ ID NO: 11347 - DNA, 1022 bp, Homo sapiens
tctttctgcaaaattggttgcttttgctgtatctttcatataaaaaaaattccccagagcccttatcacttttgtatttagacatttagaatagatattcataattatttattaatatctgtctccactactagactgaaagcatcttgaagcaatacgctatttttgatcacccctgaacccagcgaatgtttgcaacacaggagtcatttagcaaatattcattgaatgaatgaatagaagaaagaacaaggactgccagatgtgctgttggttaaaagtttgctcactgttttctctagctattagagctagagagtcactgaaataatgattattggggtcaccaaaataaatgttaatctttcagaaaaaaaattttgaatatgcatttttaaaagtcccgtcaccatatatatatatatattaaccctaagcgtctgtattttatgtggttactcaactctgtgggtttttttgatttcagatagataccagctttgtgaacttaaagcaagcagtatgaatatagttcttcaacagtggggattatctgatgtcagggcttctctccatatccagcctcttgcaagtcctggaaaatcatctctgggtgggtggccactagaggaatttcattgttcactaacagactcagaaataaagttattatttagccatagggcagcctcggattcctctggaaggtatgcctatggcagccagcattaagaccaaatcgccatgaggctgcctgtttacagaggtttgtttacatacagtatccactacacattttctctgacttcattaataaactgagacaaagaaaccatttccttactttccaggttagctgagcaatttatcttaattactgtcaacctttagtgactaccatggggattctaagcattcacttcactagtaatgatgtaaattacttatgaattttcaataggcagccatggatttttggcttgtcttacatgcacttttttccccaactgaaattatatgtg

SEQ ID NO: 11348 - DNA, 1033 bp, Homo sapiens
tttcagacctcagacaatctttgtatttctttacttagggtagttatttctttcttgttgtgactcctagctgttattatctttattccacctccattaagacaaatctacattctcttctttttcacacatatccttcctgactcttaaatgctccagagctgacttggttggtcttgaaagtatttctcatttttaactggtaaggactctatttgggcattagcttattgttcattgattataacttttctttcttattcactactgtttcttttatggtttctttttttttttttttcagaattactttcacaatgagaattagcctcagggtaacactttcgctcgtaatggaaaaattattaagtcatcctctgtgtttagcaacaaaggtttctgacagtcacgtgtggttccaacattctggtatttattttatttctgttttttttgtttcttgtgcttatatatgtctacatttttttcagctgcctactgaatcactcttctatcgtgctgttcttcaggatattattaaagattgttatggcatcaccaaatggtatgaggattttattttaataagaataactatgttatattgtaagtaaagtgacttttagtcttcaggtgaatttatgcagggtcactgttattagtagaagcaactttgaatttgagcataatgtcaataacaagtacacaacaactgtatcttaggttaattatcattaaagtgggggctctaatgattccttcttgtcctgaaagcttgttgtaatgataaaataatctatgtaaaatgtactttagaatttttgaagtattaaaatattaaatagttcagtgacgatattatatgagcaagagtcatatttagaatgtttcataaacagcataacactttaattagaacagatattgatcataaacaactattatagcataaacacttaactctaattagaacagatattgatcacaaacaactattatagcccttcaggtctctgctagtagaatactagca

SEQ ID NO: 11349 - DNA, 1025 bp, Homo sapiens
tccataagacggtgaagaatggtataaaattggagccagaataactggcttatgggaaaaacttaagtgcttgtccttttggattaaaaaaaaaaaaatcaaagcttaacttttttaagctgagcagcaggaagttaatattaaatggcctattttcctggctacacagtgaaatcaattattttgtgatacataagatatatatctattatatggtatctgttacacctaagatgtataggatctgagaataatgtgtatgtgtaggatcctgtatgtgcaggatctgagaatgatacagaaacctacaaaaatatattttctgccttctggaacctatacctattcaagtgactattaaatcaaggcagtgataaataacaaacgaatggaagaatcgtaggggctatagaaattcaaaattagaaaagattattattagtcatgttaccaaaaagaacatgtacatttacactttatcataaaggaagacttcagttcaactaagatgtagaagagagtggggaactgtgtaatccattaagaggaaactgcatgagcaaatgtaccaaggcagaaatgtggaagacagtctgaaacaattagtagactgatctaaggagaaaaaactaaatactggaatgtaatgggatatgcggttgagaaatgtgattatagtgggccctgatggtttaaggactttcaaatttatcccaataaatgggagaggtattgaaagcttttggagcagaaaagtgacaaaataaaaaggctcttagaaaataacatgtaggaagaggtgaagaagagagacttcagttttagaggtcttaattaggaaatagttggaataatcaggacatgatgtaataaaaagtggaattgagatgccgtcttgaaattgagctgaagaaatatgttttgaatatattttaaaggaagaattgatagaatgttatgtctaattaatcagaggtgttaatatttatattgccaagagtaaatgaggcttcattccttgtttt

SEQ ID NO: 11350 - DNA, 1034 bp, Homo sapiens
gacaaataaactgatacgcagttgcctagggcttatgctcaagtaggtgctgatgcctaaatggagtctctagagtcaagtgtctttattggtttgtgcttttgttgaacaacccattttgaggaaatttggtttgcattgcatgaagactttatagatttcaggcaagcagcaaaaatgagagtttaggtagctgaaagtaggaagataaaaatttgttattgattattattagtgacattcaggcaccaagtgatgctcttcagtgaaggtatctaagtaaggttagaaatgcttcggcctgtatgactttttaacctggtacacttaaaccttagctttaaggcaccttggggggtttctgaataggtgaatgcactatatctgaagttttaaagtcctagttaataaaaacctttttaaggaacttgttgtaaaatgagttatactttttcctttctttttaaaatactgtatgtactgtgtagtagaggcagggttgtgaacgaatgctggaccaagataaaagattacagttttagtcttggaataccactgtactagctaagtacttgagctgctcagctctcatgaactcagtattttaattggtcaggaaacaaaaataataatagtaactgccaaccacagagtgagactcaaatgaaataatatgatgaacgttctctgtggttttaaaaagctgcatggttatatacttagctgtagagtggttggaccagggggctgaatgacttggttgatcactgtacattaagtacagctgtccccgcttatccttggaagatttattccaaaacccccagtgtatgcctgaaactgaggacagtaccaaaccctgtatatagtatagtatgttttcctccatacatacatacctgtgataaagtttaatttataatataaagtaggcacagtaagagattaataataataactaataacaaaatagaacagttataatatacaagcaccactactcttgtgcttggagtccatattaaataaaataa

SEQ ID NO: 11351 - DNA, 1027 bp, Homo sapiens
tttccctcctcctttcctgtcttttcttatcttcctccattctctccccatttcctttctgtgctccctctcctttctgcactcacctccttcacctttcatctgtaggtgacactaaaccgaggtttaagaagagccaccttggctgggtgcaatggcttacgcctgtaatcctagcattttgggaggctgaggcaagtggaacacaaggccaggagttcgagaccagcccagccaatgtggtgaaaccctgtctctactaaaaattcaaaaattagctgggcgtggtggcacgcgcctgtaatcccagctactcgggaggctgaggtaggagaattgcttgaaaccagaaggtggaggttgcagtgagccaagatcgcaccactgcactccagcctgggcagaagagtgaaactccgtctcaaaaaaaaaaaaaaaaaaaaagccacctcacagagttgatggcagtgtgagtgctgctttttgtacattacctcattcagttctggacacaggaggggtctccaaatcatgctgcgtgggccagggagtctgatggaagaagtcatacttgagttatggctgtctcagggatgctgtgagttgactagcttgctgggaggctggagtctggctcacacattcagaacatttgcaggttactgagacaaccagtaccaaggacttgttctggagactaaccagatatggaaaacactgaggtaggcagaaatcagtttgtgatgggctattgatggtaaactaaggagctaaatggaaagctctggcaaacccttgaatgagagagaaatgatctaacagagaatcctctaacagaagtaggatgaacagattaaaggaaaaagtagggggagaccaggtgggaatctttcgcaccaagtcaggaaggaaatagagttgtcacaaaagctgagggaaggaagaggaggagaggcaaattcaagggactaaagaggttgactctttagaacttggcgatgatgtgaaaatgagtaagaaagagttt

SEQ ID NO: 11352 - DNA, 1048 bp, Homo sapiens
aatgagagcctcctccagagatctttgagagaggcttaaggaagcattcctctgttatttgttgtgctatgttcatctggttctaagtcaagataaatattgcttcatttgtatagttgttttcttttgcaatttgctcatgagtgaaatctctttaaaacgttaacatttgattaaatatacttgaatgcttacaaagagtttttcatataatttatcttgtttatctttatagcaacattaagggactggtagatatttatgttcctcttggtgagttcattgaagagcaatctgaggctttatataggttaggaaatacactttttatattttgggaatccagcctgtacagtgcttattatcaccatttctgcagttatgaggttactcttgaagacaagaaaatatttattaatgaattttcaaattgctccttatttgtatatttctctctgcttaatgctaccaacatttccactctttggcatcaagtgttgataattcttttactgtcttctgtgaatatctcaaaaccacatgcaaatgcattgcaaaatgcacagtcagattttacatcttgcaaaggatgcaggattccatgaagtcagggaaagtggctcagtaagatctgcattaacatataaacccctaggcaaattggtatggcaggattggatcaggcaattatcaccatagataatgacaagagaagcccttcaagagtctgattgaaatatcaaaggattacgtgagactcttgggaaatcaaaacccttgactatttttggcagaaacagtgtttttgttcagattttactgtaagttgtatgaagtaagatttgtgtggtcctgttatcacttaagaaatataaattttaccttattttatatttataaaagaatatgaataacctgaatatctgtatacttctcccagatatcatatttctgtctctactatgaaaatctggaattctgtgtttattctccagttttttaaaaagtagttttaccctgtatgtgtatattcctttatttagatatg

SEQ ID NO: 11353 - DNA, 1089 bp, Homo sapiens
agttttctatgtacttattgatttaatgtttatggtcattcatttatggttaatttcaacaaatacttactgagctcctgtgtgccagatattctagtaggtgctggtagaaagtggtaatcaaagtatagtaccaaacttttaaatttcctctggttttaatgttatgtttatgataccctcagagggaacagggaataataatgaagatgataatgatagccagagattatagcatacttaacaggtgctggcatatttacctctcacaacaatccttaagtcacaagtactatttattattcccattttgcagatgaagaaaccacggcttattgagatgaaggtacttgctcatggtgaggtcatggatggcagagctagcattagattccagttaatcggcctgcaaagtaaattttattaaccactctgttaagtaagaaacagtgttactgaatttgaagtaagggaaaaaatttgtttttcagatgaatgacaaagacttcctggaggaaatgggctttgaagaaggggaactatccattcaaaagaaactctcaccaggaagaggcataaaagaatgagatggaaaagaacaaagctccatgggagaatactattcgtgtagtttggctacatggggacagacacataaggcatgttgaggaatacaagataggaaaaagattagagacagattgtggcagacatcaagtgccatgacaaaatgaatgtatgttgttagtttttgagcaagaatgttgagcatagtcatctcctgccttaaaattgttatcttgcagtagtattcacggaggattataaaggaagcaagtagataagagagaaaaagaaccagaattaccaatcatgattagaaggaacaaaaaggacagacacaaaagacagggtgttccttaaattgtttgactttaaaaccaaatgaatattggagtaagaaagaagtggtaactgaaaatcaagacactgacaacagaaatagtcagatgtggttgaggaacattattttaggaagatgaggaattgacctttacattgagtttgaaatactactgtagaatccag

SEQ ID NO: 11354 - DNA, 1034 bp, Homo sapiens
taaagtggttcatgtatagtacctgatttaacttttaggtgtgagaaagccttacagtatcccttctagttgtttctaatttcaaatctggaaaattagaaacaagttattttcattaagcttttaaattgaaactctgatacagtatagtacggtgagaaggaggtgaggtgtactgaattatgttaggatgttctgatatggatatagtgaccaactgattatgtgcaaaatatttatactgtttttcatcatgcaaattgcaagtctgtgaaaagtagctcaagttgtttcactcattattttaatcagtgaaagtgcttagagtgtggtatttctcatattttcatgttgtattagtttttgctttaattttgcaaaatgcttttcatataacatttaaaaacatctctaggtaactcaagttttaattatacgtgataaacattcttttaaatggtttattagttttcagggtcacagtgttttttgtgtttgttttttttttttttgatatttcctgtagaaattgtgaaaatgacagcattgctttatcgggggaactaaagatatttttaaaaatatttagccaacattctacttcctcattttctcctactaagaggaaagagtgccagtgccatggctcacgcctgtaatcccagcactttgggaggccgaggcaggcagatcacttgaggtcaggagttcgagaccagcctggccaacatggtgaaaccccatctctactaaaaatacaaaaattagccagcattgtggcgcacacgtatagtcccagctacttgggaggctgaggcaggagaatcgcttgaacccaggaggcggaggttgcagtgagctgagatcatgtgactgcactccagcctgggcaacagaacgagactctgtcttttttttaaaaaaaacgaaaaacaggaaagattgtctaggtaaacttcttgacttgagatgagaaggagcttcctcatcatccatggaagctctatgaaggcaaatctccaacatcttggggg

SEQ ID NO: 11355 - DNA, 1069 bp, Homo sapiens
tttaattctaaccccaaaatgcacctaatttcccaggttatgggtcaggaagactttaataagggacttttcatagattgtatcctagtctttatataataataacagcgcagctaacagggcagagagatcatttgcactagggtgtccagaacactcatgtatatgtaaagcactgttctctgcttctctatatagaagacaaatgaacaattatacatgtttattaaatgatttcaaggtaaaactattatcacagaaactgaagctcagaaaggttaattgggaagcaatctagagaagcagttgaaaactatcatgcctagtcatttgaactcaactagaatactaactcagttatttccactggtgagatcaccttagatgggtttcttaatctgctgagtctctgtgatagtttatttttgcagtcaggcagtgaatgaaagagttaggactcaggaacgttttccctgaatccagagtttttccaacctgcttttcggtaatactcatgtggaaatttctctgatcacacctgcctcacaagagaaggcagaactggtggagggcctagagttgaacatcattaagacagtctcccacaacatagtctttatccacacagatgcccacagctccttaaaaagccctgatatcagactaggcaagagttttatagttctggagttctcattcctgtgcccttactaactcatgtgtctcttatatgttctgtaaatacagagataggttcactagggatacaaaaagactccaaatgccactctgttctctgggaggatagtggcacagagccaggatgttccaaactgaataatttaatgccacattcaatgtttgtaccttatccacatatgtcagtacttttgagtctttaatccttttctttatattcactttttaattttcaacagctttattctgagccatagttaggaaatccagctttgatatggtaatgaaatttactttcaaataaccttaacatgaatataaccattacagtttttacaaagtgcagacatctttttacatgtccccagta

SEQ ID NO: 11356 - DNA, 1104 bp, Homo sapiens
agggttaaacctctcattctaagctaaacaagattactctgaaggctggcattcaggggcttgtttttagtgtaatgggttaggggctatggcacaccccttgcagttccactaattgaactctttgggtacttcagtttctaatagttagctctagaaggggcttgccatgggtacgcaagaaattgctcactgcttgatttccccacgttagtttaatgaggaagaatgggtcaccatgccaaccaaaacaccatagcaatgggtttagaggcatcctttcttgatacttgcttcccatttaggggtttctaatatactacaaacgctatagagtgtcagacaaaaaccaaataggatttgaaatcaatgtgtcctctcgtacaatacatgtaagtgactatgttgagttatcctgaattttacttcgttgtgtattcagacttttttgattaatttagaaggtagcaaggcacttaatgttggtcttatttttcagttgttaatttttctttgctagcagttttcagctattgatctatcaaagctcatctacatttaatttcatttggtttctaagagcttttattctactgtagtaacaaccatttaaaaatttattttttagaacagttttaggtttatataaaaattaagaaaataaggcaaagttcccatacacccagtttcccctattattagcatcctgcattagtgttgtgcatttgttgcaattaatgacccagagctgatacattattatatcaatagtttattcagattttttagtttttacctaatgtcatttttcagttccatggtgtcagctgggatggcacatttatttgtcatgtctccttagactcttgcatgtgagtttttcagactttttttgtttattttctgattgagacagggtctagctctgttacccacacaggagtgtagttgcacaatcacagctcacagcagcctcaacctcccagactcacgcaatcctccttcctcagcctctcttgtagctgggactacaagcacaagccaccacacctggctgatttttgtacttttttttttttttgtagagatgggctcttactttgt

SEQ ID NO: 11357 - DNA, 1026 bp, Homo sapiens
tcctaaaatcaatccatttatccaaggagccctgatacactttattggaaaatggtaacaaccattgaaggaataaatacaaaaaaatttaagtaaaattcaggaaaatatctttcaagtatgattaaatgagagactagatgatcatcttaagctgttatgtgtttagctggagatgtactaatgctttctgatggatgcttgaactcagtgggaaacatgatggtgtactatgggtttaagtgaacaaaagaactcattataatccgaaatactgaatatcttaagatacttttttatgccccttaatctttaaattttttcctcacaaagtctggatatgcccactcattgaacctcttttaatattttttgcgataccaaacattataaaactctttaatcttgtctgttagttggtgtgggggagaaaacaaatgtttctaatcttacagacaggatgatcattaataaggaaacccatttttcttttaaagggaaacagaacaactatgacaacttgattatgatgaaactttgattaatcacatggatatgttctagaaacaattcctaaccatactttcagccatgcattccttcttgtcacatgttcagaaattatgcctttgaggggagtatccagtggtaactattttgggaaggaggagagctaagagaaatcctattttactgacataagaaaagtgatggatggtgaatataaaatagaaggtgctagatttttgttatgtctggatagccttttctctgtcttataactttcagaaactgatttttatctactttattattacaactactatcattgccaagggcttaatttggaattaaatgagccttatgcttaagtaatttattctcgttagtttgccaaaatgtaggtctcatgatggttttaatattcaacagcaggatgtttacatttttcgttcattgagactaaaatattccttttcagtttcatttatgtcccagaaaatctgagatcagaagacaatattg

SEQ ID NO: 11358 - DNA, 1021 bp, Homo sapiens
gctcactgtagcctcgactctatgggctcaactctgtgggctcaagcgatcatgacatctaacacgccaagctaatttttgtatttttttgttgagacgaggtttcaccatgttgcccaggctggtctcaaactcctcttgagctcaaacagtccactcgcctcatcagcctcccaaagtgctagtacaggtgcaagccattgtgcccagcctcagacactgtcttaaacagcttgtttatattaacacacttcatcatgaaacagatgagacactattttcccactttacagataaagtaaactgaagcacaggagttttaaatttcttagaggcacacaggcaaatctgagattgaaagattctgtgctctttttttgcattaaaattgataactcaaaaccctttcatttttcaggtacagtcagtagtcacccaactaaatatatctcaacacacatgacccttcttctcatcctcatcatttgctgggggactctgctttcaggactcaataccccatctccttgtaggaagtaagaaggcaagaaaagaagccaaggttgagggcaaggttcactggagagccgtactatgggggcaattattggtgctgtgccttttgttatttttaatattgaaaaattactattatttggggagaacaaagggtacacagaaaatatatttaattttcaacatgattaagtgtagaaatagcgattttcagggaagtgagctcataagcagaaacagtataaaagaacattatatctataatgttttattgatgtattctgatgcctggcaagcttctttatagctttgatcttgtttagtttttttgcttttcatctccagatcttctatgccatttatcagttttttcatacttgaatgaaatatttgtttattttaagatcatttcttgcagtttctggcccagtaagtatacaataatttcagaccatgaagacccctactgaaatctggaagagcatgaagcctttgtaggtgatct

SEQ ID NO: 11359 - DNA, 1061 bp, Homo sapiens
tggtatttctttaggcagaaataaaccaaagttttgggaaaaaagcctcaatatatatgtttcaaatttagaaaaaaataacctttatatgtagaaataaaatatttagaattaaatctattagagaatataaggttttagtaactgttagtgagtttactgaactcatggtatagaattttggtaaaaaaaatatcattgggtttgcatacctgtgctaagagctgccttcaagaagaaagtgctacctaaggcatttttaattctaaatctattaattataatatcatttgatatcatttgaatccgtgcttacagacaatagttatataatatgaaatttaaacagcacttaattctattcttaataacaatagatatcatgcatttattgtacagccttgtatttagccttttattcatgttgtcaaatttactaaaatctgatatttcatacaagaaattattaagaccaggtttaacagatttgcattatgatgttgatttgtcttttcatgtataatacattttcagagacaaagcagatgaatcgtggctcagtgatttacacagtcagattttataagtatagagttcactttcaacctcttcgctacaccactcactgcaatgtgaaatgtaattgatttttagactaagaaagagtcaatgtccttttgttgttgttatggatttgtttcggtctgttccaaatgatatttaaaaaggtaattcaatagagcattaaatattgtattaggaattagatttcaaaatgcagatgaatttaacatgctataatcaattcttgattatcttacctaatggaagaattatgtctgttgatgatagagattttgctactataagttaattgtcattttgttctgtgttgtaagaatcttagtaaatatccaatctgagaagctaagaaatgagcaagaaaataaactaaaaatttaagagtagagaaaatataaataaatcagaatgcagagaaacaataggaagtaatgcataatctaagatcttgttctctggaagatcagcagctttgggta

SEQ ID NO: 11360 - DNA, 1019 bp, Homo sapiens
tattttcctccatcatccttcatctaataaaccttttacttacacagatttgaaattgaaaaaatgttttttcccatatcttcaataaagaggaacattttgatttaatttgtaattctttacagtagctctttaattatgagatattttcccaagtttattgggctgttcacagagaacgagggagaaaaacaatgaataggaaacaaaaatgaatttattagagcaattttttgtataaaaagcttgtgtgaattttagaattgtatttttgagaaagaaacttgtggtatggaagagttaagtgtcataaatagctacaagtgatgtttagttttttaaactattatttaggtgagaagaactgacaaatcaccttctgaaaacaatgcaaatgttctcgctcgtaaattcaaattctactttaggtctgtacattatgttgtgagttcagtcagcagaaggagcataaaggaagtctgtttctttctcagccttctgtgtggcttgtgtttaactgaatcatttatttttgttggattcttctgtgtgtgtatgtgcatgtgtgtttacctcaccttgtttcggaatatatttaaagtggggatattcagagtaaatttttgacatgatggtttatatgcttaatgttttctcctgtgtttagttgttcttaagtggattgctcaaggcatttagcatgctgactgtgaaagagatggtttttaactgtatgagatttgaactttcacatctttcaagtgtggaagcattaacactccagtagcgttaagctttttataccacctgcttcccctattttgagttctggcgattttcctatgattgcttccattggcactcttgaaaatcaatgaggcaatcctacgaatatgaatatgaccatataactggattagtcattaatctatgaaatccaaaaagaatatgaacctctaatttttaagataagtctctttatttcatttcgtttttccattatcagaaaggatacaacc

SEQ ID NO: 11361 - DNA, 1051 bp, Homo sapiens
taccacacattttgacttctgaatgctttaaatatattataaaatggaattggctgctagtttcaagagaagaggaatagaaattgagtggtgttttcactctttaatcaaaactggccgaagggaaaatatgtaaaaatgaaatgcaactatattagacttagactggagagtaggattttatataagacttatatgtttacaagatatattagaaaaatattgattattagtacttttattacagtcagtggaatgattcactcagtactttttttaaagtttgtctttaagaatttgtgtaatatttacagaatttagaaaagttcaaacggatttaaggtttcccagaatgctttggcacattttatagatcaaatcctcttttatttttctgccaaaaatgtccttttcctctctttgcctgttcagattttatttcttccgtgaagtcttgcctgactttcttaagcagttccttttttgttttttctctatacttcattagtaccggtctcagtatcttcatagtaggacacttccaaatagaatgacacatacatatgtgtctgttttttgacactagatatggggcagggggtgagtctttactttttatttcttcagtacctgccatttcaatgtattagttactatccctgtacccatgtgccttttcctttataagttatttaagggctggggacatggcttttaaatgtttttgttccctccctcccctccagtactcattccctcattaatcccttcatttggtcaacacatatattgagacttatttcttcaagctaggtattgctttaatcctcagtgatctgtgctgaaaaaaaatgaatgagggtggcatgattatagagtgaacacacagtaatcttccaaaatcctagatggggagatgggcacaagaggggcgtgcatctcttcagtgcctgtgcttgacatgtgatatttaatagaagcttgataacaacccttagggagtattatcccctttttataaatgaagaatctgagcttcaaaggtttgagg

SEQ ID NO: 11362 - DNA, 1035 bp, Homo sapiens
aatgtccatcaatgatagactggattaagaaaatgtggcacatatataccatggaatgctatgcagccataaaaagatgagttcatgtcctttgcagggatatggataaagctggaaaccatcattctcagcaaactatcacaaggacagaaaaccaaacactgcatgttcgttctcactcataggtgggaattgaacaatgagaacacttggacacagggcagggcctgtcatggggtcgggggctgggggagggatagcattaagagaaatacctaatgtaaatgacgagttgatgggtgctgcaaaccaccatggcacatgtatgtaacaaacctatgtaacaaacctgcacattgtgcacatgtaccctagaacttaaagtataatagaaaaaaacccagaaaatttagaattgaaaaaaaaaattcgaactctcagtgttgttgttatttttctattgtttttctattctctctttcatttatttctgttctaatctttattgtttccttccttctgctgactttggacttagtttcttcttctttatctagtttcttgaggtataaaggtaggttgttgatatgagctctttgttcttttgtaatgtacacacttatcacttaaacttcagtcttaggactgcttttgctgcattgtatttcgttcttcttacgttttaattgagcatttaatatgattttatttcctctcctagtgtatcaattatatttctttaaaaattttcatggtggttgccctggagtttgtgatggacactttatactaagtatacctttaagtgacattaaactgcttgatgtgcgtacaattaccttacggagtattcacaattcctccctcctgtcctttatgacatctctgtcactcattctacttacctatatgctgtaatcatctaattaattattactattgttacattaaacagttatttagataagctcagaaaaagacaaatattttatttaccttcatttattctttctataaccctcttcattttttaat

SEQ ID NO: 11363 - DNA, 1075 bp, Homo sapiens
attatttactgctgatttttaaatctatctcctgtcatggaccttgatcacaaatgttatttgttgggaatataaaaagtagtcttgcctttgtgtaataaagtgattctcaaccttggctgcacatcacgaattgcctagggaacttttagcctattgagacctaagtcttatcagacactctgattgttttctttttttttttttaattgaaaagtaaactttactgttgaaaatgccaacttggggagggtagaaaaatcacacacaaggctgccacttcacacctggagggttgcacggtggccgggcagaggtgctcctcacttcccagacagtggggcggccaggcagaggcgctccttacttccctatggcgcagtggccgggcagaggtgttcctcgcttctcagacagtggggcggccgggcagaggcactcctcgtttcccatatggagacactttgattttaattggtcaaagacagagcccaggatcctttttgtaaagctcttcaggtgattctaatgtgcagttaagattgaggacctctggtttaatgcacagcattctgttcttgatgggcgttggttctgtcacccagttccagacaaactgctgtgtgaccttgggcatcgacttagactctctgtgtttcagtttcctcatctgtccagtgaggtattaattaacagcataaaaatgcctcaaagatatggcaagttcactttcagaccactgcagtagagcaaatatcacaacagagtcacacaagtgttttgatttcctggtgttttgattttatgtttatggtataaacataaaacatgtttataccatacagtcatctattaagtgttcaataaacatgatgtttaagaaaacaatatacataccttaaataaaaaacattttattactaaaaaatgctaacggtcatctgagctttcagatagtagtaatctttttttgctggtaaagcatcttggctcacattaatagctgctgacccatcagggtgatatttgctgaaggctgggctggctgtggcagtttcttcaaataagacaacaa

SEQ ID NO: 11364 - DNA, 1049 bp, Homo sapiens
aagatgaacattttaaaatcttaatagttgctatactgccagattattttccaaaaagcatagcagttcacattctcactggcacaattgctgaatttgaataatgtccattttttatgttattattgacctgaagaattaaagttgctatcttactgtttcaagttacatctttttggctactactgtggtaataacaggtattttcatttatgtatgtattatcatttgtcattttctgtgagacttgattttcatatcttttgcacattttttagtgagttttgttactgtattaagatctctgtcttttctactatggcatttgtgttacctgtcttgtttgagaaggcctccctcacactgagattttgttaagttagatttttaattcatatggaatttattcttttatggtttccagatggagtccatattgagattgtgttacagctattaagaagcactcacccttcttttaagctttcatctggaaatagatatgtgattagtgaaaatgcaagttgtagatttatccctgtagttaaacacaattggcatatgtgcacaaagaggaagggggtgagagagtaagtaccaatgtgtacatatcatttttcaggggaagggagaaatggaaactattaacattcttctgaaacaacaaatagttgtgtgcttcttctcactgggtatccctaactggcctcttactctcttcctggcctccaggatgccattgtgttagagagataatcctgccttctcccaaaaggtgtgcttttgcagtgttcctcccacacaaaggctaggcccagcagctcccagcctcacatagagcttaaagatctcctcctaccatgttggcatcctgccccccttagagcattggcctcttctgcatgatcacagctgattgcaagcatgtctgtcccagtgtgttggaaaacaaaagaaaggaagttcagggtaagagtttccttttatggaaggtacacatatccattcaggtcacgtttcattggtgagaatataattatgcccctgaa

SEQ ID NO: 11365 - DNA, 1120 bp, Homo sapiens
tcagggaaaatggggtgtcctgatagaagagctgtggtgtctgcctttgaggagcacacagttttgtgaaagggaaaaacatttctttacatagaagtagataatgcagtcctgtagatccaacatccgcgtatgccctgggggcaccaagtatggttaggccagtcagttgagaaggttgaaaaggccagagaagatgtcctaggagaggagaattgccttggctgagccttggaagaggaatagtgtttaaccaagcaatacctgctctggggagcatttccacttttgaaggaagatgtagacaatactgtggtgtgttcaggaaatgacagccactctatattgtcagaatataaatcttgagatctatagtgataagtgaagaggctaaaccatgcaaatcagcggcgagattatcaaaagccccacctgccacactaaggggatcctttcgtggtcagaaagaaagtaatacaattgagagatatttgttccatttgcattgtagaggatgaattttgtggacacgggttgggcgaagaaagaccaatactacttcagtattccaggtgaaaaaagacttgaactagggcagtagtaagtacaggagggaagaaaaggtatatttgaaaagtatttaggagataaagtggagataaaatggacagtgcttggtaattccttaacagggacaaggaagtgaggaagagagagaagtttctagcttaggcgactaagtaggttctggtactagttatttagattaggaatcttggaggtcaaacatatctgatgggaaagaaaatgtgtcaaagttgattattgggtatcctggaagcgtgtcatgcaactgaagattagaggagggttcggggatggagatacaaagaaagcctactttttaaagtcaccggatagaactcagaacacttaaaatagatgctctaaacataaagttcataaagagatactaggaaattctgtgatctacaaacacttaaaaaacatggcacattagtgccagttggggaagcttacaagggaattattcaagaggttggagaattgtgtgtgtgcatgtgtccatgtgtttaagctggagtctgcagtattgggt

SEQ ID NO: 11366 - DNA, 1030 bp, Homo sapiens
ttaaattctaaggtccatcattataattgctctcttacctatataacctctactcctttgcctctttttgccttatcatatatacttggcaaaaatcaacacccagttaaatccatctctgcctattccatgcctgcatcctgaagcatgaataaagaaaaacactttactttttctttattctttattttatggatttaataactcactttaaatccatatcagtaacctcaagtgagtcctcaaagatgggtgacaattgtactgtagttttctaaaccattgtacctcaacatttttctagacatttattcataccttactctcaactcttaaagttctagtatatcttcacctgtcattatactcagctgacgaccttgcttttctgtcactgaggatatagaagtaatcacagagaacttccacttgcttccatcgtcacgtctaaccatctattaacatctgtaatgttacttttccttctgttattctagataaattattcgtgcttccaattcaaaccaacctcttcatttcttcgctagatgcctttggtcttgactactacaggacactaatccagcagttacacttcctctctttctgtcactgtctttctcctgtattaacaaatgtttcctctctgccagatttttcccatcaacatttaaatatattatttctactaaaattgaaaagcaaaaaacttctcaggctaattcctccctctagataccccttctctccttctctatagatttctctccttctctatagctttccattttcatttcaacccactcagatatgttatgtcaccaaaactgctcttatcaaagttactagactttgactagtaagtacaacactcagcatcgttagattaatttgttctcagttctaattttatttgtcctgtcagcagcatttgacacagaggattactcattcctcctggaaacagttttttcccttactttccagaaacttccctcctttgcaaccacctaactctggtacctcttgt

SEQ ID NO: 11367 - DNA, 1040 bp, Homo sapiens
gggtcctctcagatttcctgatttattcctgcagttgttctggagcaaaaattcagcatggatcctccacaggctgctctgtctgtccaatcagagctgcaatctagtcctgcctcccgtctgccatgatctctcacagttctctaggttttgcatttgagtcatgtgaaagatgttcctgtgacattaaagacatcaagaaacccagctttgaaaataggatcgtctttactgaagaataatttccggggtaatattcttaagttagtagatgcactttaaagtctgttagaaataactaccacctttgaaattgctctgttacaatcactgtttgctcttcccccaaaccaaaactgttggcattttgatagccatagaaatgtataacacccaacactgtgacaatcacacccatcataaaagttaaatgaacattcttgtaacacccactgggacgaggcagacgtaggagggaaggattgagcacacaggataaaatgtgtctctgacaaattgaaagtactccctttatacagcattgttgtcttagttgtcatctgtgtctgatttgttttattcaaagccatttcaaaagcacaaatactgtgttgaaactgagattcaaaatgaatcatttccatgatctgtcagaatttgccttgccattgctagattttctgtgttttcccttgctatgtctccaattttgtaaatcttttttgatttattcaaaatatgactgtagtcaaaataagactacaaagaactatcatttctgaattgggagtgttgcattgcttatggggttttgttttatgatagccttttgtgaagatcatttgtttaattgtattaatcttgcattttaagtaaggacttatttttttcattttggttggtgccagaagggttaacatcatgattatcactgctgacaacttaatccccaaattaattgaaattctgactcccctctattggggcgactcttcactcctggctctgctctcagcagtctgctaaaaatgttttttaaa

SEQ ID NO: 11368 - DNA, 1049 bp, Homo sapiens
aacaaaagtgagaacatgtaaatgtaatatttgttgttttatatattccagattcagaacaatttgtgggcaggaaatgcaagtggtggttctgtggttacttcatgcatgttaccacgtgacacttcctcctgtatgacaccttattctcactcgcctcggacagattccagttacacggggttttcaaaccaccagaaccagttcagccacgtgcccctcaacaattttttcactgactctcttcttactggggcaaccaatggacatgcatttgaaacaaagccagagtttgaaaggaggtcttccagtatcgcagttcttcgaatgaaagccaaggagcacaccgccaatatttcatgggccatgtaacatacagtactcttttatttttcttttaatagcaaagttaaacattcttatttctcatatttaaaggataccacaataagctgctgtgtgtggaattgctaaaggtcaagatattcagtgagaccagcttaaatgaatagttgttatttaacattaaaatctaagaatgaacctctgaaaagactaaataggtttaccatgtgccagtctccacaaaccctgttttagtagtaaggttttctttttctattgtacaagtcaatgaaatatgatcacgcaacttattaaagaataaatgtgttaaacaaattcttctgttatagattgatttatgttacttctgtataacaagaaatctcatgtaaaataatacctgataaagaaggaaatgcactggggaaaatgtcaagatgccaaagtcgtcaggtaaatattgaatcagggtgttctggggagttaactgctctctctctctctccaaaaagcagtgggcaaaaaccctgttgctgagaatttattttcaagcctcatttttgtttttgtttttaccctttgatgttttagtgaatttccactctgttaaacaagggatcttttaaaataaccaacattcgcatgagatatttgggcatggtttcctgaagccacatggctaaaggtgataactgaagtattct

SEQ ID NO: 11369 - DNA, 1049 bp, Homo sapiens
cacactcacactgtgtttgctgtaaccatatttacatgattgcaattagagcaaaaaactccattctatcatataacattcctttcaattagaatgcctccttgcccacatttttcaggtagctagtctgtactcagcaacaggctctatgattcataacattttatggagcccctgataatgttcctggcatgtttccaggtgctggacatacacagtcaacaaaacaaggtgtctgccttcatgaagctcacattctaatggggaagatagacaataaacaaatatgtaatatgtcaggagaagaccagctataaaaaaaaaaacagtaagataaagtggagtcttacccagtacctggcagacagtgggcactcaaatatttctaagtgaatgaagatagtatctgtatgctaaagctaataccttttttctctttccaggtccatcgccatcatcttggcttatgctggccaattccagatacttacatgaattcaagaccagttattatcaacatgaacctgaacaaatgtgactctgcctttgatattaagtgtttgtttaatcattttttaaaaatagataatcagaaatttgttagactcaaagatataatatttgatgtataaaatgcaaataaaattagtttatcattatattctaatcttgaatattctaccatatttaaaaatatctcaaggtttctgttcattatgaaacatcaatatgttttctaccatttgtgaagaaatgaattttccagtttcaagtacctattcaaaattttattaaaaaccagcaaattaattttaatctctagccataaaaacataagtaatagtaagctcctaagcttggacaaaggctggattctcttcactataactgagtggtaatttaaagacaacaatttaatgtcactaattttcaaaattaaatagtttaagctcaatttaattttgctagatatttaacaaaacatacggctcaacctcataacctatatgtgtgtatgtctacatctgtgtatatatcataggatttga

SEQ ID NO: 11370 - DNA, 1063 bp, Homo sapiens
aagcggcgtccagggtagtgccttctgtaagaaggaaaaaacaaaaagttttagccttgtttagtatcagaatctgtcttgatagttagagtgagagccgcgcagccgtgatcctcgtttgggggcgagcgaagaattgacaagaggtctcggcatcccgaccccgcccgccttacctgtagcaccattcctttcgcggatcgtggggcttgatggttgtggagctagtataaagtcaaggctctagagaggagaggttagtacttgtccggaccactgccgggggtggagagagaagggatccaaggactcacctgtactattgttgccacttgcttggttacctagggtgcccttccatgaaagcgccttctctggtgtttaccactcttactcgtgcaagttttgctcatcctgctcgtctgctcacaatcatgctggagtatgatacatctctacctaactttcctaagaagctgtagacttaaatctaaatgacatttccaactatctggaccagtgctttgtctttttttttttttaaacgctgctttaaaaaaaaaattactgtacttgacagtaaattttcctttcgaaaataagtaatgagtttctttttaaacccccaatttgggtaaaataagtagctcagtacaaaataaaaagatactgattttgtgagatgaattttaaagacattagttagatttataggaatgacaattttactacttttctgaaagattatatgccaaatactattcattatcttgtttattcttccttacaatccagtgaaataggtgcttacattgtcctcattttccatctgagttaagaaactgaggcttggagaagctaagtaacttaaatagtgtgattgaacacagatctctctggctggaggacatattcttaacttctatacacctcctcagacattctgggaaaccaatatttgtgaagtgcttgttcctcaatcttgctatttttattaaatgttatattttaattttgtaagtgtttactcaataatttgaattaaacattcttcatgttcagt

SEQ ID NO: 11371 - DNA, 1028 bp, Homo sapiens
gtaaaatgtagatattaatatctttaatggtaaatgcagtgatgagcttttgtaccctgttggaccaaggtactttaataatcactgatcgttttttccttgtaggagagaagccacaagtcttaccgtcccttaacagtattgacatttcgcttaaattatttgttaagtgaactaaaaccaatgtcatatcatctcctgaatatgatttttcatgctgtggttagtgtgatatttctcaaagtatgcaaactttttctggacaacaagagtagtgtgattgcttctttactttttgcagtgcacccaatacatacagaagcagtaagtaaaactatgaactgactttttttctttttccttttttacaaatcctgcacagtgattataatggtatatatttttaagaaaaaaaaaaattaaccctgactttaatccaaatatttgaagactcttaaattcgtacagttaattcttaacttcctagtatgcaaagtataacttcctactgtgtaaaatttttaaatttaacatttttgaaacataaacatttttcattcaataatataaaatctgtttagaaatatatacatgaatacagttcttcggtcactttttttaatgaacaagatttctaaggactatttaaagtttattgtctttttaaactttatttttcagatttattatgagatgtaactttttgaatttatggtgcctttgtatattaagaacattcgtattttaagaaaatatgtaagaagtacttaagttctagatattctaccatatttacgtggttaccattggagaaagctggataaagagtacgcaagatctctctttactagttttgaaacttcctataagtcttattattatttcaaaataaatttaaaaaagtataaactgttaagagtcactaataaatgtctatttatgtaagattcacaaattcaccacctgagggcacccaaagaatgtttaagaaacaaatgtgcacttgaaaagttacggaaattaaagta

SEQ ID NO: 11372 - DNA, 1574 bp, Homo sapiens
ctaggagcaaaaaaatgttttgaaaggattttggagatggatccaagcaatgtgcaaggaaaacacaatctttgtgttgtttattttgaagaaaaagacttattaaaagctgaaagatgccttcttgaaacactggcattagcaccacatgaagaatatattcagcgccatttgaatatagtcagggataagatttcctcatctagttttatagagccaatattcccaaccagtaagatttcaagtgtggaaggaaagaaaattccaactgaaagtgtaaaagaaattagaggtgaatccagacaaacacaaatagtaaaaacaagtgataataaaagtcagtctaaatccaacaaacaattaggaaaaaatggagacgaagagacaccccacaaaacaacaaaagacatcaaagaaattgagaagaaaagagttgctgctttaaaaagactagaagagattgaacgtattttaaatggtgaataacattaatatttatcgtgacaatggtatcaaagaacatcaatccgtatcatgtgattgcttttactgggagctttgaaaaaaagttcaagggttcctaatggtcaatcatgagctgccttgaagtaggatcaaaataagattttcattaaagacctgtattatcccaggatgtatattatgtatcgctgttttcagagtgtgggtgaatatagcagaaatattacagcggaagtgacaaatttacaacttttattatagaaagaaggtgtttctggcaatgtaatctttactgctctcaattaaaaataattttgaggcctgaatgataatcccttgaggacaaatccaacatgtgctggtttattctgttaattcccatttatttgcctacttcatttttcttgcacctcttagaatctaactatgaattgaaaacacttaagtaattctgtttaatcaagggatttacactacaaaagaatgctggctttttttatgttgtattccttagttgagttttagaaggaatgcttgatgaaacattttaaaataagtcatgacatgttagcttgagaatgtattttcataattgtatacttgtttttaactttaaatgtaatttttaatcaggtaaagtttgacacatgtatagctacatacacacatttttaatggtgctcatatatactgtattttttgttgtttagttttacttattgagagtgtcacaacatgaatcacataatcatgattttttttttttacttttactccccaaattattcatgtttcttagatcgtagtcattgagaagtcccaataactctaaacttttgagttataacgtagtaaacttctctttcatctttgtgttagctctgtagtcttaacctggattttaatttttttgtttccaaagtcacaattgaattattcttagataccttaagccactgaattcagttctgtttgactgaaagcaaaacaacgtgacagtttattttcaaacactaacttcttgatattttgttatggtatatctttttattaaatatttattttgactaagctttcataaaatatttgaa

SEQ ID NO: 11373 - DNA, 1030 bp, Homo sapiens
aattaaagtacattttaaatgagctttataataccttaaaaagttggttctaatttaaaatatgaaagctctggctatcatcctgggatagtaatttctaattatatagtatttcaaaactatatattttttagttcctttgagataactaatttctaattatatatgtttcaaaaaccatatcctgtattttttttaagaattgttttataaataggtcataagatacaaggtctgcattagaagacccactcttactaggttccctaaggatctgccatagatttttttttttttttttttttttttaggtagtttaaagcaagcactgataccagtgggagttggtcttgatctaggagattctgttaagcatccaaaaacaatgcctaatttcagttcttaggttatggcttgtgactccagataaaagatggagaatacctcatgtactgtgacttgaaaatgaattcttaaaattcttaggctctctccatgtatctttcttaaggaaaagtttctgagtgtgatctctcttttgccatagtatcaagtggagggtagttcagaaaagttaataggaaatcttttgtgacagcagactataatagaagtttgagtaatattttaataaatttatataattcaaatgataaaaatgtatcaatgttatccaatgatttttattaaaaaattaccttattattagaactgtgcctattacataaaaagtgctcatgtatttgaattttaaataatttatttaaatcaagaccaccataagtcattaataatttaataattgttttaaatcagtggttttcaaccctcacttcatattagaatcatctgaggacttttaatatggaatccacctcataacaattaagtctaaatttctggaagatggagccatgcttgtttttccaaaagctctttgagtgattctaatttgtagtcagagttgaagaccactgctctaaattagtgcaggaaaatgcttttatttctcccatgttaacttttaaaa

SEQ ID NO: 11374 - DNA, 1054 bp, Homo sapiens
aaatggccttttattataccacatgcttgactttggttaacattaatattgttgtttctgttttatttggagagtgtaattatttgctgctataattcttgaatatttatgatcatcttttcaaatcatactgagtgtttttcctttaatgagttttctccatgcataatctaactcattattcattaaagaacaaaaaatgctatcatgaatacaagcttattaaatgtttcccctgcttttcacatgctgtattattaaacatgccatatctgaatacatctaaaccatcccaatttcagcacttttcagctgttttcttgtcaaaagcctgcttcttaattttgatttattataagattaatattggggagaatagttaaattaaaagcatttactagcagaaggcctttggttctttgacaattttcttcttggccttgaagtaaaatagccttaatgacaagaattcttactgttttcttttcatccatgtatgaaaaatgatcattccggaagctaaaaaacacttagtccttcgaaataaaaagaagtaagcacccatgaaagaagagagatgccctagaaaaacaggaggattagaatgggagtgccctgctttttatttcccatctgctttcaaatgtgtggatcaccctttgaggtctgcataaaataaagcaagtggatgagggcagaagttcattcttggttagaaaacctttattatacttgtcagcaagagctgcaatcaggcttatcattgagaaagacgttttcttatacttattcccagatcgcgattatccaaatagatatcttcttttcaaatttgagatcagtataatgtaatttttgagttccaaatcaatagtctttctgttatttccctttcccacccaaattggaagaaaaatgatatagatctcccttaaccaatttatttatggaaggtgttcactgtacacactacatgctttggtttaattcttaatgggtttcatatttactgtagcttcactctcaggtaagctagaggttaaagttttctaac

SEQ ID NO: 11375 - DNA, 1047 bp, Homo sapiens
tataaaactttgtaaatctgataacctgtaggttgagaattgaagagagtgagtcatcttgttagaggatatgatctgagggaagactctagaattctccttaagtgaaatgcacagccaattttaacatctggtttagctcttcagaattttcatttctgtgattgtgtgtagttgaggctttatctattacatgattattacagaataaactctgttagctttcctggagattctattgtttctctatgaatttgccttcactctgttgaaattgcattgccagacttcccaggacagtctagaaaaccagcttgagcccacctctctagttaataggtgagaaatgtttccctctactggatgaaaaacacctagatcctggttagaagatttaaatgtatgttttgtttgaggatgaaatgtttatatagagtacaaatggaagtaaaagagtaattgcaatttgaccccaaaaaagctacgtggcgctcccatctggctgttcctgtactgaagttctcagtaagtttctactttaaaacagattgttctaggaaagaaggttgttctaagagcagagttattcttttaaggtggctttatatattaaatattttccattttatctttttctgttctgtagggtaaataagtattagtatttgtttaggaagaaattaggtagcagaagtaacctatcccaaggtcacagaagctggcagatccttttgagctctggtcctttgtttctaaatgttttgtttatttgacctacctccccagctagttatttctgtggggaagcaccctcagttttggccgctgggcttctagacaggcccacagctaattgccctgtagagtagctgggtactgtgcttgtacagtgaaagatgacaatgcttttacaaataggtaatcagaaatggattctgttgaatgtatttgcatatatgatagtttaaaaggggatgaagagatgaggtcttagctcctaagaatcattctgtagggaaaggttggacaagggatcaatggaaaggg

SEQ ID NO: 11376 - DNA, 1047 bp, Homo sapiens; identical to SEQ ID NO: 11375

SEQ ID NO: 11377 - DNA, 1047 bp, Homo sapiens; identical to SEQ ID NO: 11375

SEQ ID NO: 11378 - DNA, 1073 bp, Homo sapiens
ctttgagggaaagatgtatattcagtatcttttcatcacatacaattcttgttgagtatcacacaattagtagataaggaacaaaatcagcaacttctttctccacagtgcttctctttaaggtggagaacttgtgctgaattgtcactttttgacaggagtcagtctgttctctgtccttctagaggctgaagattgtaaagacaaaagtgaatggatttagtttggataccatgtgcatgatgcttctttcctgctagcccattttcatgattctgattttctttcgaaaagcattttaaagtggtaaggttttgcatgaaaatttaagtggataaataactaacagttacatattttacctgttctgaaaaggatataccattaattggctgtagatgtccaatatgtgacccttgagatgagcacttgaaatatgactggactaaggaattgaattttaaattttatttaatcttaaatttagccatatgatgctagtggtgactgtgttagctgtagaccctcaaaagcatgaaaggttcaaaagtagcagagtttaggacagactggaattaattggcagatcaagggcccagaggagcccaattctatctgcaggtttgtcaatttagatgagtagacaagtgcttaatgaaacatgctggattttaaaactaccatcaccaaaagttggatattagcacatctgccttaagctagtagtttagatgtgaatcatttctggaccatagataattactcatttaaatttatcggccttttttttgaaagatacatttggctgggtgtggtggctcatgcctgtaatcccagcagtttgagaggctgaggcgggcagatcacctgaggtctggagttcaagaccagcctgaccagcatggagaaaccccgtctctactaaaaatacaaaattagctgggcgtggtggcgcatgtctgtaatcccagctacttgggaggctgaggcaggagaatcgcttgaaccggggaggcggaggttgcagtgagccgagattcttatatcataaattactggattgtgctaaatca

SEQ ID NO: 11379 - DNA, 1073 bp, Homo sapiens; identical to SEQ ID NO: 11378

SEQ ID NO: 11380 - DNA, 1680 bp, Homo sapiens
gtgaaagtcagagcacatattgtatatgaaagtgggttgtaaactaaaaagcacacctatgagctcagggttaacggtgttaatgtactggcagtgcaaggtatcagtgtgagtggtttagactagcaaataagagggcctgtgtcctaattctcttttatcactattggggggaagggcacggatactcattgaagactattaaaaacaagatttaacaatggttatttgtcatttattcacaacaggccatgaagattgtggttttccccattttgtcattggagaaactgaggatcgtttagttaatgacttgtttaaagtttcccaatttggcagtgactgactctaaagtccttggaagcaagacgtttaaattttgtactttagtttcttcatgaatcagaataaagatacctcacatgattaatacgagagcaaaatgaaatggtggtgaaagtacgttggaaagttaaagactttgtacacatataagatggtgaaattttatctgggacttgagggcatttatgagttcctccaattgagtaataggctaaggataggccttgtttgatatttctttattattattattattattaatggctcagggcagacaactatttcatttaatcagaaacaggatagtactgtaaatgatgtagtatcttgtgtatggaaccttggagggtgtacacagccacactagcattaaaagaatgaatactctgtgtaccatttgtgagtgactgtttcaagagtaattacacatttactgagtattcattaagtggaaggagctgcactgggtcctgcagagaagtttgtatctaagataaatagtaatggacatagttccagtggttctgatcttatattctgtccatgtcgctcttcgtcctgttgttcaatcatgtggaattgccaagttgtttaaaagcattgcttcagttgacttctaggcagtgattcttaccttgttcttgtggtgtttaatataacttaaatttaccataggtagcactgatttttctttatctcttcagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaagtaagtgaaattttttttaatgtttaaaaacttttaaacttttaagaattaagaaaatttaaagcatttagttattgtatatgcctgtaatttgcaggagtgtttgcagcaatggaaagtgggagaaaacctaaatgtcagtcagaaggggaatggataggtcagatgtggtgtctcatgcctgtaatcccagcactttgggaggctgaggtgggaggattgcttgaggccaggggtttgagaccagcctgggcaacatagcaagacccccacctctaaaaaaaaatgtgggttggggaggggaatggataaattatggtacatctgaactgtgactgtcatgtagctgttactgacatggaaagatctccaaatagaaacaaaaaaagcatgtcagaaccacatctatatatatctatcatatgatcttatttgtatgtttaaaagatgatccatcatatgca

SEQ ID NO: 11381 - DNA, 1070 bp, Homo sapiens
aatttgtgattaattttagcttttatttatttatttatttatttatttatttatttttttgagatggagtctcattcttttgcccaggctggagtgcagtggcgtgatcttgacttccttcagcctctgcctcctgggttcaagtgattctcctgcctcagcctcctgagtagctgggactacaggtgtgtgccaccacacctggctaatatttgtatttttagtagagacggggttttgccaggctggtcttgaactcctgacctcaagcaatctgcccaccttggccttacaaagtgctgggattacaggcatgagccaccacgctgggcccagaatgattattaggccgggcactaattttagctttaggctggagtgcccactgcactccagcctgggtgacatagtgagagtccatctcaaaaaaaaaaaaaaaggtaatcattttgccttgaatacagtataactttatttctaaaacattcttttttttagcaacgtagagcttgctctgacttctgatggcaggacaatagtatgctaccacccttctgtggacattccatatgaacacacaaaagtatgtatgagaaaatttcttgcagtttttaatttgctgttagaaatgtttgcacttctttatagtatccaaaaagaagggagtcatctgattttctttgttttagattttcttttggctttttaattttactattttgatttttctcttatttatttttcatctgctttctttacagtcttttttcagaatacaaaatgaaccatttaaacacaattatggcatcagttttctggtctaaaaaatttggtagatttctggttaaggatcaaatacatctagtataaaattataaaatgcattatcccatgctaccccatattataatctagacaattatgagaaagttgtattttagagtgctgggattacagctacttttttactattggttctgacagtttttttttttttttaacatttggtgaatttctttatttttatgttttaatgggccaacataggtatatattttgaatggcccagt

SEQ ID NO: 11382 - DNA, 1031 bp, Homo sapiens
ataagaacattaaatgagggctttctttttttcttttttttttatttgtagtagagacacggtctcgctgtgttgcccaggctggtcttgaactcttgaactgaagtgatcctcccaccttggcctcccaaagtgctggaattacaggcatgagccaccacacccggcctttctatttttctttctcttttttgagacagggtttcactctgtcacccaggctggagcacagtagtgtgatcacaggtagcctcgacctcctggtctcaagtgatcctcccacttcagcctcttgagtagctgggactgcaggtgcatgccatcacacctagatagtttttaaattttttttgtctgaccatgttgtccaagctggtcccatgctttggaactcctgggctcaagtgattctcctgccttggtttcccaaagtgctgggattacaggcatgagccactcactgcacctggcctaaataagaactttattattggaaaagaaacctaaaatttgctgtgagaagaaaaatatttctgactaatgaataatgcactaagtgaaactttgttttgataacttatttgcccaccctaaagtactatagtgaattactgaatatggtaattgttttattgtgatctcaaacaaatgctggctaacattcccacatcttcatgatgtttgttactgattattttgtagcctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtaagttttcttttcttttcttcaatccctactacatacagtaaaggaacacatggattttcttgcaataacaaacttctgaagtggtgttttgcatgaggaaattaaccctaagtagaatcacctactatgttgtactttttttttcttttctgagacaggatc

SEQ ID NO: 11383 - DNA, 1054 bp, Homo sapiens
aaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttaccagctttgtcgatggtgtattcttgaaaaatgtttggttttctttcaggttgacttatatccaaaattctacaaattcttagctatgttataaatgtagaaagaagtgaaaaatcaaaatatgattatgaagattttcttctcttccgagtacaaagctctgctaaataaggatttacccaagatgcccacatccacatacttatgtgtcagtgctttggagaattaactttgactttattctactggaagtatagattaacactgtgctttctgggattttgcttttcatgggttgctgatttttaattttgctaaataagcacatagtccgtgatcac

SEQ ID NO: 11384 - DNA, 1022 bp, Homo sapiens
aagatgagttgaatatcagcccacaaacactggtagtaagcaaactattttatttgctaaaggcataaataaatgtctcctttgcttttaggcaaagggaatgcttcttcagatttttttttttccccagaagttcaaaataacttgctcatagtcttcccaaaataattttcaaacattctaacaccaaagaaagatactcccaattgagctcagccatcagcctcctactattttttaatgtgctgtttaaccttgtgaatgtgagaatattttgaatgcactgggaaggaatactcaggaacaatatgtaatgtgctttctagttttgcacaaaggcattcattttgatttagtaacaacctcatacttacatagcatatccttctgcagaaatgcttcacagccatgactgcttgaattcttgtcatgttgcttgtaaatgagctcctgtttttagatggagaaatggaggcagagtctcacaattacatgtgagaatagcaagtagaaccttatgattacttctgagtcttttttttttttttttttttgagatggagtttcacttttgtcacccaggctggagtgcagtacagtggccagtggcatgatctcagcccactgcaacctccgcctcataggctcaagcaattctcctgcctcagcctcccgagtagctgggattatgagcgtgcaccagcatgcctggctgattttttgtattttcagtagagatggggtttcaccacgttggccaggctggtcttgaactcctgacctcaggtgatctgcccaccttggccccccaaaatactgggattacaagggtgagccactgtgcccagcctcttctgagtcttcaattcagcaagaatgtctcttttttttttttttttttttttgggacagagtcttgctcttgttgccttggctggagtgtagtggcacattctcagctcactgcaacctccacctcccgggttcaagcgattctcctgcctcagcttcccaagtagctg

SEQ ID NO: 11385 - DNA, 1057 bp, Homo sapiens
cgaatgccatccccttgagttaagtcagggactatgccttgttcacatctgctgcagccatcacagaacctttaaaaaagtaggttcttaaatcttaaatgagtgcatgctgtgagggaaggaaagcaaatagactttttggctcaaataaagaattgatgtgtttagaagacaggtaaagagaaaagggacgagttgttggatgatcttgatatctaggctttgaatctgggcttggcagggtaggtgcatgagccctgaatataagggagctggcctagggagagaaaaaaaaccatcacttcaactcctgtcttccagggtgttgacatcattaactgccccacatccaccagatttccccagatcttagttgacatagagacattcattctgtttctcaccttaagaaaatccatcctgagttagcttcagttggtgctgctgctaggctttatggtgataggctttgggaggaactgagaatcccaaatgctaggtggtatctgaatgtggcattacgagatataatgctctaaactctgcaatttctcttgtaagacggaaacaattcaacctgttctttgactccttttctgggttttcttggctccaggcttcttagaacactgatcacactgttccaccacccccaatctttacctccattctctctaccctcccagcccccaccaaaacacaattcttttcaggcaagtgcaccatacaggtgctctggtggtcccgtaactgaggatgtagttgccagccttttagcaatatcaagagttctctggaggctcttgagagctgtggccttggttaaattggacagaatcacctttttggtaaattcccttccgattcatttcacaaatggcttaaatcatttatgttgttttgttcaatccagtcaggaaatgaaagcattgccattttaattgttttagaacagcattttacacctaatatagactcccaaagccagccaaatgcagattttggctcctagatcgctgactgcatgctgactgtgttcttgagtgtggaagaaaac

SEQ ID NO: 11386 - DNA, 1003 bp, Homo sapiens
cccgtaaaacgttttccacatggcaatcagagccatcttttaaaaatagaaatcagactttgttattcctctgcttaaaacctcctcctaggactttacattgcactgagaatcagagctcctcaccagggcccaaaagggacaccgtgacctggggactcctgctggcttcttcagtcacatctaccattccctgccttctccctgtagcccagcacaggcctcctctgtcactccagtcggccaagtcagtgcccacctcgaggcctttgttccagcctagccgttctctgtgcctggtgtgccctgctcccagttttgctctaataagtggctccctctggtaatttaggtgtcaggcctccttgatgaggcctgcctgatcaaattagccacctcccaagtcactttctgcaacattatcctgttttgtttcttgcacagcatttaacactatctggaattatcctccgcacttgattggacttgttacttgacaagcgaatttcccttctctagactgtaagctctttcagaagtagggcagctttaactgcctggtttatcctgcatccccagaccccaggacagtgcctgtcccatcaataattatgtgttgagcagatgcatttatggaccagatcatcacagaggattttgaaattgaaaaaattacttaattaaatgaaatgtttaaaattaattttttgggattctgaagggaacttttatgattaaatttctgtgtactacaggttgcctattgtgtagtcatgttttagtaaaagttcttttcctgaggcaggaccatttcagatgggaaagataagttttctgtgctctagggacagtctcctgtctgccttgaacacattagacagatgaccttaatgatcggaagagatgcattggaaatacattcctttccctcatcagcagtgcttttgcattagcattgagcagggtttgactttcttggtgatacagaaggtgcaagaagctt

SEQ ID NO: 11387 - DNA, 1040 bp, Homo sapiens
actctttttgtgtttgtccatttatttcaagtccgttaggggcattttctcttgtctgtgctgatttgctttatagaacttggttcagtacaacaaacctaaaacagctccttgtacatagtaggtactcaggacatgtttgttacatgaatgaataaacctttaggggcaagatctcctgggcttttgtgaagaacatgcagactaatacattatgttcctgcccttaagcagactactgttttagcagggctacttcagaacctaaagccaatgtttgcaatagaagcctaataaaggaagaatgtagaagtgtgcaatgtagaaaggaacttcgggcatataaatctgactccagaacctcagatccagcctctattctggctttttagtaggcgagttcttcaagggagagggaagtgtggttatcatggacaactgaatcggggctttattcacactaggagaaatgacccggaacttggtaataagatgaaagaatgatctttcagagtcgtagtagagcgttgtctaacaagacctaaggctcatctgattctgtagaggatgtgacttcattttagatgttaacttagagaaaactgatatgatgcaaataatttctggcaggtagaaaagataactctaaaggttttgttttattgtcctatagaatattcacatactacataaaaaaataacaaaaaatacatacaaaaaattctaaattacatacaaaaaaacctacattttgtatgtaatttagaatcttattccagtatttttttttctaaaaccgactatatgtatcaatttcttagccaatttactgttttcattaatgaggtatatgtgtctttgccatgctcactatatatttgcatgtggattatacttttaacattttgaaaattatattttgacattcatattcagtaaagtctttagacatgaatgtacatgtcattatccaagttacctaattatatcataccatgtaacttttaaatggacacatcgcagatgtcacaataagggaa

SEQ ID NO: 11388 - DNA, 1032 bp, Homo sapiens
gccagagcactgcaaaaaagggaaatttgtcatttgccttggggaacaatggctttcaccaatcaagaggcaaaatcaaccacagtctcagagcctggagtaagatggaaaaatcttcctgttgtctttagaggaggaggttacatcatttcttacagaaatgagccttgacaacccccacatcccgatactgcatcctctttgtaccacagtgaattgttgccatgaagctgagacaaggcttggtatgggcaactccaggcatgggcaactccagacctcatcctagtggtgatcctgggctccttcttcataagcaatagagaagcagactgtttgggaggaggaaaaagtagtgatgggacaagttcccaaaaagaggccatgggagggagttcagtgttacatgcagtcaccttttgggttttgtctctattggattattctgttttttgtttctcattggagtctagaaatgtttaatgatacttgatggtacttcctttatccatgtaaaagtatatctaagaacttctgcatatattaacactctgtaatgattaagccaatgtaattagagtattgtatcagcaagagaaatatttttctctagacatagataaatcaaattttttctttcaaatctctgtgcaattgctccaaaatggaaatcagttttatgatttcatggattgtcatctccttacaacagcagactaatgaacatgatgatttatgcaaacaaaatatactcatttaagaatatgctcgcattggccgggcacggtggctcatgcctgtaatcccagcactttgggaggccaaggcaggaggatcaccaggtcaggagttcgagactagcctggtcaacatggtgaaaccatgtctctactgaaaatacaaaattagcctggcgtggtggcaggtgcctgtaatcctagctactcaggaggctgaaacaggagaatcgcttgaacccaggaggtggaagttgcagtgagccaagattgtgccagtgcattgcagcctagg

SEQ ID NO: 11389 - DNA, 1027 bp, Homo sapiens
tctgttccccaggcaggcacagtcatagcttactatagcctcgaagtcccaggctcaagcaatcctcccacttcacctcccaagtgtcaaggattacaggtgtgtgtcaccacgcctggctcatttttatattttttgtagagatgagatttcactatactgcttaggctgatcttgaactcctggccttaagggatcctccatcctcagcctcctgaagtgctgggattacagacatgagccaccgtgcccaagctcctgttggattttgatgggaatattagccccacacacattttctcttctgaaccaggaatgtctgtgcaagtacaccacatagactccttagcatgagccatataagggcaaaggtcacatgtttaatgtcccataaacatcatttattttgtttaaagtagtctatcccaatgacaatgacagcattcttgacctgagtcaattctctttgctggatccaaagtcaaggataaaagtgagggtcacttggcatttgcctccttgaaatgtagctctctgagggcccacctgtgtcttgtgtcctcttctttcctaatgaagtgtctggcacacgaagtcatgattaacgaaggtctcagtgaatgaaggaaacacaaaaacgtatgtgtacccctcagtacggggaaagtgatggagaactgtaaatgctactgtcattgagtcaaaaaatcttacacatgtttcttatgcaagttatgtaacttctctgtgcttcactctccttacctctgaaagacagataatcatagaaccaacctcataacaccgttataaggaggcaatgagagagtatttgttgagtgcttagaacagtgtcaggcacggaataaatatagaaatatttgatgatgaataaacaaatgaatgaggggtgcctggcttttactcaggtttgcaatgtttgctgaaagagtgaatcaacaaatcctagaccagaacgttccaacactcacatccttggtgctcagctgttcccaggagtagtagt

SEQ ID NO: 11390 - DNA, 1112 bp, Homo sapiens
ttttaatagagatggggtttcaccatattggccaggctggtctcgatctcctgacctcaggtggtccaacggcctcggcctcccaaaatgctgagattgtaggtgtgagccaccgctcatggcagttaagataatttatagtttaaacttagttaataaattgtgtattgtgaacatcagggatggcttttatcacagtgttatttcattttcttctgctaatcaacaattgtatgtgcaaggtagttcatatgttaaacagtaagtgcaccagaattatgaatctaaatctttcctaaggaggtgtgctgatagctgcttatagagaaaggatttgttgtttttttttttaattaggagggaggatatcacaaactggcagaaaaagaccttttgaaaatgaatactatagaatttcagttattactggcttataattatgcttttctgatatagtaattccagttccatttgtaatgcacaatatttttggaaatgtaacattacttatagatacaaatatcatcattgacttgggctcagaactcttataatagcagggaatattatgtgacataatgcttgctatattttgctattttaaaaaatgatacatttatgtttgtttcgaagtggtagattttttaaaagattggacttaaaagccggaagagttggttatttgtggtattctgcaaataaaaacatcttcattcctactcacagttttaaaaaattcagattctatctctttgctataattctttgatgatgtaatattaactcctgccaaagaggtacctaacaacagaaatactttagataatttactgaaatttcagttcacagttactgaggtagaagctggccatgtttttccactaaaagatacaaatattcacccaagtttattgattcaaagacatgcatttttttcatcagcagttttataataatcacaattcctaaaccaagcactttgtggaaatttgctccttgctatgtgttttttccttacaaagactttccaccagtaagattgttacaatgtaaggtaagaaaacagtgtgaactatgtcacgaatagttaatacagtatacagtattaagat

SEQ ID NO: 11391 - DNA, 1035 bp, Homo sapiens
gaccaccgaaccccagcgatttcagggcctagagtccgtcgtcgcctgacaggtgtagccagaggcgccctggccgtggccggcctctatctcgggcccgcccagaattcccagacggtgcccggttgccaggctctgggctggagcggtgtctcttccttcctgggaatggatgtgcggcgggggggactgcgcccggctggggcggggccgaatcgtgccttttagatagtcacaacttagcctcctccttttccatccgcgatttttttgggtcagtatccagagtgcttcaggtcactgttcaccgtcaaggcgtggccctcggaatgaaggcagcaggtgcccgttttctaacacggtttaaagtctatttgtgggacctactgtgggtagttagggccagggcatctcagcatctagattcgattcttttgtcctttgctgttgcgctaggtgtagccagttcttctgactcggggctctagatgtgagtgcttttgtgtgggactattttaagacgttctctgccatcttgaatgaaaaaaatcgggcgagtgtttttgatgccatttttttccatcagacacaggtcaaaactcgcacccctgtacgtatgtgtattgcatgtatacgctttactttcatttatccaactagattttaagaaaatttaaaaatgaagtggcccatgccatacagcgagagagcgaggcacagacaggacagaatgctaaatgttgaaatatgtacaaactgtcattgaaggattaatttctgttcttgcggcctcccagaggctacacccagtacgcgatatccgaggtgaatctttaactatgaattggattagaaaaaccggcaggagaaaatgtattacagggaaagagaactgattatgccaagcttgggaagtgtgaaagtacctggtgtgcatttttagggggcggggtgtggagggtggctatgtaaagtggcttgatgtggctgcaatgaagaagcagtggaaaatgtggccattttaccgaagtgaag

SEQ ID NO: 11392 - DNA, 1052 bp, Homo sapiens
taattactataatttaaaaaataggttttaatatctgatagcataagacccttcagctgtatttttcttcaggattgcctttggctattcttggcccattatatttccatataaattttagaatcagcctgtcagtttttgtaaaaaaataaaaaataaaaataaaaaaaccctactgagactttgattgaaattgctttgaagctataaattaatctggggaaacttaacatctttacaatcaatattgaatcttccaatccgtgaacatttattgcttgccttctaaatgaatcaagcaacttctcatctcgttctgtgctctaggactgattttacaaaatgagaattatctgtttcttcagagtatagctaaattggcctttcctggggaaaagagactgaatgttgtctatcagctcaatttcttttatggttattgctcaggtacaattttctattttgataacttttttattctgaaaggcagtgtaatatagttaaagatatgggctctggagctggataacctaagaaatcctaggtcagctatttattagttatattagttaatgtgactttgagcaggttacttaacttgtctaagcttcagttttctccatattaaataaaaataacagtaactatctcgtaaggtagttatgagtactaaatgatttaatataagtgaattacttagatgagtacctgacacattgtaaacactcagtaaatgttaccttttattaaatttttccaacaaattgctttttatctaggttttcaaaattattgatatattcttagtagtctctttagtttcatttatagcacaaattagatctgattgttgttatgtttttctttttgttttgcatagatgtgctggagtttcaacttaccagatagacttttcttttttttgagacagagttccactctgttagccttgtcgcccaggctggagtgcaatggcaggatcttggcttgctgcaacctctgcctcctgggttcaagcaattctcctgcctcagcctcccgagtagctggga

SEQ ID NO: 11393 - DNA, 1046 bp, Homo sapiens
ctgcagtgcaacctgcttcggggctgaggtgggaggattgcttgagcccaggaggttgaggctgcagtgagctgtgatttcagcactgcactccagcctgggcattgaaataagaccctttctcaaaacaaaaacaaaaacaaaacaccaactctggtttataaccaagatatgcaagaagaaattccatgtttaatatgaattataaaaattattcttggggaacaagtctgcttttttttctgcttatgttgtgtcatttcttctgttttggcttcttcacagatccttggggctccagtttagattaaaattttgtttctgttttatgtctaaacattcaagaaaagtaggtagttctctcttttatgtattttttattgcatttattaaaatgtaagtccatttgtctcaagctatgacacacacagtgcctacattattttttttagttaccttggtattttatgtgcagctatattgaaggttttcatttttttaaaagcattgtggaaagaggaccagacgaggagtcaagagactgactgacataaattagcaatgaaattctgaataaatcacttaatttctctagagcttgtttcccaggatcatcctttataccatatcatcctttggtatgaaatttttcttaaatccattctaggggatcggaaactatctagtgggttgagtaaatgagagtaggcccttagaggcttccattaattaggaaatacaggaaaagaatctattcatttccagtctctttttatattagaaatcctgactcaattttagttttccctggttctgtaccaggtgttctctgagttcctagaagcaaatcatgccttaaggatttaggagaaaaggcccaaagctcagtgtactcgacaggggcacagtgttagaaagtgtactaacttcgaccagatgtggtggctcatgcctgtaatcccagcactttcagagggtgaggcaggcggatcgcctggggtcaggagttcgagatcagcctggccaacatggtgaaaccccatctc

SEQ ID NO: 11394 - DNA, 1026 bp, Homo sapiens
ttaataatcctatacaatgtcattcatttccttcagcaaggtatcctgttaaaagtggctgaaaccatcaaaagttggatttttttttctcagtgcaataagaaagatgacttacttcacaagttggtaagtggtcacttctttttgccacttttcagggttctaggttattagtgaaataattggtgaatcagaatttgttttgctatcaatttggccagcaattgatttttactagagattctgcagtaactcaggatcttttaatttgggcttactggtattgtttatagcttttaaagaggttattagccactcagaatggaatactctgatagttattgaaacgttatttgttagattgctaatttactattgccctcttcctccattgacaggtatccctctctataggtaaaggaatatgtcattagtgggatcaattcaatctgttaaatcacagaatttcccaaagactcgaaacagtcaacctgaaaggtctttgtgatttttgtgaggctttgtttttttctactctctgctgtaacagaactccaggggggaaatacttcaaccttctgacgtcctaacaatacaaaatccagggagtatagcctaaaaattcaagttatgtggttctcatggctcccagaaggagtaatgtagttacaagtaagcaggtttcaggatctctgctggcctgtaaccttaagaattatcattcctgtaaattaacatttgtaaggagattgtttacaaagtgctttcacattttgatttggtaatctaaacaacactataagatttagtctgcttcagtaacgagaaaaccaaggttcagacaatcagtttgttttaataacttactgagtgaattgtctaaaaatgttcagctagaaagtgatagagccagaatttgaacccaggtctcttggttccaaagccatgctctttctgctatagcatacgacctctctagctcaagtattattattttttggctgactaaaattacttttttagcaa

SEQ ID NO: 11395 - DNA, 1060 bp, Homo sapiens
ctcccaaatacctgggactataggagcatgccaccatacctggctaatttttgtatttttttcagagacagggttttgccatgttgcccaggctggtcttgaattcctgaactcaagtgatctgcctgcctcagcctcccaaagtgctgggattacaggcacgagcccctgcacctggccagggcaaatatttaataagaaattgcatgtgattttctttgcaatatgattattataactctttccaaatattgctgtttttcagctattctcagacacatcccccttatactcccctctttcttttcttttctttttttttttttttttttttgagacaaggtcctgctttgccacccaggctggagtgcagtggcatgatctcggcttactgcagcctgctcaagtgatccctccgcctcagcctccgaatagcagggactacggatgcatgcaaccacacccagctaatttttaaattttttgtagagaaggggtcctactgtgttgcccagtctggtctcgaactcctgggctcaagtggtcctcccacctgtgcctctcaaagtgctgagattacaggcgtgggccactgtgcctggccccctctttcttatatatacacattttcaccaaagcattcattgctttaaagatgtattttagtctgttagacttgcaattgatatgaattttaaaatgtgtacatatttttgtttcaattaaagtagtataaaagtacaaaccttgtccatatcatggtctgtggtaagtatgtatattccaaattgatgatgattatttaaaattagaggactttattcaaacaattactcatcaagtgtgtatcatttctaattggaaaaatgtgtacatattcttgatctagtatgtgtttctatgcaaataaagtttgattttaggaaaagggatttataatatctctgaaatagtatttttacttttaaatctataaaatcggattttaaaatctctaatttgctttttaggttaaggattccatatattttttatttttttaaaagtggtttcagaagat

SEQ ID NO: 11396 - DNA, 1049 bp, Homo sapiens
ccttttttcttttttttcttttaattgagatgggatttcactctgtcccccaggctgaagtgcagtggcgctattgtggctcactgcaacctctacctcccaggctcaagcagtcctcccacctcagccttaggcacatgctaccatgctcggctaattttttgtatttttggtgaaaaaggggtttcaccatgttgcccaagctggttttgaactcctgagctcaagccattcacctgccttggcctcccaaagtgctgagatttaagcttattttaaaataagcctcgtaaattataaatttttcatttcatattatagaaatctgtttctgtttttctttatgactcagggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggtacctgtgagagatttctttgccatatgcttatcagacatgcttattccactctggtaggattttattaggtagacttcttgtctttatgatgaaactagcttcaaaatttcttagtttacttttttttaatgttgaatttatatgtacaaagtgacactgaatacaattcttggctctcattttgtaaattaaaaatgaatatgatttgaaagttcagtgaatcatatctcttttttaaaaagactgaaatgagagaataaattttgatagcatttttctattattagaacttccagaaactctttttcagttaggataataaaagaatgagtttgatagtctggggctaggaacttgagtttttcttttaagataaaatacttaactttagtcattcaaaaataatatacaaatgatataattagtggcactgcatatttagtactaagatctaaagacattgtgtcattatttaataatatatcagattgctttgtgct

SEQ ID NO: 11397 - DNA, 1095 bp, Homo sapiens
tcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtggtgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaattgatgtgtgctggggtttggaactaaaagtagtttcaacagtgcgtgggttatgacatttcttatgtttctttgttcatgtgtgtatttagtagttaattttaagatgtcctagtgatctttaaaagaaaaatattgtaccattttttagaatt

SEQ ID NO: 11398 - DNA, 1050 bp, Homo sapiens
tgctttactacttagaaatagctaaatttcaattttaaaaatctttgtgtgttataactgttaaattattcaataatacttagggtttactttcttatttaaatcacttatttagtttaccgacttcatttttctttggatttagaagaagcaattatggaaaaacttggtaatctctctcaacctataaccttacacaggaagaattagagtttaataatttttaattcttttattgtatgttacttttattacaccagtttgggggaaaatcttcataaaattgtatcagttttattcagtgttctctaaggtgataccttttaattttgaaagactaaataattttaatcgagaatttccagtctttcagtctgatctatttaattcactacttgttacataatccagtgaaaactctacttgttgaaattatgacataaagatcttgcagctttatttgagtatttgttcttttgtgtagtttccatcttttaaaatatttaaaatattttcaagataaagtattatcttctctgcaaaaattcctggagtaattttctctcataatatttgaagtcagtggttctcagttgtattagtggggtaactacatcaaaataaataaagtcttatttttaaaatgcaaattttagaccatactcccagtgattcttagttggtctttttggaatgagccataggtaatgtttatgtccaataaaatctaggaacctctgtctggaactttgctcttcttgccatgaataccttaggaagtattaaaaaacaggccaatgtaatatgagtaggttttcttgtttgttacttttctaagaatattttacttcccttagcaggcttttggctagctttcaaagctgccaccctggccaggtgcggtggctcacgcctgtaatcccagcactttgggaggccgaggcaggcagattgcctaagctcaggagttcgaaaccagcctgggcaacatggtgaaaccccgtctctactaaaaatacaaaaaattagctgggcatggtggtgggtgcc

SEQ ID NO: 11399 - DNA, 1286 bp, Homo sapiens
ggattacataaggtcagtagttcgagaccagcctggccaacatgttgaaaccccatctcttctaaaaagacaaaaaaaaatttagccgggtgtggtagcacacacctgtaatcccaacaacttgggaagctgaggcaggagaattgcttgagcccgagagatggaggttgcagtgagctgagattgcaccactgcactccagcctggccagcagagtaagactgtctcaaaaaaaagaaagaaagaaagaaagaaagaaaagctagaaaatgtgatattccttaatcaaaatttatttactcgtatagtgttttctctgacatttcacttgttacctcaattaatgtcacagattaaaaaggaaaaggtatttattagcaagtcttgaaaaagttcaatgtgttaattagctgttcagataggacagatctcagagtttaaaaatatacttggtagaaggcaaagtagtgagtattaataagattgaggggttgtttatttaactaatacttactgaagaactactatgtactagatactttcctaggttattttcacatacattcacattttaacctcacaaaaccaagcaaagtaacctacttgtgcttagatatccattttgttttttggtaatggactgtcttttcctatttattttgactttacccagcccttcatggctttacccagccatctcattttacagatagggaagtggtagttacatgatttacccaaagtgacatagctaatatgtgtagaatagagccagaatttcaaacctagtgcctgactgcacgtttgttccttttactctctatttttttttttctttttgagaccgagtctcgctctgtcgcacaggctggagtgcagtggcgtgatctcggatcactgcgacctcccgagctcaagcaattctcctgcctcagcctcccgagtagctgggattacaggcgcctgccaccatgcccaactaatttttttgtatctttagtagaaatggggttttgccaggttggtcttgaactcctgacctcaagtaatctgcccacctcagcctcccaaggtgctgggattacaggtttgagctactgtgtccggcctgttccttttactctctataccaaaattaactcttttcattctgaaagaatcgtataggagtgcactaagttttattataaattccttgaccctagctccttctgggtgtttgggtacaataagatttttttaaagacagcaactgctaattgatgttatcagtaaaacagtgaagg

SEQ ID NO: 11400 - DNA, 1028 bp, Homo sapiens
tttaataactttggtttaacaatcctttattttctttagctgttagctaagggatgtcgatatgaattggttgcattttactgcaagttagggatgagtttctaaaaattttatgatttaaaacttgcataatttaaagaataattctgtcaagaatggccgaagtggtgccatggtggtggtagggtaagcgttgtttgtaatttaccttccagcttttaaattatgagattcttgatgagtatttaatgaggaatcccgttatttaagatgtgtgcatatggtgagactttattattaataataacttttatattgtacgatcagatttgtataaaatatcctgcttgttttgagtttctgtaagtgccacaaccaaacatcatcaggtgcccgaaaatatattaaggaggctgaagggagatttcgtagtgttgaggaagaaaggttgggttgagaatcacaacatgtaagttttaatcttggatgccatttgggctgttgtagaccactgaatgtctggttatgccttcctttaaaatttttcaggctaaaattttatgaatcagaattttgggggcttggtagtgattcccctggtctccaggtggaggtggaatagccttctttgcatttaggcgtccatcattactagatccttccactctaagaagaggatgtcagctattctcgtagcctgtgagggcccatgagtctgtatttgatgagcacaggatacttgcattccaggaatcttccaggggctatattgtcctattctttccattaaaaaaaaattattaaaagtttggctataagaaatagtgttacctgagaatgaattaagagatacctatttcttaaattaaaaaaaaaaaaaagataactatttcttcaaatactctaaattgctcccttctgaaggcagaccagcagggaggagtgttgttagaggactgttttatatttgcccttgacagaattcttctgacagatgttttaagtatgatgccattaacatttgttct

SEQ ID NO: 11401 - DNA, 1207 bp, Homo sapiens
tttataccttatatactcttgaaataatagtttttcttattttattaatatatattaggtttatatttttattttattgctataggacttcttactactttggtttgtatttgtgaaagccaacctctctatgctgttccatctctagtatagtgagtgaagatgaagacattagaagtgtgccttttgccaaggcatatactgtttaaatacataatggagttctgaggagttaaaaatttctttttcccaagcagcaataaatcattgaggaggtggccagcatgatgaagtgtcttctgcttttaactgtggcagcaaggagtttccttaaaatcagaacatataacaaccattaggaactgagaaaactctaataactgcttaattttatttttaactacagaagttaatgctttatttgtatctcacagcaaaagttcaaacagaccctccctcagttccaatatgtgacctgtatcctaatggtgtatttcccaaaggacaagaatgcgaatacccacccacacaagatgggtaaggatcatcaaatcacttccagtttaatttctgacagttatagcttagcaataaagcagatttgacatttctcagaactttgctccactactttaataaatgcttataaatttgtcataaagaagatacagtagaagccctcttatccaaaatgattgggaccaatagcaggttattggtcatttaaaaagtatattaaactgaggatcacaaaataaaaattcttgtagataaaggttaacttaaacaaatttgtttttcacctctcttgaaatttgggtatggtttagtacttttcccccctcatatgtattcataatgcgttatctacaattccatttgggatttctgagtgatataagggttgatgtctactatatctttactttttttttcctgaaaccttttgatagttcttacctacacttaatttgacagaagtattttttgatcacttatccttagtgagatttatcagggtagttagttttcatggaaacagtttttttaatgttactttttttttttttgagacagagtttcactcttgttgcctaggctggagtgcaatgctgggatctcggctcactgcaacctctgcctcccgggttcaagtgattctcctgctccagcctcccgagtagctgagattacacgcatgcaccac

SEQ ID NO: 11402 - DNA, 1955 bp, Homo sapiens
tttttccttttgataaatggttagtataacatgtaattctctgattcctacaatttaaaaaatatacaacatgaacaaataagatcagcatttaaattggtctaagttagactcttattttctagtaaatttagttaaaagtggattgtgtttctctgactttctagcagaatcaaattccttgtcttctaaagatatgctattttcatagcatcagagaactgttatttatttatattcagaaagtgctcagatcattcccagaaggtatttaaggtttttagtaaactttctggacttgatgaactatatggtattaatatataaaagtaagaatgtaaaagtaaacaagttccctttgcttttttgttttagtgaaaagttggaagactgttcacgcaagttaataaaagagaatggattaaatgcaggcctggcatttcctactggatgttctctcaataattgtgctgcccattatactcccaatgccggtgacacaacagtattacagtatgatgacatctgtaaaatagactttggaacacatataagtggtaaattcttgcagaaaattcctaccccagcctcctcctgaaaaactagtttttgtctctgttaaatggagtgataaatactgaactcccaaattttgttcttgcttcctcatttcattaggaaaggtgtgttgaggcagatttttaaaaaaattttagtgcacttataggagagagaggcagttgtgacatttacttgaaagcatactactaagtagaataaaatgaaaactgttgggtagttgaggtttattaccctttgtatcaaggcatgaaagacattatcctacctttctttaggtcattgtttcatatctcttttattcaaataataacatttatttaaaatacttaagtttatcagccttaatatacatgtttgcttttctgaattctctccaaaacctggttaggtaagcaccttgttatcttacttacaagtgagaaagcaagcttagaataaatacttgcctaaggtttcactaccttggaaaagtaaaagtatattcagagccctgtatactttctctgccctgcgttactatttctcatttccctagtcttttcttgtattcattttgtttctgtttatatgtttgtataactgccagggtgagcactgaactggtgctgtcttggggtaatatatactaaccttgtaattctttctattctgaatcctttatatacttctacattttgtctctttgattatgaatgatctttgggtatttggagtgcagccttcatttgagccttcattctatttttctgttaaactagcaagattaatagattaaatgctgtaaagtagataaattgactagctgataagtaaaattaaaagaggaattttctctttcaggtaggattattgactgtgcttttactgtcacttttaatcccaaatatgatacgttattaaaagctgtaaaagatgctactaacactggaataaaggtatgtgaactgtaagcaccatttcattcccaatattttgagcactttaaggtcttttaaacacttaacagcatttaagcacttttaaggcctgtttaagggctttgggtaattaagaggaataaaattgatccatttcccttatggttttaagcgggtaagtgtatgattgtgtaccaaaggttgtttttttgtttgtttgtttgtttcccttgaactttgctaaaatttattaaaacagagtttggatctatttttgcctgtcagttggcagtggtttttttgtggttcttttttagaacaattttaggttcataataaaattgagcagaaagtacagagatttcccttatacccacccctccccaatttcctccattgtcagcatccccaccacataggtatatttgttaaaatcatttgaactagcattgacca

SEQ ID NO: 11403 - DNA, 1070 bp, Homo sapiens
tctttcaatttacattgaaattttttaacatttgaagatgattgaaatctgcatttacatcttttatatgcaggtctttgagcttgctgcacacaaaaggaaattcacatcataataccctgtagtaggtctctagtggggaatataacacacacacacgcacacgcgcgcgcacgtagacacgtaaacatgataagatggcctccagctggtgtcctattcagctgccatctataattaggtatgggctattatacattctggcttttgattgttgaaagagcaacaataaaagtttttggacttcaactactaggacacagctaaggtctgggcttttcttaatgagggaaatcagttcgtaactcttttgccaacagttaattttggattttctcctcttaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttct

SEQ ID NO: 11404 - DNA, 1045 bp, Homo sapiens
gaaggtttatatgaaaccaaaagtactacaatagtaatagaaagctcatcttctgtttattaattatagataaatttgagttgttggtatagaaaggtctcagttaatgagttctctcaccaatattagctgtattgtaatattttcctcctgtgtgattatactaatatatttctttttattgaaagcttgcaaatacagaagaatacatagatggagctttgtctggacatctgggtgaagttttaataaggtaacaaacagcagtagtatatgtaaggagttactggtgagcattaggaatacctgttctaaatatattagtgcctcaattttggaattacttttttttaaaaaatcactattataatactttacagttagacttcagaagtctttgaaattgttaaacttgtcaaaggtaagttttcaaatgttttggaactggccaaaagatttttctagtgttgatgtttaattttctagctcttagctataatcttttgcagtggcaaccttttgcagtggcctttgttgcgggaacttagttttgaattttagttgggtctggctgttttgttatattgattttctgtactagcttcaaagctccaaattctggtaattatttcctttggaaaatcataaagatgtcattttataacaaccatatggtggaaaataagtgccatgtgcttttcaacaaatctatgtgaaacttttttttaaaatgaatatatttaaaaaatttttttaaagacaagaatattataaatatagtattcagtattttcataataaaaatatagtaattcatatcatacatggtttctggttggaacaacaaaatcgactttttctatttacaggtgtaataatgtcctttatatcagaggtgtggaagaagaggaagaagatggggaaatgagagaatagcatcttttgtgggggattttttttatatatatttctagacaataaagatttgtttgtttttcaacttgacttgtgaactatttgtattcagatatttacaagcaaagct

SEQ ID NO: 11405 - DNA, 1042 bp, Homo sapiens
agatgagggtattaaaaaagggatggggaagaaaaaaggaagaagagggtgaggaaaaggagacagagcagaagaggaggcaagtgcgggaaaaagggaaagggagaaggaatagaagaaagatgacaggaggctgagtgaaagtcattttctccccacattttaattattttatatttcctacatttttaagataaagtatgtgttaccttaaacatttttttaaaaaattacttgggcatttgcacacccatgttcctcattattcacgatagccaagacatggaagcaagaatgtccatcaatggataaatggattaagtcaatgtagtatacacatactatggaatattattcagcttcaaaaggaaagaaattgaccgggtgcggtggctcacacctgtaatcccagcactttgggaggccgaggtgggtggatcatgaggtcaggagttcaagaccagcctgagcaagagggtgaaaccccgactctactagaaatacaaaaattagccagtcatggtggtcggtgcctgtaatcccagctacttgggaggctgaggcagagaattgcttgaactcaggaggcggaggtttcagtgagctgagatcgtgccactgcacttcagcctgggcaacaagagtgaaactccatttcaaaaaaaaaaaaaggaaacaaatcctgtcatatgctataacatagatgaaccttggatacagtatgctaagtgaaataagccaggcacaaaaagacaaatactgagtgattccacttacatgaggtatctaaaatagtaaaacttttagaaacagaatgtagaatggcagttgccaggggctatgggagggagaaaagaggagttgtttaatgagtatagagtttctattttgcaaaatcagaaagttctagagatctattgcttacagttgacactactgtaatgcacacttaaaatggctaaaatggtaaattttttacatgtttatttgtcacaattttttaaaaagatgacttggataaggtgtgtaatatacaacaatg

SEQ ID NO: 11406 - DNA, 1049 bp, Homo sapiens
ctcagttgaaccacctgccttggcctcccaaactgctgggattacaggtgtaagccaccaccccgcctgagcagctttatgttctatgttattaacacttaaaaggcctttgaataaaagtacccttgagtgtttaaggagagccaggagggagacaggactccaggtccagccagcagcagcgcccagccaagaaggcagggagaaaaatgctgcgaacgtccagtcgaatcctcccgggttggggtgtcctgccaggccagcaagccagcacttctcactagcaccctcagggtgccacgtgtactcaggcagcagggatgaagagcgcctcaacttcaggctggccaaatttggtgagatagttcacgctgcagtttaccggtgccagaaagcaaagaaacctcaacccaaaccacaagaaaacctctcccgggagccgacagagttggcctgttcagagacagagttccagcctttgttggcagcacgtcattcttagaagtctggaatgggtgtgagtgggtgtgtacgtgtgtgtgtgtgcacactccaaagttcggctttgcacaagggacagcctaggctccaccttacccggtgcctgtaccatcgcagtgggaagggctagttgcaccccagtggcggccccaggctgtgcctcctctgcctcgctgaacagagacaattttaagaaaggggtgtattagtttcccagggctgctgtaacaaatgaccccaaacttggtggctcaaaacaatagaaatgtattctctgaaggttttggaagacagaagtgtgtaatccaggtatctgcagggccccgctccctctgaaggccctagggaaaaatccccccttcctcttctggcttcttgtgggctccagccacccttggtgttccttgacttgcagctgcctcactccagtctctgcctccacgtcccatgaccaccttccctgtgtgtgtctttctgtgtcttcatgaggacagaagccattgatttcagtgcctacctcaaatccaggatgattctgtctcgacatc

SEQ ID NO: 11407 - DNA, 1009 bp, Homo sapiens
cagcgttgcggacgcaggggctggctgaagggcccaggagagacaaagtttaagaagtggagactcgtcgctcttaacaatccttaattcctgggagctgttatatcttggcttcctgctcaggtcaaaataaaaatctacacagaaatgtttcataactcaccatttgttatttgaccagaaaagaaagatggtaacataagcaggaaagaaccttaaaaagagttcgcagtttgcagtaataacatggtgatagaactcccaaaaaggcaaacagttgcgcagaatgaatagcaaaattaagaaaaagtcactgtaatcctaatagcaatataagaaggaattaaagtgcacatgttcacaggatgacatacttcattgtatcaagagctagcttcatgaacctgagctacctcgaagttattcctttttctccatatacaaatttatatactcataacatggaaagttgtgaaacccttgagcgagccaaaaatttatacatgaatacaaaatacgaaaattagctgggcatggtggcacatgcctgtactcccagctactcaggaggctgaggcaggagaattgcttgaacccgggaggcagaggttgcagtgagctgggatcgcgccactacactccagcctgggcgacagagcaagactccttctcaaaaaataataataataaataaataaaataaaatattttttatttatgcatataacaactatttattgagcacatactgtatatcaagtgctgttcaaggaactaggaaaacatcaagttaacaaaacatataagaatccatgtccttatagagcatatgtttttgtgggtataaacaaccactaaacaaatatgtaagtaaataatcttacaaggagatgactgctagggagaaaaatagaacagggaatggtgttggaggatatgagatgaatgttgcaattttatcttttttttttgagacagggtctcactcttgcacaggctgttgtgcagt

SEQ ID NO: 11408 - DNA, 1033 bp, Homo sapiens
ccaggtgaaagaccagcctggccaacgtagtgaaaccccatctctactaagaatacaaaaattggccgggtgtggtggcgtgtgcctataatcacagctacttgggaggctgaggcaggagaattgcttgaacccggggagcagaggttatagtgagccgagatcatgccacttccctccagcctgggcaacagagcaagactccatctcaaaaaaaaaaaaaaaaaaagaacaaaggaaataaacttccagaaataccctgagatcataaagattcagtctgtgttccatctgataccatttactctctgagtctggcttttgcagcaggaatttgtgagccatgccaagatcttgaactgtcaaaggacttagttacagtcagaacattttagtgctggaaaggtgaaaggcacctttttgaaatacagagggcccttgtcattcttgagggcagtctcctgaggccttcctcagttccccagttccccgttactggcatgtttatacaggctcctggcttacatcctcatcacatgttttttggacaggcatgtgtttcctgtgcatatttttacttggtgactatttttttttcctgcaaagaaacacttagacagttttatttttaaagatgaagagtagaggccaggaatggtggctcacgcttctcatcacagcactttgggaagccagattacttgaggtcaggagttcgagaccagcctggccaacatggcaagacccctgtctctactaaaaatacaaaaattagctgagcgtggtggcgagcgcctgtaatcccagctacttgagagcctgaggcacgggaatcacttgaacccgggaggtggaggtcaccgtgagctgagattgcaccactgtactccagcctgggtgacagagcgagactcttatctcaaaaaaaaaaaaaaaaaagaaatgaaaaagatgaagagtagaggtcaacaaagcctcgttgagataagtctgctgagcttgagctgttattagtcgagtggtttcttcccca

SEQ ID NO: 11409 - DNA, 1054 bp, Homo sapiens
acattatttacctaatagataatctatgaattagaaagcttatatttataattctaatttatgcattaattgtaggtcagtgaagctgtgctggcaattaacttacttattggaaagaagaatactagaatgcataaagttaaccaagtggcattaccaaatatcccagaatttgctgctctggatcttttgtcttcgtatacagattatttgcttggtatgtttggatgtctacatattatgcaaaaaaactgatatatgtaatatagaatcaagtttcaaagatttaattgtaatttgttggcttttagcttagatgggataatgtttgggggcacttccaggggatcataggggtcctagggccaaaatagagggctcttagctcactgcacatgtgtacctgttactcagtcagctgctgcatttcagatgcatgttcttttaaaaaaatgatattttacatctgtttcttttccagttcacacatatcaaatgggaccttttgggactgtttgcctctctgatcctttcatccaaaatctacatgcactctcccactctgatatgcctccctcttcttttccttagtgattttatatttgtatatatgtttgattatgtgtttaagctctttctctcattaaattatcatcagctacctgagagcagggtcttcatatattcaattttcatctacagcaaattgcacagtgcttgcacatagcagacattcaatatcaacatttgttaaatgaattaatgaaagaaattagcaaaatttaaactggactgcaatactgtttatgtttttgcttagttactcctttgatagtaaactataatataaacctctatatcagataactggtaacaggcatttaacattcatttatgtgtttttccattatttcactcaaaaaatatttattgagtgcttcttgtgtgctaagcacttggataggtgctaagaagcaagacactagtcttacttccagactgacatttcactaacatccacctctaattttgcttggtgctaggccagcattga

SEQ ID NO: 11410 - DNA, 1030 bp, Homo sapiens
gctagttcttccctgcagtagtagcaaagagaattagtcttagtaattattaatagtaatgtgagccatttttgaaagctactctgtaagctatactcattgcttgtcttcttagtgtgttagcttttataatcgcaattcttataatagtctagtgctatagatgttcatggattgtttgatgctccataactcctcatttagataactttttagtaacagcatcttccagtggcgacaaaatagttgtctcaagttgcaaatgtaaacctgttccacttttagagcttgctgaaggggtaagtgattttttttttttttaaacttttaaaaatcttagttttgcttgactggcaattgcttattgtggtgcttgcgactaaatataaaggtttttaaaagcattatttttaacttaagctcaaaataatatagtaacacttaaaaatgagatatgtgtacttactaaagtatttttaggtaaaatagttttgaatataggggaacaattgaagacttgaattttgttgactaggcacttcatttctccattttccctcagtgggagaggatctctgttgctgctattttaggacgatatcccacataggttactaggttgacctgagcatataaactctaatgacacagcactgctttactgatcttgggctcaggaccatcaggaacagactcacagctgatggtagctctctgcttcagattctgtccacctgtactgaggggcctgtctgagcctcccccatactctccttaaacaggttggctttgtcaaaatgagcttaggtcccagggcgtttaaatgaagctctcactacgtactgttgccttatccttttttttttttcttttgagatggagtctcgctctgttgcccaggctggagtgcaatggtgcaatcttagctcactgcaacctccgcctccccagttcaagcgattctcctgcctcagcctctcaagtggcagggattacaggtgcccaccaccacgcctggctaatttttgta

SEQ ID NO: 11411 - DNA, 1030 bp, Homo sapiens
gcatagaatgtctctggtcgataaaggcagactgaagtcttcaagagcaggcaaaacatcttaaccatctttggatctttgtatcctaagatgttcaaaaaacttgttaatgtcaacatcaaaacaatttcaacttctactctaccactatatatatgtactactgttatgcattatgccttaggatcagtgaatcagtatttgggagctttttttttaaagtataaaaataacagatggtatttacaagtgtgacataattctaagagttttgtgaatattccaaattagttgctatgattcttagccctctttcccatagttaacaaattgtatcataatgctgttggataaaagtaagattagttgagttcaaattttcaatctattttaatttagttatgaaaatatttggaaacattggttttttagcttttactagtaatgtttacagaaacatattaatgtgctaataacctttttgtaacttccaagtcctcttactcgtgtattatttgaggcattagaccttttctacttgagaaaataaattatgatcttactgattttaaaattttagagtagaactttaagttcatatttattttctttgattttgtatttcacctctttaaagtagaatgtacctttgccttgcaccttgagcagttcaggattcctgtaataaccacacaatttccattaattatttaagttcattagttgcattaataatacattatcataaaaaagacctatcaacagggttagccagctctaaatataatttttattttgagcccttaagagtaattgtagttgttgtgatgattggagtcccaatatattgatcttcaatggacaccatctttttctattttatttaaaggctgttttgatagttcttagcaaactgtcctgatttgcagtgacaaccagattctaaagcttcttagtctccctcaactaaagtcaattcctagaatggtatctgcaggagaattacagcaactatactgaaacattgatg

SEQ ID NO: 11412 - DNA, 1943 bp, Homo sapiens
gacagggtctcagtatgttgtccaggcaggtctttaactcctggcctcaagtgatcctcctgcctcagtctcccaaagtgctgggattacaggcatgagccaccacacccagctgggagagggatgttttacatggaggaaatcacattaacaaaaataaggagaaagaaaattgcatgggctttatataggaccaatgtgagaaaagattggaaaagggtaaatatgaatatagtattgatgtaagactgaatgtcacacaaaagacttgttttgggaggtatttagggaaattaatcagagtttttaattagttgaatgtcagaatcatagaatccttgaacattaaaaatagcctttagaggtaatctcgctttctgcattttatggatgaagataaatgatttgccaaagggatgctctttagaatgtgctaatattgtcataaaagcaggaacttattatattttgttttggtgatttcttttttatttatattttgataaagagagacataaagtctaagcctataaactttggaactattgtgaaaaaaatcattaatgttcaaatatcttttttaaggacatagagtaactttctttttttgtgtgtgttagaagcatgacaaatttataaattttggactgacttttcaataccataaaaattagaccagatactactatgtatattcttatacttcaatttttatgcttattgtatcttgctagagagttttcttattaaaatcagacatgaaggaatattcctgaaaacattaggtttgactataccttttggcctaattttgtgtaaaagatttaaattttttaaaacaattgaggtgtaacttacaataaagtgcagtgcatatatcttaagtgtacagcttgttgaatttttatgtatacgtaaatacattggtgtaactactaacaaaatcaagatatagaacattgccagcacaccagaggacttgattttgtcttttccagtcactacctcatattttatgaaaggaatcatatgtgggccagacgcggtggctacctgtaatctcagcactttgggaggctgaggcaggcagatcccttgagcccaggagttcaagaccaccttgggcaatgtggcaaaacctcatctctattaaaaatataaagaaattcaccaggcatggtggtgcatgccagtagtcccagctgcttgggaggctgaggcaggatgatcacttgagcctgggaggttgaggctgcagtgagttctgattgtgccactgcactccagcctcagtgacagagtgagaccctgtctcaaaagaaaaaaaaaagcaaggaatcatatgtgtctggtttcttttagtcatcattacatttgctttgttgcatggaatagtagttcatactgtattaattctgtgtagtgtttccttatatgaatgggccaccatttatccattcttttgttgatgagcagtgaattgtcttgttttagctgttacaaggtagctactgtgaatatttttgtacaagtctttttttaagatacatgtttttatttattttgagtaaatacttaggagtggaattgcaggattgtagcataggcatacagttttactttatgaaaaattgccaaaacattttctaaagtgaaatccagctggctgtgagatccagttgctccacatttttgctaatacttggcattatctgtcttatttttgccactttgatggttatgtagtgctgtctcatggtggttttaatttgcatttgtccatgttgaatgatgttaagtatatttttatatgcctcttgtgaagtgactgttcaagtctgttgcccatttttatgttgggttattcgtgtttttaaaatttatttataatttcttatgtattgcaggtagattcattttggggatatgcatgttgcaaatat

SEQ ID NO: 11413 - DNA, 1065 bp, Homo sapiens
catttgggatcagtagaatagaacactgttgacaatatgatgaggaaattttgtttgttcgtgtaatagcagccaaaataaagtacacctgaacacagctgaatgcagcaaaccccgtcagcatccatctctttttattcacttcctcttggcttggctgtgtggtctgttagaagtacttattttgtgattatttcccatctttgggcattttgctcttgcctctgtaacttgatagccgcaatccttctatcctcttccattaagtgaccatcacttcttcacagtaagggtattattcaataattatctattagatttttactatgtctttttaactatgttagtatttttattaggatttaattgtttttgttgtgctctggttacaaagttgcataggtttttgagtgctttgccctaatcctttttccctaagttctgttatttttaatacacagtgttaaagaatatacgtttttttcaggagtgcataaatatttatggcataatagtagaactgtctggatacagctgactataatacagtgtgagcaaagtgatgttgaaatcacagaaagggagcagttcttctgtgggggcagatttagaaaggtacactgaagagattttattttatactgatgtgtgtgggaacagcttgagcagagacatgatcatacattctaggaatgtttgcagagagaaggcaccgtggtaagagaccaggcctgagggacagttgtgaaggtcttaacacacaggtaatggagagccatcagagtttttaagcacaggagtaatgggtgctgtctatttattacccatttattcaacaagcatttgggtgtcagttcaccactggcttcagatgatttgaggacagtgggctcagggcctttccttcagcagacccagggatctgagtgctggagcaactctgaaatcgctgtgcatttctgccctgctgccagctttcggggtggctggagcttgtttttcactatctaacctgttcctggctttctgtgcctcaggagaagtgtgtctgtcccactttcagcc

SEQ ID NO: 11414 - DNA, 1057 bp, Homo sapiens
tgtattatatacttaaaaatttgttaatagggtagatcacatgttaactgttttaccacaataaaatttaaaaagaaaagtaatcataaattaatattattgaatttgcaatataaaacaggaaattgtcatcaataacataaaaagggatgcagagatataaagaagtaagagtttttatatatgattgaagttatcaggttaaaatacatttttataactttaagatgttttatgtaaccagtgtaataataattaacaaaatagcaattgtaagtcttcttctgttaataattactttaaatgtaaatggatcaaatgtatcagttaaaagaaatagtttgcaactacttgggaggctgaggcaggaggatcacttgagcccaagagttcaaggctacagtgtgccatggtcttgcctatgaataaccactacactccagcctgggtgacatagtgagactcccctctctcaagaaaaagcaccccaaaacaacccccaaaacaatagtttggttgaatgcatgaacaagatctttatactgtctacaaggggctccttttagatctaaggacatgcagaccaaaagtaaaagagtgaaaagatattccatgcaaatggaaatctaaaggagagcagggacagccatacttatatcagacaaaacagactttgagacaaaaactgtaacgagataaaaaaggatattatataataataaaaggttaaagtcacccaaatgatataacaattatacatgcacctaacagaacaaccagatatatgaagcaaacattgatagaactgaaggggaaattaacaacaacaacaacaacaacaacaacaacaacaaaaacaagaccaaggaactttaatacttcactttcagttatgaatagaacaattagacaaaagatcaataaaggagcaggacttgaacaacactatagaccaattggacgtgacagatatatatacagaacgctccacctaacaacagaagaatacatacttttttctagtgcacatgaaacactctccaagatagatcacata

SEQ ID NO: 11415 - DNA, 1033 bp, Homo sapiens
aaagacttatgaattgtttgaagaggcacgagaccgtggcaaccctaactgtccccgacatctggcagccatatgctatccttgaacttgaacttcagagtgaaagtataaatttgtaaggggaaggctcagccgcaagtcacataccagtggtcagttaaaaaaaaaaaactcaggacggcaacctaaatcatttagaacgcgtcaagagcctcggaaaaactattttcacacacttctctagcactaacatgggaagcgcgtttccttcacatattccacaccttttattcttcccaccaacatcaagaatacaaagcgcccagagaggacaataagcctaagcagcggctccaagagaccggactttcgtacttcccgggggcaggcggaaggttacggagcgctggaaggatcttactgctccttgaagggctgtctgagaaaatacacagcctaacgactcctcgttagtatagtggttagtatccccgcctgtcacgcgggagaccggggttcaattccccgacggggaggtgtgtagctgcacttttttggcgacagttattattttctgtatcattcaatgacaggacactgctgttaaacataatatgctaaaccagctcccttaagtgcacaaccctgtcttcaaaatggtgacttttaaccttaatgcccaccatgaagtgaaagcctcccctgagagaaaatgccttacattgtttgcaggaagggaggaaagggaaaaagaaaacgctctgaaggcctctgcccttgcctccagccgccatcttgcgaaggcctgcgccggcttagtggcgccccgccagattacaactcgaggtcgcgaactcagcgcgcggaacctgttgggggaggggagagagggcggagtctcgcgactaacggggcgggggcagggcgggtaagaacggaaatcatttggtaaagaaaaggaagggccaatttcctttgatcctggagacccgactaaacgggaagccccgttctcccgcttccgctggttacg

SEQ ID NO: 11416 - DNA, 1050 bp, Homo sapiens
taccaatatttttaggtgttgaaactacctagattgtggacacaaaaataaacatttacagagttggcagtctgcctttttgttttaagaggcagagcctgaaggtgtagctatttggatctagtggagcataatattcttgaatgatctgttctggtgaattatgagtgtgtgtttgagaaggagtcttgcgctgtcatccaggctggagtgcagtggcgcgatctcggctcactgcaacctccacctcccgggttcaagtgattctcctgcctcagcctcctgaggagctgggattacaagcgtgcaccaccatgcccagctaatttttttatttttagtagagacagtttcaccatgttggtcaggccggtctcaaactccttcctgactttgtgatctgccccccttagcctcctaaagtactgggattacaggcgtgagccaccacgcctgtctgtgtgtttgtttgtttttttaagagatagggtctcgctctgtccctcagactgtagtgcagtggtatgatcatagctcactgcagcctcaaactcctgggctcaagcctctggaatagctgggactacaggtgtgtgccaccatgcctagctgatttttaaaatttttatagagatagtctcactatgttgaccaggctggtcttgaattcctggcctcaagggatcctcctgcttaggcctcccaaagcgttgggattgtaggtgtgagctgctgctcctggccaaattatgaattctcaataggaaatatttgaagacctggaaaagaacataaaagcatgctaccaataggaaatgttaattaaatcacaaatttaccaccactgtataataaggtgttaagtttacagacttgtgaataatagagttatagattcaaattccaggtctgccacttattcatatgacactgaacagtgtcttaatctaagatcctctattttcacctgaaatagaggaataacctaatagctacttaatcagattgaggagtacatgccattgcatatgtgaagtgtctagtgcttag

SEQ ID NO: 11417 - DNA, 1307 bp, Homo sapiens
catcagccaccacgtcctttttttttttttttttttttttaagacagcatcttacttcctctcccagctggacagtggtgcgatctcagctcactgcaacctctgccttccaatttcaagtgattctcctgtctcagcctcccaagtagctgggatcacaggcgtgtgccaccatgcccggctaatttttgtatttttagtagagatagtttccctgtgttggccaggctggtctcgaactcctgacctcaagtaatgtacccgcctcagcctcccaaagtggtgggtttacagtcgtgagccactatgtctggccgcattatatggtatttttttttttaagaacttgagtttagaaaaataaagggtgaaaatagcttaaaatgttgctgaagatagtgtctgagctgcatcctaaatgaaacaatacaggtactaaagcaagttctgccttaatccaggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaaggtaaaattttaaatgatgttaatcaaatgtatggaattttttcacactcaaaattcagtgaccatgaagaaagtaaaatttaaaacaatattggcaagatacacaaattttattcgtgtcattagagtaattctgtaatttgatttaaatactttttattgaaaattctaagaagcaacatagtacaaattcataattttccatcacctgaaattgcaagttaactttgtcttttttgctacaaatctcatttttctgagagaataaagtattacaagtaaaggcaaagtttctcgtacttacctgtacctatcacctccacagaagtaactactattattaattcaatgcctgtctttcaagttttatatttcacatacacatctgtctaatacatggtattattttatactttaagaataaaaaatttatataaacagtatgctaaatcttatcacttgctttttcttactccattatttttgaaatctaatcctgttaattacatatctgtttattcttcataattaatacatagtggtagcatttaaatatggcatattttctctgttctctattgataggcatttaaattgttcgcagtttttgttaatctgacctcagggcaactttaaagcaaatattttgactatatttttagtagactgtatagtatcttaaaatttg

SEQ ID NO: 11418 - DNA, 1051 bp, Homo sapiens
ctaaagcaatgtattgatttacactctgatgcaagtaatttatctcttcattgactggtagcaaccaattcatggaccagtaccatggaccacactttgagaaacacttctttggataataatagatatcctgggatagtgcatgttcaccatctattttgtcagataatggggccttttaaaaaataatactttgctttcatgatatattgtattttgtggaaagttaagtttagcaatatagactctaaaagcaaattaaatttttttaagccataagaaattatactatatcccagtatctgtatgtctgtataaagcagtgtattatcatgttttcatttctgtgattgtaagttaagagtcttaactgcagaggtattgtggaaagtagtagccttaagcataataaaatatggtctcttgggtactccctctggccattaccacattcttagattatatgtgtccatctttgcagctttctgagagtaattttatttgttgtcttctgaaatgtacatgtatacatgtacctactgagtgctatgtgatttttaaaaatgtattactgtagaatgcttctgcaaattcaataaagttgttaaatttgaacagtgttgtgtggtctccagaaacatgttgttctgtgtgctttattcttggagttgcaacaagttaaatatttgtatatgaacaccccttttccatttcatcattgaaactcactttgacatttcagtggtataattgaaaatattctgattatggtatggtttttcttctgtttgaggaccatgtttttattgactgttggaatctaaatttataagaggaattaatctgtaaccagataccttattcgtttaaccgatttctattccactactaatggttttttttactttgtgctttctagttcttagattctgagttaacaaagcataaaatagattttatattgctgggggttgtaccaaacatagatacattgacagatccattgatagaagtgttgggagatggacttgaaatcttagtcctaaataaa

SEQ ID NO: 11419 - DNA, 1204 bp, Homo sapiens
tcatttattgagtgtttcagagagtaatggtttctccaatgttatttccagactctaaaatagagctcaagcttgagaagagagaaccactaaagggcagagcaaagactccagtaacactcaagcaaagaagagttgagcacaatcaggtatctttagttttattaccaccgtgtacaggtataaataacctcctgacaacactaatccatgttttagcctttaatggttgacacccagattccagcacgctcaataaacttaattctgttgttaaatgatactaaaaatctaaactttgtgggttttgtcagtagtgtagcctgtgattacagcaaaagcaaatttttaatgtctcatttgtgtttgagtctgtgctagatgtagttcaaagccagttatatggtgttttgaaagaaatattttaaaaggtggaaatatctagacacttttgatacaatttctttaaaaggcaatggaagggttttatatttgtgtctttgtctctagatttctgactttgattttatgtttgcctgtcttgtcttctgcgattctttcctaaactcagaagctagtctggtcctaagactacagttttctttccttatttcagatgaaaatttaccttttctattgtgggagaggcgtttcagtttttcaaaagggaaatgtaggaaactaaggagaaaataagcataggtataaatgaacagagaacaaattattgactaacctagtattgtttacagagaacaaattattgactaacctagtattgtttacagagaacaaattattgactaatgcagcattgatttggctgatgctttataagacagctattcctagagtcattttccttacccctgctatgtctagctggatgatttgtctagttggttatcttttccatctcctatttgtcactttgtgtgtttgtttgtgacggagttttgctcttgtcacccgggctggagtgcagtggcgtgatcccatctcattgcaacctccaccctgctgggctcaagcgattctcctgcctcagcctcccaagtagctgggattacaggcacatgccaccacgctcagctaatttttgtatttttagtagagacggggtttcaccgtgttggccaggctggtctcaaactcctgacctcaggtgatccacctgcattggcctccgaaagtgctgggatta

SEQ ID NO: 11420 - DNA, 1011 bp, Homo sapiens
gcctcccagattgctgggattacaggcatgagctaccgcacctggcaataaattgcttttgattttttttattttgctttttcctggagtatattaaagcagtctttgacatagtgtttcacacattaaaaagtcagcattttagcatatatctctgaaagataagtgctattccagtgacaatgccaatatcacacctaataaaattaataatttatttgtatctaattcatgtttaaatttctctagtttcagaaatgtttcgtttatgattatgttgttcaaatcaggatccagacaggatccacatatccggtttgatttttggttgttttactctctcaagtctgtagctgttaccactgtaactttttctcttccctccatttatttggtgaagaaaccaggtcattacagaatttcccaacattctggatttgttaggttgcttctttatgtcatttaattagcttctctatacgctgcattttctgtagagtgggttagatctgtagtgaggctatgcagtagacctttctgtgatagaaatttttcatacctgtgctatccgttacagtagccactagctattgaatacttcgatggtgactagtgaggctgagaaactctgttttgctttgttgttgttgttgtttttgtttttgtttgtttgttttttgagatggagtttcattctttttgccaaggttggtgtgatctcagctccccacaacctctgcctcccaagttcaagcgattctcctgcctcagcctcctgagtagctgggattacaggcatgtgccaccacgcccggctaattttgtatttttagtagagacggggtttctccgtgttggtcaggcaggtctcgaactcccgacctcaggtgatccacccgcctcagcctcccaaaatgctgggattacaggcgtgagccactgcgcctggcggaaactatgttttaattttaatttaaattaaatttcaatgaccatatgtggctagtggcc

SEQ ID NO: 11421 - DNA, 1042 bp, Homo sapiens
ttttagttcaaataagctatatgtgggattataatttaaactgattctactaaaatgattataaccatatgaaaataataatgtttatgctaacaattacaaaagtttgtatttttgttttaaaaggaaactgacttataatagatgacttttttctaagtcatgatcagtctgctttttgtttagacagagatgtagctccaatactagagccaaatagcacacagtgagtcaaaaagggaactggtgatagttgatgtgctttttttcccataatgtttataatttgtgagctactataggtggattctttagtgtattttagcactttttaagtgtttcctgatgcctaaatatcagttcaattaatacatttaggaatattttgaggacatagccttgtttgtaaatgctggcatttggagacttctatttcatggcttctcagtgtgccagtatggccgttattaaagtatttgatgttagaatatgactttttaatgtgttgatgcttgaatagagctattctcaagctggaataactgagactgaatggacaagtggatcttcaaaaggcggacctctgcaggcattaactagggaatctacaagagggtcaagaagaactccaaggaaaagggtgatgcaaggcttattccttgggttttcagatttgtagggttttagtattattttatatttattgtttttgttttgttttcaaactaacaggtggaaacttcagaacattttcgtatagatggtccagtaatttcagagagtactcccatagctgaaactataatggcttcaagcaacgaatccttagtaaatatgtttcataaactatacaagtggtattctttgtaaattaccctttaattggaaatggggaggtggtgaattttggcaaatctcaaatttacatgttttttttttttaacaattttaaactgattttccccatatagttctgaattttagaattttcctataatatccaatttatgtaaagaaatctaattcattgtacaagaaagta

SEQ ID NO: 11422 - DNA, 1383 bp, Homo sapiens
gcatcgaactttttttttttttttgagacggagttttgctctgttgcccaggctggagtacagtggcgtgatctcggctcactacaacctccacctcctgggttcaagcgattctcctgcctcagcctcctgagtagctgggattacaggcacccaccatcatgcccggctaatttttgtatttttgtagagacagagtttcaccatgttggccaggctagtcttgaactcctgacctcaggtgatctgcccgccttggcctcccaaagtgctgggattgcaggcgcgagccaccatgcccagcccatctaacttttaaaatagaaaatatgtagaagttttaaataggttgactgacctcactgctttatatgtatcaattttctactgttacctcagggaatgtgcttggaattaggagtggcaatgacattttatgttatttctctaaatcatgcctttatctaaaattatttttcttttcctcctttcactcccaacagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaag

SEQ ID NO: 11423 - DNA, 1919 bp, Homo sapiens
gcctgtaatcccagcactttgggaggccagggcgggtggatcacgaggtcaagagatcaagaccatcctggccaacatggtgaaaccccgtctctactaaaaatacaaaaaaattagctgggcgtgatgatgtgcgcctgtagtcctgtctactagggagactgaggcaggagaatcgtttgaacccaggaggcagaggttgcagtgagcagagattacgtcactgcactgtagcctggcgacagagcaagactccatctcaaaaaaaataaaaaagtacaaaaagtacttgcttttatattacatcataagcagtagttaataaagttgtatactcttaagaggtgggcattatgattattttttatttttttattttttatgagatggagtctcactcttgtcacccagactgtagtgcagtggcacgatctgggctcgatgcaacctctgcctcccaggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctctagttttgtcgttgcaataaatggttttcagatagcacaaactgtgatttctggataacatttcttatgtgatatttatggattattgtgttttatttcagtctgttcatatgttttacttcttattgtaatcgggttctcgtttattcaaaggtaagcaatgtgtagctactgtactcacagaatgacattaagcgctccaaggcacctctcccacacctagttcctttttcccaccacttttactgtctttagtatttacctatgacccttatgattgttagtcttgctttgagactaagcccgtgtcactgtgatacgtcatggagctgtgctcacaagatgaaagtgccattatgtcttcctcattcatgtgtccccagaggtgatttgacttaaattagtgtttctcaaggtagtatagacaccataattaattataaggcaaatcgcatcaaaggcttaaa

SEQ ID NO: 11424 - DNA, 1046 bp, Homo sapiens
ttgaactcctgacctcaagtgatcctcccaaagtgctgggattacaggcgtgagccaccacccctggcctaatttgtttttgtttgttttttttttatcttccaggcagctttttgaagtatcttttgctatctcactctacctctttgtcattgtgttaaacccttttttattcccttatcagtattcaagtctcagtagaaataggctgtaagcatgtggtcagcctgtcaccttgaattgatggtcactgagagcttttcgggattcacatatcctttccaccaaagatttggggagaaagtagaggagcagacatagggtttgagtgcaaggggtctccatgtgttttgttaagttctcctaattatggaatcattagttgaatcgacaacatttatactatatttacagtgtttttaaatggattgaaatttattagttaccaaattttgccacttaatgcaacagacatttgatactttctctgtggtgaataacaatgtgtagttgacggtgcttgggtgcagttttagaattttctgtgaacttgaggcactctttggggaagttgttttttttaaaagcatctgacgctgggtgtggtagctcatgcctgtaatcccagcactttgggaagccgagatgggtgggtcacctgaggtcaggagtttcaagaccagcctggccaacatggcgaaaccttgtctactaaaagtacaaaattagctgggggtagtggtgcacccctgcagccccagctactcaggagactgaggcgggagaatcgcttgaacctgggaagtggaggttgcagtgagccgagatcgtgccattgcactctagtctgggtgacgagcaaaactctgtcccaaaaataataacgggctgggcacgttggctcacgcctgtaattccagcacttggggaggccgagacgcggagcacctgaggtcaggagtttgagaccagcctgaccaatatgatgaaaccccacctctactaaaaatacaaaaattaggcgggcatggtggcatgtgcctgta

SEQ ID NO: 11425 - DNA, 1024 bp, Homo sapiens
tggcagaaatagataagcttttcctccccccccattagttaatgtaatggatatgaaatgtacctttgctaaaacgtgttatgcatgtctcttgaagtgaatttagtttatgtgctttttttttttaacttgtgtttagtttgtttagtgttcacaaaactttatgctataagctacttaaagaactagcatatgttaggaatacagttatatctattatctagacagtagcttttaaaaagtaggaggtgggccaagcatggtcgcccacacctggaatgccagcattttgggtagccgaagcaggtgggtcacttgaggtcaggagttcgagatcagaactcaatctagccaacatggtgaaacctcatctctgctaaaaatacaaaaattagctgggcatggtggcgtgcctgtagtcgcagctactcgggaggctgaggcaggagaatcgcttgaacctgggaggtggaggttgcagtgagctgagatcacaccatggcactccatcctgggctacagagcaagactcaaaaaacaaacaaacaaaaaacacaaaaaaagtagtaggagttgggtggtaagaaatctgttaagaatcagttttgttacgtatttttgttgaaattttaccctcttaactatcactccaagacttaagtttgacacagaaagcttttgttgaaattttaccctcttaactatcactccaagacttaggtttgacacagaaagctagaccttaatgtacaacagtttctatttataaaagtaatcaaatgaacaataataaacagtgataagcataaactaataaaagttatatgaatgtagttcctcactcaaaatatcttaatattttcagatgtcagttgaccttggataactgaagccacagaaaatgaactcttggataagggagagctactgtatttctttttttttttttgagatggagtcttgctctgctgcccaggctggagtgtagtggtgccatcgtggctcactgcaacctccacctccc

SEQ ID NO: 11426 - DNA, 1119 bp, Homo sapiens
tggtctcgaactcctgacctcaggtgatccacccgcctcggcctcccaaagtgctgggattacaggcgtgagacaccgcgtctggctgtgaacttcattttttagtattaagcctaccagactttttaaaaagactattataacatttaatgtctatttacctgtatgtagaacataaacttgagaggtaaagataagttaatacatggtttgagccctggactgagttttttttttttccctagagtaaggaccatttgtcggtctacaaatgacttgatgtttggcctaaacatttactattaacttttagggagggcttgttagtatccttgtgatctattcacagttaagaatttccatgaccacaacatgcttccttagatccacctttgtggatgaatcttgaactgagttccacttgtaaacttcttgtttcttgtggttccagtagtcaaagaaacatccagcaacttttttggttgtatagtcaaaggtgcttgagtcattggcatgtaagagaaatatacctgcatgttagtctaacgttctgatagaaatgacatgcatttatgctgccatttgttactatcaggactcgactcgtgtgcggacatttctgttaataatgacagtctctgatagatgagtgtatgcaactgtgtaaaacaagtctcttgatttcctagattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacataggtacgaattacttagaacacacttgtctgaaattatgaacaaataatcatttccattattggcgttttttgagagggaaaaatactccaaaggttataaagcagtgtttttgtttttttggtttccctgaggcatagtctcgctctgttgcccaggctggagtgcagtggcatgataatagctcactgcaacctcctcctcctgggttcaagtgattcttctgccgcagcctcccaagtagctgggacgggcatgca

SEQ ID NO: 11427 - DNA, 1070 bp, Homo sapiens
ttgataactgtacccgtgtcaccctgagtctgatttttattttagaactagaaaaatattattttaaaatcataaaaatgattattggctctgtgaagttttgtttttaactggcactgtatgggatcctttatcttttttcagctggagtcttttgtgcaattgtttctcaccctgctgattctgtggtatctgtgttgaataaagaaaaaggtagcagtgcttctctggtcctcaagagacttggatttaaaggtaggatgatgtttttttcttgaaagaaagaacaacagttttggatatgttgcatttttttcatttgcttttcctgtttgaaccaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatacttacatttttgcagcatgtactacaccttttttatgttggtgagtttgctaatccttatttgtaagacaaggtaaaccaaattaggctgattcttagaatg

SEQ ID NO: 11428 - DNA, 1027 bp, Homo sapiens
aggacatagggaaaaaggaacatttactattttgtagcggtaaacaaggttcctttcctttttgggttgctctactcatatgaaatgtatgcttatttctgtaccttaaacaattttctgttgggttgggtagagcttgccacattttaatggcaaaaaaaacacaaattacttttgcaccaacctaatagtaatttatgtttcaggcatttcagttttcctgtaaaatcatctgggttcatttatacctttattttcagccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccataaggtttaatttcaaagttccttttaaaagaggttaaggaactgtgttaccttttgtcctaagaaaaaggcttgaatttatgtaaatactttgatcgattgctaattttcaaaggcttcttaggtaggttactacagtaaactgtaactcagtccacattttcatttaggagctagactaccataacaatgcttatgctgtttccaagggtaggttatttttcattaaaagaagaatgaatgcattttaagtttaattcttcatagctgaaagcacaaatttaacggcttcactggacagttttccttagaaggtagttttgtgtgactgtgactaaactattttattttaaaatgtcattcttatttatacattctaaagttggaaagactgatcttatatgtgtataatgtttattttgtacctagagtacatttaaaagggtggagactaagctaataaagtttttttggccactactgtgtgggcagaatatcttatttcactcataaaagtactattttttttaggatgaatgaaaagagatttgaagttaactcagggttgttcaagaactttttttttttttttttttgagacggagcct

SEQ ID NO: 11429 - DNA, 1122 bp, Homo sapiens
aggggttttgttaagagaaaaaaccccacggttactcctgcagtcttgtttttctaaacgggagaatacggatggaggagggtttagaccgataaagcttgcaaaaacttattggactttgagcacatacctgtgatccgtaattaaggaggccatattatcaaatccaccctctaaggcactcgaggaggctccagacaagctgcttaaaagcgctatgcctgtagtgacttcattggaaggtgtcaactattttttagtacgtcaaactcaggaattatttgtgatgacactttctaaaaacattggatactatgagtgagttttctaagtagcctatctccgttctgaaaaataaatagtttagcaaaaatgctccaaatcagcctgccactgtaaaaccccattatgttctggtgatggcttgaaagtcaggtgcttgaagattccttttggactttgcaggtttgttgttgtttggtttgctgtcttattctttagcacaaatatttttaaaatatttaaaaatgaaatcagctgagtatataaattacttcttgaggcaacattaaactgtaatcataaagaatgcttttgggggattgtgtaaaggaagggaacctaatggaaggtaagggccttcattctctttagatttacattactcacatgcagaaacctattttgtctctaagattcataaatacccagtaaaataaatacaggcacattgtacttctatactgtggaatactttctagacagatcaaccctgttactgggaataactactcatattcacatgtttgaaattcatgatatacctcccttcccccaccccaagaagaaaaatagctcctcttactgtgtttaactccgtgggtagcatcactatccattcctttgtatagaagttgaagtttgacaattcctctgtcgtgcttcatactcagcctctcatgaagtcctgttgattttgcctcttgaatatctcttgactcttgtctgctcttcgtctgtaacagtagtcctgttccaagccaccaccatctctcatcctgactacttccgtagcctcctgattatggtctgcttgcatctactgtggtctcctgtagtttt

SEQ ID NO: 11430 - DNA, 1035 bp, Homo sapiens
ctccctcgccaagctggagtgcagtggcgtgatctcggcttactgcaaccttcacctcccgggttcaagcaattcttctgcctcagcctcctgagtagctgggactacaggcgcgtaccaccatgcccagttaatttttgtatttttagtagagatggggtttctccatgtttgccaggatggtctccatcttttgaccttgtgatctgcctacctcagcctcccaaagtgctgggattacaggcgtgagccaccgcgcctggccagtctgaggaaattcttatctttgttcttatatgtaatttacttgttttctgtggctgcttttaagatttttcttttaatcactgattttcagctatttggtatatctatgtatgggtttctttgtgtttatcctgtgtgtggtttatttaatttcttggagctttgtatagcagcagtccccaacctttttggcaccagggaccggattcgtggaagacagtttttccacagatgggggatgggaggcttggtttcagggtgaaactcttctacctcagatcatcaggcattagttagattctcataaggagcacacaacctaggtcccttgcatgtgcagttcacagtagggttcaggctcctttgagaatctattgctgccacctatctgagaggaggcggagcttaggcagtaatgcttgctcgcctaccgctcacctcctgctctgcagcccggttcctaataggccgtggactggtactgatctggcggcctaggggttggggtctactgttgtataagtcacatcgtcttgcttcttggcatgtctgatagttgttgattgcctgctgaatattgtgaatgttacattgtttagtatctgaatttttttgtgcatgttatgtgtctttcatgactattgggttttgttctggtaggctgtttagtaatttatgattactttggtcatttgataattgattttagagtggatttagattagcttttactctaagggtggcttaccccactattaaggcatggtt

SEQ ID NO: 11431 - DNA, 1035 bp, Homo sapiens
aatgactgatttctttcttgaagacatgcatcgtgttttgctttggtgttccgtattttccctgtgttatttctggggcgacagaatgatgtcttggctaaaaatatagtcctgtggactaactgtttgaaacttgactttttttatcttagaaaacatttatcttctccacaacatcctcatttgtaaagttaatataatatttgtctcgtagggtttctgtgaggaatagaataattcctgaaaagtacttagcacaatgcttggcacatataaatacgcaaatgctatcttgttatttctattatataaatagttgacttgggaacctctttatttgtaagattttctagtagactaatgcctgaaactttagctgtagagtgtattatattttcattttttatctcattccttttatgactgtggtctgaaaataacagtgaccaaggtttgagttcagggtcgacataataaatggaggagtgaaatttcattttaggtttgtgtgactctggaaactgggctcttgatcactgttatattcttatgctgcatgtttttttctgtgtgacatgggaatggtattgggtttatatcacatcattttgtttagcttagtatattaatgttccttatcaagttgacaggttgttgaatctctgtctttcaaagttgattcttgaccatgggtcttgaatgtgtgtcattgatcatatgtatgtgtcattgatcagatgtgtgtcagcagaaaactcatcagtaatagaaaaataacaaaatacaagtcttgatgttagtggtgtaacgacgttagctaacattaattgaatatgtcaggtattacaataagttctttttatattactgtgtcacttattcttcagtggtcctttgaggtattcatactattatttattctttttttttctgttgagaaaacttgcccaaaggcagctggtcagttgaagggaaattgactcaaaggctcctctgatctaatgccagtgtcttgagtgctgtatagatacatcc

SEQ ID NO: 11432 - DNA, 1027 bp, Homo sapiens
ttttatatttagtgatattaaagaagagggaggggaagattaagtgacatgaaatccatttttctttatagttaatttgaccaataagtgtcagcaagtattttattgaagtagtatataattcagattgacttttgtaactttgctaagatttggaaaccagcatttcttcctttgtttttccaggctggagtgcagtggcgcaatcttggctcactgcaacctccgcctcctgggttcaagcagttctcgtgtctcagcctcccaggtacctgggattgcatgcatgggcgaccatgcctggctaattttttttgtatttttagtagagacggggtttcaccatgttggccaggttggggaaaccagcatttctggtatcattcagtgtaagtctttagtcatgaaattagcactgcttagttgataaagcatatctaaacaattaggagaatcctagagaaagcaagaaataagaaatcttttcctccaggttcttgcaaatagtaggctagaaagtaacatctgaaattcatttttaaattgaaatttttaaagctaagtttgattagaaatatttaagaggctacagatggttctgaaaacatttggacgggtagaagatggtttgcaaaaggtaggattcttaaaaagaggcattataaacgtgtatcagacacaatttttgaaaattaatttaccttttaaatggatatcgaaattatcttcatcaccgccacccaccacccattataaagtgtaaaataaacagaagtttctgagagtttgctaattagactcctttgaggtttgattttgtgttttgcaatctcctgttattaaaatagttcctcatcccggctgttattaagttcctcatcccgggctgggtgcggtggctcatgcctgtaatcccagtgctttaggaggccaaggcaggcggatcacctgaggtcaggagttcaagaccagcctggccaacatggcgaaaccccgtctctactaaaaaaatacaaaaattagctgg

SEQ ID NO: 11433 - DNA, 1024 bp, Homo sapiens
atggacttacatacaaatgttatttttggggcaagcagacattaacagtagaaaataatggaaaagatgactcttcttaaagagtttaattggggtctaataaattccatgtgaataaataatttttggcatgagtatttaaaaatatgcatttctttttattgttttatcataattcaactctcctacagatctttggatataggaaatcaaatgaatgtttctgaggagatgaaagttacaaatattgggaatcaggtaagaagcagcttaatttttgcagaaagtatgcttcatctggagggcttttaatctttaagcagcaaaatcacatttttattgaacttatttaaattattgacatttttctatttcagcaaattgacaaagtttttaacaacattggagcagaccttctgactggcagtgagtccgaaaataaagaggacgggttacagaataaacataaaagagtgagtttccttactgttctttcagccctcttattttatgctgtaggacttcctgtaaaccacagatttttgttgggaaatactgttcagcagcttaacaagaaacatttgtaattatctttctgaaattcctttatcagttaaacatgaccctaacccattttgagaataaacatacttaagatttttagcttccattattacttgacttgccacaaggtaatatttatagactccttgactcctttgtcctttctcttgtactttgccagtcacaccccttggtgaatcccactgtctctctttgcttctgctcctgtgttgatggattctactatagatttgtgctgtccagctatcctaggctgtctctgattgttgctcttcagtattttaatttctctcccactcactacattcccaacagtttgagttccaaactccttccattctttttgagcctagcaacctcatcttctgtcatttcatggtgtcaacttttatagtccatcagattttcactttgacactttcacagagtactggtcagt

SEQ ID NO: 11434 - DNA, 1027 bp, Homo sapiens
acctgtgcctcctgggttcaagcaattctcctgcctcagcctcccaagtagctgggattacaggtgcccaccaccacacctggctaatttttgtatttttagtagagacggggtttcaccatgttggccaggctggtcttgaactcctgacctcatgatccacccaccttggcctcccaaagtgctgagattacaggcgtgagccaccacacccagccaacacagcactcttgacccatgtatgctgtgtatccagcttcaggttgttcatcaccctcatctcagtaaatgctgcctctgtctctgctcaaattccctaagcctgaaacagtagttcttgacactctgctcttacattcctctcctttaccccatcatctctgacagttgccaaatccgtttgttcttaactccaaatatatgtcagatccatctcctttccagtggagactgttagattctagctcagtcaccattgtttgtcactgaactactgcagtggactcttccctcttccacactactctcccatctcatttcttatacagtgtttctttggctctcaccttttctacccctacttgtttctccttctctcagtgtttccctagttctttttcctacatattcatccacttttcccccttttctctgttaaacgcatcactgtttcactccaccctttctctctcttcctcggatttcctttaaaactgtgaattagatcatgtcgctactctcttagttaaaattcattaggggcttccattgcatttaggataatatctggtgagggacttcaataaaccactgacaacactagacaggtcatcaagacagaaaatcaaccaagaaacaatggatttaaactataccttgggacaaatggacttaacagatatatacagaacatttcatccaacaacagcagacagaatacacattctgttcaacagcgcatggaactttctccaagatagaccatgtaatagggcataaaacgagcctcagtaaatttaggaaaatt

SEQ ID NO: 11435 - DNA, 1050 bp, Homo sapiens
tccattcattaattcggggttttcttacattgaccacagtattgaatattgaaaatgtcttggctgggcacagtggctcatgcctataatcccagcactttgggagtctgatgtggaaggatcgcttgagtccaggagttcaagaccagcctgggcaacatagggtgaccacatctctgcaatacataaaattaaaaacttagctgggtgtggtggcatgtgcctgtgctctcagctactcgggaggctgaggtgggaggattgcttgagcctgggagtcaaggctgcagtgaaccataatcgcatcactgcactctagcctgggcaacagaataggactaatactttgcttctaatttatatatttgctgtgagccacagcagctttttatatgtgtctattatgtatgatttatgcttcatcatttaaatattgatgtggattatgatgacttttagcaaaggttttattcattcagttgattgattttttttttctttaggtatggtttggagaagatctgcctctaagtcctcggagtcctctgactcccagacacggaccaggattggctaatgtttgtcagtacgatgagtggatagctgtgaggcatgaagccactttgttgcccatgcaagaagatctgtcaatctggttatctggtttattaggtgaggcttgaaacaatacccaaaattgtattatcttattcaatatgcatttattgagagccttactctttgtcaaggagtgattgttacagatgctggggatactccagtgaatgaaatattcagtgcccttggtctcacccaggttacatttcagctggggaaatagtctgattcaccctgaaccttgggtcttgaatagtaggaaatttgcgatttaaccgaagaggtcagtaagctttgaataatgaacattttcactgttaatattaaaatcatctttaaaaattgtattggtctaatttttttttttactgatttcctcctgcctcgacccaccttagtcttgtataagccatgaactttgagtgaaacata

SEQ ID NO: 11436 - DNA, 1053 bp, Homo sapiens
ctattatcagtttgatggataatatttagagtttattatgtaataataatgtttttaaagaagacattctagaagtaaaaagttagtattccctgggtatttgttatggtattgtctttaattttaaaattgcaaccaagtccatcttatttatagagactgtttttcttgtgcaaggaatattaatatgcagtgaatttatttcattttaaatgaaataaaatcgatgtcagtttttctgtacttctacattacagatatttttgtttcagtatcattaagttaactggccattatttgctattttaactgtaccttctaagagtaagtatttagagtctgatctgatatttttctagtgttttgctgtaatctgattctatttaattaattttaaccatattgtttttatgtttctagaagattcttaactttgaaatatgtttttaggtattaaagttaaggcagaaaaattattggaagaacttgataatggagtactattatgtcaactgattgatgttcttcaaaacatggtgaaaacatgcaactctgaagaatcaggggtaagtaaatgttcgacagtattgattttatgtcttggtacatattaatttatgtacacttcttatctctagaaggttgtaaacttccatgccaactggctatgagatgttgaataatttacttaacccttttcaagatctggaaaaatgttctctttcataaaatgagattagatgttgaataatttacttaacccttttcaagatctggaaaaatgttctctttcataaaatgagattaacagttccttaggatttatttgtgagagttcaatcaaattaaatgggtgaatgtatagatagtgtctaacatagtgcttgatgcatagtagatccagctcttcttgagaacattaacataacttccttgtagaattgttgtgagggttaaatgggaaaagagcttgtgatggttcctggcacacaagtagcagctgctattattattattttcttctttatatattctccatatattgcattagtg

SEQ ID NO: 11437 - DNA, 1042 bp, Homo sapiens
aattcctaaatgagttggctacaggaaggttctggactaatgctttagtaattgatattttcattaagaattactccaccaagcctaaaaagtagtaacttccctttaaccggataattacggaaatgacaggaggcctaataatgtattatcacggtgtttagctttaccttacaaacaacagctgccaacttgattatctaatggattaatatttttgacaattcattttgaggagtcatgctctgttgaagaattattgacgtattttctcatttccttgaagtcaacagaagcatctgtgcagtgactaaagcggtagctatttaagttttatactatatttgaaagcatttatatatgtgtacatacacacacacacccaccaccccacccccacacattgaattcataatgtgataagtgcagcagtgtaccaagggcagggctgtgggagttgtctgccctggtagaagttttatcactgacatagtttaggattgctggtttgtggtgatagtaaaaagcaaactgactttttgttggttgtattattttaaaattctctactgacagtacacacccttattgccctcacacagggtaagcggcctcctgtttgctctgcatctgggcacccctatccagtgtagagcaagcatgggatgctattttatccctctgtttgcaccttgctttagatccagatgggctgatcattattgacagtgtagttgatgtaatggcacatctactttctaaagatcaaaacaaagtggaaatgctttgaattctctagtttctagtttattatttctgaaaggacataagattgttgtatatttctcattttcagtagaaggcatcttctcactctcctgaaggtcagtataggactaagtaaagcactgccaataccagtaattcattttgaggcattgaaccgataagctaatgtttttactctccagaggtctcaaagatgagcctcttaattttttacactttgctagcaactcaaagctattttatgaaacaaata

SEQ ID NO: 11438 - DNA, 1040 bp, Homo sapiens
gcaatattgttaagatgcccacactacccaaagcaatctacagattcaatgcaatccctataaaaataccaattatgtgcttcacagaaatagaaaaaataatcctaaaatttatgtggaatcacaaaagactcagaatagccaaagttatactgagcaaaaacaacaaaactggaggaatcacattacctgacctcaaattatactgtagatctatagtaaccaaaaaggccaagtactagcataaaaaaacagacatatagaccaatgggatagaatagagagccccaaaacaaatccacacacttacagtgaactcatttttgacaaagttgccaagaatatacattggggaaaagtcttttcaataaatggtgctaggaaagctggatatccatatgcagaataaagaaactagacccttatctttccgcatatacaaaaattcaaatcaaaatggattaaagacttgaatataaaacctcgaactatgaaactactaaaaaaaagcattggggaactctccaagacatgagactgggcagagatttcttgattaataccctacaagaacagtcaatcaaagcaaaaatggacaaatgggatcacgtcaagttaaaaatcttctacacagcaaaggaaacaacatgaagagacaacccacagaacccacagaaatgggagaaaatatttgtaaactatccgtctgataagggattaataaccagaatatataagcagctcaaactactttgtaggaaaaagacctaataatactgtttaaaaatagccaaaaatttgaatagacatttctcaaaagaagacctacaagtggccaacaggcatatgaaaaggtgctaatatcattgctcatcataggaatacaactcaaaactacaatgagatatcatctctccacagttaaaatggtttttatccaaaagtctggcaacaacaaattctggcagggatgtggagaagagggaacatttctacactgttggtggggatataaattagtacaaccactatgaagaaaa

SEQ ID NO: 11439 - DNA, 1031 bp, Homo sapiens
aggggtgcttagagtctatgtggatggatgaaacagaaagtagaaaagaatgaggcaaatgatgtggagggaagacagcctagagtacatagcactagatgaggagtgttgggtgttcagtaacaatgcttacccaatgtaggccttggacagtgagatgttacttacagagccattgatgtcttctttattttggatgctagggggtaagataaattgattaatgggcaagggcaggtggggagggaacagttgtaatgataaaattcccatcctagtttagaagttccttttgggacacgttattaaccatcaaagttgccatatccttgactattccagacctgatttttaaggtagctaatgtaatcagagtggtgactcccagagcaatacttgaaaataagagtttatatattaatgttaatgacttgtattcccacaggcagtgaagctaattttgcgaaagctaggaccagtcactgaaacagaaactcaactaccatggatgttaattggagaaacactcaaaaacatggtcaaatccactgtatcctacatctccaaggaacattttggtacattttttgaatgtttgcaagtgagttctaatctttaaggatgggtttttgataaggagtctaagaatttactgtttctgctctcagttttgcaaatcactcctagaagttatattttataattgttttatttatacttctgtacacatattaaaattttccttccctctgcccccctgtgctattttttatttgatatgttatcttgagatgcagtagaaggctctggagccagactgcctgtttgaatcttgacccttccacttactgctagtgtaacctgggaaaattatttgaaatctcgattccccagtctcttcagataataaatgggggtagtaatattctctccctcagggttgctgtgaggatgatgagtgaatacttgtaaaaaacttagaatgggccgggcacagtggctcacacctgtaatcccagcactttgggagg

SEQ ID NO: 11440 - DNA, 1034 bp, Homo sapiens
gctttttttgctttgttttgagggttatataaaataacacttatcagttttttgaactgcaagggctgtacatatgccagctggcatttatggtgttagtagcatataaacttcataccatgttaattttccaagtttttccctaaagaattagtttaccccacggcttaaggataagatcttagtctaatggtacaagatgctgtggggtagaggtagaaacaggagcctgtaacagggagtgggtctctgagtttagaaagatttagagactaaagatacacaattctaaggaacgtttaatactggttggcatggattacctataaataatacatttatagatgatccgaactaatggaaaacccaaatgtcacctttaattctgactttgaagtatattacaggctttttattttttggctagcaatttatatttctaaatatgtttcaattaatttggtattagaactaatttgtgaatcccttgtaaacattctctgagacgaaccaaaccaggaacaagaacgaatgactaacaatggcaacagcatcccaataaaaggtgacatttagtgagtactcactgtgtgctggacactcttatggatgctttgtgtgaattgttttatttaataaatgaatgagtgaacatgctgttcacggagataaaggttacagtatgtaatgtgtggttaattgaatgttgtaagtataataggtatgatattaagtggatgatggtgcagtttgtaacttatagaaactttacttgtttcattcatccattttttgatttattaagtgctagattctgccagatgaaaataccaagtaccacagtgtcccagccctcagattgtagtttagtgttatcgatctggaggttaacttgggctaagctagagtttcttttaggagggttggtagggtgctgtcctcaaacatgttattttatcagtgtgtttttgagtgaggacttgaaaggccatccaatcagtttcctagcatctttagcccagtgccctgcattc

SEQ ID NO: 11441 - DNA, 1169 bp, Homo sapiens
aggagttcaagaccagcctggttaacatagtgagaccttttccctacaaaaactaataataaaaatagccaagtttggtggcacacgtttgtggtcccagctactcaggaggctgaggtgggaggattgcttgagcctggaaggtcaaggctgcagtgagctgtgatcatgccacagaactccagcctgggctgcagagtgaaaccctgtctcaaaaaataaaataagagcgccaagtggaatatacagcactccaagtagttacgtggtatctagcccctcgctgctccaagcatggcacctggacagacagtatcagcagcatctgaggggttgtgagaaatgtaggatttaaaggtcctacacctgaccctacagaaactgcattttcatatgatccctgggtgatttaaagtttgaggaacgctgcagcttcttttcaagtaagcagccatattacttgttggggtgggggtgaagaatgatgctcaaagaaaacaattttggtacagtcgacgtgattaagactcctggtagttagctttactttgtacatcctagtttgttgatgggtaaggttcctagtctacagactgtaagtctaacacactaagaaatgtcacattcattttgactatctttctttgtatagatttttagtagttgctctatcgattaccatatatttcaatagtctactgagaatcagtattttaccaattcaagtggaatgtagaaaccatatcaccctgtatggccctttgcccttcaccctttgtattatagctctttatgtattaacgtctccgtatactgaaaacttcattaggcaatgttataatttttgcttataattgtcaaacaagttttaagcactcaagaggagagtagtctgttctacctagatatttactatttctgctgttcttccttcatttctgaatttccacacttctttctaatatcattttgccgtagtctagagggtgtcctttagcaatgtggtggagcaggcatggtgggaacagattctgttagttttctttcttctatgaatgtcttccttttaccttcattcctgaaacatattgttgctggatatataatttcactttaacagttctttctttttagctgtttagttctttcctttaaaaatattgttctat

SEQ ID NO: 11442 - DNA, 1032 bp, Homo sapiens
cttgaactcctggcctcaagtgatctgcccgcctcagccttccaaagtggtgagctaccacacccagcctgattttcatcatctacgtatttagctcctacagaagatttttaaaaatagaatacgtggctgggtgcggtgactcatgcctgtaatcccaggactttgggaggcctaggtgggtggatctcaaggtcaggagtttgagaccagcctgaccaacatggtgaaaccccatctctactaaaaatacaaaaactagccaggtgtggtggtgcacatctgtaatcccagctactcaggaggctgaggcaggagaatcacttgaacctgggaggcggaggttgcagtgagcgaagattacaccactgcactccagcctgggcgacagagtgagactctgtctcaagaaaaaaaaaaaagaaagaaaaatagaatacgtgtctcatgcccatgagaggatcacattctaatatgaaagatagggccacatacaaatgacatcacatcgatctagagctgaaacatacctcagaaactatctagtctaccattttcatttagagaagacctaagaacatgttccagaaaaatcagtattttgaggctgtaagtgaaatttgtccagtgagttcagtggatctcagcatgcagctttcacctgatgccagtgccatgctcttgggcttcccaggctccagaaccatgagccaaataagtcttttctttataaattacccagtgtctagtattctgttatagcaacagaaaatggaattacacaactcttatttgaaaaaatgggaggctataattatgaaacaattaatgacttatgtggaattacttcccttggttaaattagatctttactttcattaactaaagatgataatttcaaagctttgctttttaaatttgttctgctacctgtgaaatcatttaaaatcaaggaaactagacaacagaaacagtgcattgttataaagtcatgaacatcattgtcatgtagttccttatatttgtatacct

SEQ ID NO: 11443 - DNA, 1443 bp, Homo sapiens
aatcagtaacttaaattaattcgtcggagtactcataaatgctacaccttaagtcttttaggtactctgcatgttataaatagttacattatttgataataattttatttttcttctcctcttctccaacttaatcattagcccaagtttacaatagagaggattaaaagaaaattaagggacctgaataatatagaaaagggatatgcagtacttaaataagcatttgattcatataataaaataatgcagtgtggagtctaaggtccttttttggtcgaatcttcatgtgcacagaaaggggacccgccttgacaacagtcaccagcatcaggtaattgtgagactctcaactgtggtaggcaattggtgagataatgtaaaagcaccttgtaaatgctagtgctaaacattagatagtattatctgcctctgttgcctctttcttagagaccaggaaatagtgcacaaagcaggaatactattctctgttcctctttttcatatagttccctctcggtctgatccttttaagaactttgtcatttgctcattttggctttggcttcccatgcctactgattctttttagccccactttattgctgaaaaggagaaacagtagctctgaaaaaactctctaatgataaatgataggagaagcttaaaactatggatcatttagcagagggcaggcttcaggcagttgattctcaattatggaataattgtatttaccacctatcgagcacttacatgtttcaggcattgtactaagagcttcacaggcattatcttatttattccttacatttatcccgtaaggtgggtattacctccatctaaagacattggggcatccaggcagagatgtaaagtatgtagacagatataaaaatctacagctcaggaaaaaatgtagattggagataaggatttagaagtcattagcatatagatggtagttttaagtatagataaaattgttcatagactataagaattccagatggaattctgaaagcatcatttaagatatgaatgaagaggcagtctaggaaggagcgtgagaagagctccagcaaggtaggaaaatcaggagagaacatggaatagataaaaacacagcagagcttttcaagaaagagggtatgatcagcatcttaaatattgtaaagaagttatgcaagataattaatgaaatgtatcccttagatttgtatcctttaattggaattgaaaattgaaggtcaatttaccttaaacaattttagtagaataatggggccaaaagccagactagagtgtgttaagcaacaaacgtgaagagaggagaaaattacaaatgttgactaattttcagtgagcctattcgtggagcataggagagagagtgacagcttcaggggaatgcagactagagggactgatgctgattggtta

SEQ ID NO: 11444 - DNA, 1049 bp, Homo sapiens
ataatatggtattactgtaattttatagtaagttctaacttaaaacatgtaaacttaataaacaagagtaaagctgttcttgtgaacccatttaaattggttatagatttaataacctcaataccaaatttatttcaatattttatttaggataagcagtgccgagaggatactaattcacatagataaaaatgtaatggtctggattttacaattttacataaaagaacatttgcagtctgaatgcaaaaagaaaggaggtggggatgttggtgtagaaagaaactaggataagctgggtgtggtggctctcgcctgtaatcccagcactttgagaagctgaggctgggaggatcgcttgagcccgggagtttgagactggcctgggcaacatggggaaaccctgtctctactaaaaacacaaaaaattaaaaaaaaaaaaaaaaaaagaaaataggaaaaaagaaggaaacctgaatagaactaaactattcttactcttcttcatcagtgatattttgtagaattggcagaataagctctatttcagtatctccacaaaattatgttaatttggcaatccacatgtggactgccttcgatgtagtaaaagttgatatagaataaactgcattaatttttagccagtttaaaacgtgtgtgaatatcaaactggaatcagacatctgtggcactgtattatgtctctgtcaccctcaggttctatgaaaccttggaaagcacaactcaggtttgtatactcctgtaggccatacactacatcacactgttctttaggcctcttgcacaaaatagatggtcagaaaatgtctacattgtaataaatgcagtgttaaaatgtgatactgattttctgctttatcccttagggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtg

SEQ ID NO: 11445 - DNA, 1047 bp, Homo sapiens
attattgaatcaagttatgttctaagaaattttttatactaatcatttttcaagaggcatattagtatgttataaaatacttgcttttagtatactagaatttaaaagggctacaggaattttttaaataaaatttgtatttaataaaaggaatttgttgtaccagttcagaaaaacatacgaatctttatactgaaggtaacttgttccttgatattttgagttaaaatttcactgtcactgaaaagtggatgttaaatattccctttcatgaaaaatgaaaacagtagctaagagtcagttgacatgtaagaaaattagtaacttagaaaaacttacttggtaaaaaaaatcttccttttagaatacaaaagtttactttaagtacacactgactcatttgaggtgataagggataaaataagtaaaagttattcaaccactaagtacattaggtactgatacttatctttccactctaattgaaatgtatttagattactcattatgaatactactagaactatcacaaagatctctggggatccaaatcttcagattcccatctgaccctatttatttttaattttatataatagttcaacagaccatatgtcatatgatgaagtaatcaaaaaaaaaaaaaaggagtaatttgtgtactacatctgttttaggcaagaaaaaggtatattgaagaaaacagtgaaagatgatattccttaaaagcaaaaaaacatacttatgggaattaagtacacagaaaacactggagtacttattttgcctctaactaactattggtaaaacttcccaaataaggactttcttacaaggatgaatagtacttatgatttatattctaataatatatactttggcttaaaaggaaaatcctttacaaagttcaaaaatttaggaaataatgtcaaatattcgttaatggtggaagactaatttcttcctgtacaagtaggttgtcacaattagaaaaagtttatctgtaggcacctgtttttttaaaacttggaaaaccttattataact

SEQ ID NO: 11446 - DNA, 1704 bp, Homo sapiens
aactgggtggcgaggctccgcccccatggggcgattgcgcgcccaaatagctggcccagggtgctttggccgccggagcgggttgcgagtacacttgaggcctggtgccttccagtttttaagttttaaatgtttataatcgaaaattgcagctaggcgcagtggctcacacctgtaatcccagcactttgggaggccgaggcagacggatcacttgaggtcaggagttccagaccagcctgtccaacatggcgaaacccatctctactaaaaatacaaaaattagccggacgtggtggcgggcgcctgtaatcccagctacttgggaagctgaggcaggagaatcgcttgaacccgggaggcagaggttgcagtgagcaagaccatgccattgtactccagcctgggcaacagagtgagactccatgtcaagaaaaaaaaaaagaaaattgcggaataatatgtaaattatgaaacatgatgaacataccacctaatttatgaagtagggctttaccaacattcactgaatctcctcaggcaggcctttccatccgatcctcaccaggaccccacccttccccattcagggatataagaaaattatcctaaatttatgtaaatcattcacccttccttattttctaagttttattaccacatgaaaatgtgtcgttaaacaacacggcttagtttcgttcgcgtttggcattacaaaaaattgtcccatagtctatgtagtgttctgacagtccactagaatggcaaaactacaaaatatgactacacggagtgatgatgaatctatgtaacaaagggaacccattcagtgggtgggagtataattgtaaaacaattatttggtgtaactggaaatcacctatcaattgcaaaacaatttttgaagatacaatttatgaaggaaatgaaactcacctataatcccactacccagaaataatatacagtttaaaattgggggtattattgcctttcatccttttttctgtgcttatatgtattttcccccaaataattttaaaatatatttcaacctttgtacctgccttagtttgctcacagctctgcaatcctttttctatttgaaatcatacattttactttttttttttttttttttttgagacagggttttgctctcttgccaaggctgaagtgcagtggcatggcatgatcacggctcactgcagccttgatttcctgggcccaaatgatccccctgtctctgcctcctgcgtagctgggactcatgcacgtgccaccatgcctggctaattaagaaaaaaaaaaaaaaaaagtttgccgagatggggtctcactatgttgcccaggctgttctcaaactcctaggctcaaatgatcctctcacctcggccttccaaagtgctgggattacaggcatgagccaacttgcctggcctatattttacttctttaatatttggcaaaggcttcaggatcttattgacgccaatcacttttcaactgcctagttcaagtaagagattcaaaggaaccctcctgtttactgttttgctttgaatcctcttccttatgatgctcagcattccactggctcgtttaaatacaccagtgtattgggtaaggaatgacggatgacgactcccagacttgttcctgtaattccattcactacatcaaacctgttgatacaggatacag

SEQ ID NO: 11447 - DNA, 1176 bp, Homo sapiens
ctaatactagttatcatctcaaatcatgaagtctgatcatgacaaacatctaaaaaaaaaatctctcctgggggtccattctcaaaagaaaaaagtctaattcaaatacagcctttcacaatcttttttctcgacacaggactctcttacacctctgtgcctttgcacatgccatttcttctaccaggaatgctctttcttacatggaagtgtcattttcataattcaaaatcaagtccaaatgtcaccttcctgtaacagaatcagctggtccttcctacgtacaccagctgcactgaactcttattgccgccctcaatatactgtatcacaatttgcctggtatctgtctccctggatagactgtgagcatctcaaggcctggtaccacatgcctttcatcttagtattcctagcacctggcacagagaggcaagcaaagggtcaaaaatcttcctaaactgaaagataaaattatctttataattaaatgttggcaatggcagtagaatgaaagatgaagaaaacttataaagcagctttggaatatagtggaatgtgcagaggactgggagtcaggctggatcagccacttgccagctacttcagctggagcaagttactcaactcacattactatgttctcatctgcaacatggcaataacaatacttttaattgtagagagtaaatatcttgcccagtacagtgtttggcgtacaacaggttctcaagaaaaagggtagctactctgacggcagtgatgatgatgaagcacacttagtaggtgttgtaggccagaatctggggaatgggctgtccaggttcatacgcgggctcccccattcaggagctgagatgccttatgcaagttacttcctgttgctgtgctgaggataaaatggacctactacagagttgttagaatagttaaatgagaatgtgcatgaaaagctcttagtcaagtaccatgttacagttaagttaaaaaaaaaaaaaaggccttagtaaggtattgttacttaaacacgcaatattgctagtgattattcccacagtagatactcaataaattagctgatttaacaaatataagaatgaaaattagggccggatacggtggctcaggcctgtaatcccagtactttgggagcctgaggcgggaggatcgcttgag

SEQ ID NO: 11448 - DNA, 1053 bp, Homo sapiens
tatatttgggttaacttgtttttttaaagcaaaatttcattgctgcccatttgaataaacttaagcttaagaatattaatttctttacattatgtgcccttctgtgataatacaccattttcacaaatgcctctgtgtatctgtgtcagaatgttatgatagaatttgaaatgaattatttcaaaattaagctcttatgtatggttatacacgggacatgcatatttgatgtttaataggaagatttaggataaacatgtaactattattattgtggtcaaattatttttatttaataagacttttttcattccctaaacttttaaaaactactggctcttgtaccccaatcctggaaattcttccaatctgcaccgggatactggaaactgcctttaaaaaatttccacaaagtgattcttacttaggtagcttgagccaaactagcgtttggatttaagccgtagattaagggttagaggtgttcagatgagagaaggatgaatgtaggatagagtggtaaggaaaggctttgtgatattagatagattttagataaaggaagagaaggctgtagaggaggtatgatgaggaaagtcagttcagaagaagggttcaggggaatcaaagtcatggtatgaacttggcaaagatactggcttgactagagaagaggatttttgaagggtagaattagcttcaatgggtctgttgggctagatattgaaatgacattctgatgagttattttaattttatatgtcagtagtttccagatttttagattccatagacagtaaaatttctaaaaaattattagacactgacagattttaaccatttctcatttttgcaaataaggccattgagaaaaaatagttactatatactatgatcatcattttgaaaaaggaagaatattttaacacttaaaaattaaaaagtataaaatcttaaaacagggatagtgttttctacctgtgaatagttggcagttttgcatattttaaacaatgcatgttaagataaattttgaatctcgaaaacaatgac

SEQ ID NO: 11449 - DNA, 1048 bp, Homo sapiens
tgcctccctagtagctgggactgcaggcacccgccaccacacccggctaattttttgtatttttagtaaagacggggtttcaccgtgttagccaggatggtctcgatttcctgacctcgtgatctgcccacctcggcctcccaaagtgctgggattacaggcatgagccaccgtgcccggcctgtaagttcaactttttaacacaccacttgtaagtgagattatgtggtgtttgtctttctatgcctgtcttactttccttaatataatgttttccaggtacatccatgttgttacaaatgacaggatttctctcttttatggggctgaatagcattccattgtgtatatataccacattttctatccattcatccattgatggatacttaggttgattccatatcttggctattgtgaacaatgcagcaatggccataggagtcctgatctctcttcactactgatttcatttcctttggatatatacccagtattgggattgcaggatcatatggtagttttattttttgagaaactttcatactgtaatgcttatactaattacatttccaccaacagtatacaaaggattcccttttcttcacatttttttttaacacttttatcttttcaataatggccattctaacaggtcataatttattttggtttccatttgcatttttctgatgattagtaatgttgagcattttttatatacctcttggcaatttgtgtgtcttctttttggaaatgtctattcagatcctttgtccaattcttaaaaaacgattatttttaaaattcattttattatttagagacagagtctcaatatgttgcccaggctgtacttggactcctaggctcaagaattctcctgcctcaacctctgaagtaattgagactgtgggcatacgccactgcatcctgctcttttgcccattttttttttaatggggttgttttcttattgagtttcttatatattttggatattaaccttttatctgatacatgatttggatatattttctcccattcc

SEQ ID NO: 11450 - DNA, 1053 bp, Homo sapiens
caggtggtatcatgctacctgacttcaaactgtattaaagggctacagtaaccaaaacagcatggtattggtagaaaaacagacacatagaccaatggaacagaatacagagcccagaaataagaccacacaccaacaaccatctgatcttcaacaaagctgatgaaaacaagcaatggggaaaggattccctattcaataaatagtgctgggataactggctaaccatgtgcagaagattgaaaccggacctcttccttaaactacatacaaaaatcaactcaagatgagggacttacatataaaacccaaaactggaaaaaccctggaagacaacctaggcaataccattctggacacaggcatgggcaacgatttcatgatgaagatgccaaaagcaattgcaacaaaagcaaaaattgacaaatgggatctaattaaactagagagcttctacacagcaaacaaaactatcaacagagtaaacagacaacctacagcataggagaaaatttttgcaaactatacatctgacaaaggtctgatatctagtatctataaagaacttagacagatttacaagaaaaaatcccattaagaagtaggcaaaaagctgggcatggtggcttactcatgtaatctgagtactttgggaggctgaggcaggcggatcacttgaggtcaggagttgaagaccagcctgggcaacatggtgaaaccccatctctactagaaatacaaaacattagccgggcatgggggcagacgcctgtaatcccagctactcgggagactgaggcaggagaatcacttgaacctgggaggcagaggttgcagtgagctgagatcacaccactgcaccacagcccaggcaacaagagtgaaacaccatctcagaaaaaaaaaaacctaaaaaaaagaagtgggtaaaggacatgaacagacacttttcaaaagaagacatacatgtggccaacaagcatatgaaaaaaagctcaacatcactgatcattaaaaattgcaagtcaaaaccacaataagatatcatctcac

SEQ ID NO: 11451 - DNA, 1004 bp, Homo sapiens
tttaattggagcatttagcccatttacatttgagtttaatattgttatgtgtgaatttgatcctgtcattatgatgttagcgggttattttgctcgttagttgatgcagtttcttcctagccttgatggtctttaaaatttggcatgtttttgcagtggctggtaccagtttttcctttccatgtttagtacttccttcaggagctcttgtaaggcaggtctggtggtgacaaaatctctcagcatttgcttgtctgtaaaggattttatttctccttcacttatgaagcttagtttggctggctatgaaattctgggttgaaaattcttttctttaagaatgttgaatattggcccccactgtcttctggcttgtagcgtttctgccgagagatctgctgttagtctgatgggcttccctttgtgagtaacctgacctttctctctggctgcccttaacattttttccttcagttcaactttggtgaatctgataattatgtgtcttggagttggtcttctcgaggagtatctttgtggagttctctgtatttcctgaatttgaatgttggcctgccctgctaggttggggaagttctcctggataatatcctgcagagtgttttccaacttggttccattctccccgtcactttcaggtacaccaatcagatgtaaatttggtcttttcatatagtcccatatttcttggaggctttgtttgtttctttttactcttttttctctaaacttgtcttctcgcttcatttcattaatttgatcttcaatcactgataccctttcttccacttgatgaatcagccactgaagcttgtgcatgcatctcatagttctcgtgccatggttttcagctccatcaggtcatttaaggtattctctaccctgtttattctagttagctaatcgtctaatcttttttcaagtttttaccttctttgcaatgggtttaaacatcctcctttagctcagataagtttgttatt

SEQ ID NO: 11452 - DNA, 1469 bp, Homo sapiens
atatctggagtgcatttttatttggatttaaaatgtttttacaatcccagtataaacactgttaatctagtcaaaactttttctcacaagatcaagagcttgcatagttttactttaactagttatagtcaaaagggtaagaataagttgtgcatttacattacacaaaatcttattttaaacatgaaggatgtcagactaaaaatagtgttaggaatttttgagataaaacagtttagttttaaaactctaaataactggatttatttaatttacatagcatttggaaattttctgatgtgtaacctttgtggggttggggagtaagtgtacagtttttggtacaatgctggaaaattacaaatatgtcctacatttggagaatagatccaatgtttgagagttactgatttttttgtttttggttattcattgaactagtttcatgaaatagaattaatttccattttcatgacacaacaggcccctgcactaaggacaatgaggataatttttttagttgtgtttgtatagatgagtaaagagctgcttattttaaggcagtttggacacttagtcttaaatgtggatagtaagtactaccagtggctaattattataggaagtataaaaatgtagatttaaaagggtcaaatatatagaaaataatatttaggagtacttgatttctttctgtttttgttgtgtaaagtttatattgtagtttagttctagtgaactatagttgtacttgaatacccacccatcttcaaatgcaatgagttgacagatcttggtgttagtggaaactactaaaatattaaaggaacttaactatagaagacagcaatgtattacatttcataaatcatatctggatacttaaaaatatttagtactcatggtgtattaaaaaggagtagttagaatttaatttttgctgaattagggctggcagcttttggaaggcatcattattaatttctagaatattaatggagcagaatggaatcaataaaaaaaaccttcaacttgttcactgagagaatttattatgcagatgttgaagaagactttaaagaaagcattatagttagataaaatattagcatgcaaacatgttggtaacattagtggatctctaagcaactatatgtcactgtagccaggttataatctgttttatttctcgtgggatagatagaaattctgtcaaaaaagagaaagaaaaagaataattttgcctgattactaacatctgacaacttatagaaagaaacctgtgtctttttagcacttgtttgttacagtttcatgtgtccatgagctgagaagaatcaaaattaatctctggctcaaggttttacacttgatcttagccaaaaggccgagaagcaatggctcaaggttttagcactgatgttttgctttcctagtaatagtaatgaaacataattttattgcttcaa

SEQ ID NO: 11453 - DNA, 1033 bp, Homo sapiens
tgtgttttgcatatggatgaccaattgctccaacaccaattattgaaaagactgtcttttcttcattgttccttttgcacatttgtgaaaaatcagattgctatatttgtgttggtctatttctgcacgctattctgttccattgagctgagtgttcttttgtaaatactactctatcttaattattgtaatcgtatagtaatttagattgtttctcagcatttttaatatactgttccaatatcatctggcctacatacttctggatgatttgttaaccttattattgttcctctgtaggtaatgtgtcattttgttctggctgcactcaagattttctcttacttttggctgtcagagtttatattcattttgtttggttttcctacttaaatagcttattggatctataagttaatgttttctactaaatttgggatgctttgggacaaaatgtattcatgtattttttctactcttttcacttctcttcagggattccaattacgtgtatgtttgacctcttaaattgtctcattaatccctttgattctttcatcttttttgttgttgttgttctcctttgtttttcagatttgataatatctattggtttgtctataagttcaacaatactttcttctactctctccaagttgctgttgaacccatcaagcaaattttgttttacttattgtacttttcatttccagaatttattttgtccacttttctgttgacattccctctgttaatttgttggtaacagatattcttttaattcattgaacatatttcctgttaatatcttgaacataattcataataactgccttgatgtttttctcctaaactcagcatctaggtctacttggtgacaatttctgttgactactttttaccttgagtagggggggcacaccttcttttttctttgtttattgatttttggatgaaaactggatattataggtaatattttataacaactctggattcctctatgttcttctgagaaatattgtgttttcgt

SEQ ID NO: 11454 - DNA, 1028 bp, Homo sapiens
ctcgagagaaacaaatgtctatctttttggtatggttgtgtgacatgttcaaaattaagactccttgcacagtggatccatgtatcctaatatgcttgtaactaggatgaaacaacttttaagtggttaatttatgttctacctctgtatttgaaaatccatggtattttaattttttaccatatcgttcaagtttggtaaaggagaatttctctaaagcagtgtttccttacatatgttctgtatagtgctagccctgataaattctctgtgaataaatgtttccagtgtcaaaacgtttctgttaaatgttctttgaataaatgtttccaagggcaaaatgtttagaagtagtatatacccttattggttatacataatccatgattgtatataagagctctgagaagtcctgccataaagaaatctgcttgtagcaaattaagcttgttatttaatctgttgtttcctaatttatttgaccatagaactttcccctaaattatcgacatttcacaggatttgtctttcttagaatgtaccttggaacatttcatgtttgattggaacacttacgtacagctatcacatatgtatttttatcattgtaaggacaagccttttgaactatacatgatcccaggatgggaaagctggatgtaacttagtgattatctagtctgtatttttattttacaaatagagaggctgaggtttggaagtgttaaattgcccaaccaattcacctgtttaacacaacagatcagctgacgctaaaaattcccttgttccatgtaacaatttcaatagctagtagtcaactatattataatatattcataaatgagttctttagagtcaataatacattctaattaatatactttagctcttaatttgtcccctaactcagctcctcagcctcaatctgcagctgggtgtcattgccaccacacttgctagcatgaattctgcatggcatttgtttctttggttatttacttctgactcaaagtgtgtcatgagcc

SEQ ID NO: 11455 - DNA, 1027 bp, Homo sapiens
tataatgtccagcaaccctctgggttaggcattatcattgcctctattttgtcatggagtttaagaagagagttcaagcaccttctccagagttatacaggatatacaactaagcagttggtatcaaatccagccagaaatgccttcagagtttgtgcttacatgtatctatacataatattttattattatatattttattttattctatctagtcatgaagtttttttcagctttccctttttaatctgctttatctctattactactatcttagttcagaactctccatttctaaactgttctattatagtctttaatttgtgacctgtctccagatttgataacattcgtatctcacaatatattttacacattgccatcattggttctttaaaatctaaacaggatcattttacttccttgcttactgaagcaagagatttttcctctgtaacagactggcttataacttcttggcatgatatacaaagtttcccaggctcatctcataccacttcctcccttttaccttattcttcagccatgccatgctacctggtccctgaaagcaccatgctctcttcttcctctgggtgcctcctcctctgtggaatcatctttgatgccagggtacattggtcacttcttttgtactcccactgcactgtgcgtacacttattagaaatagcacttagcattctgtaatgcaattgtcagttacttatttatcttatcaaggaaactatgggttctttgaaggcaatggttgttacctttggaaccttagctttaaatatagtgcttgggacatagtatatgcttatcaatgattattgaatgaatgaatgtcaactagcttttcatttttgcatttgatcgttacagtcatccatggggcctgtattcagatagccagaacctcatcattctttggcataagagagaaaaaataaatagagatgttgagccatggggctgatgtcacatagctagatagtggctaaagttttctgactcaaagcc

SEQ ID NO: 11456 - DNA, 1061 bp, Homo sapiens
tgattttggtttatcttgcttttctagtcccataagatgcatatttatgttgcttatttgaagtttttcttgtttttggatgtaggtgctcattgctataaaatttcctcttagtactgtttttgctgtatctcataggttttggtatgttgtgtttcgattttcatttgtttcaagaaattttttaatttcctttttaatttattaagcactttaagtaagttattataagtacccttatacctttttattaaatgatttttcaaggagatacctccttaaatccctgtgaattaattggctttattctttccaacttggtttagtggtagtttgcacatcaggcacaattgaaaagtcatatatacaggtcttttccttattctgagtctaatgtttatagcatattatattgaatgtctgagtaatcatcatttagccagtcaataacttaagtgtgctaatcaggaaaatactggacctttaacatggagctgttgggacagtgaaagtcaggacttggtataaaaaactggactggctagaactctttattttcataaacacccaggtagtagtccaatgcctatggtattaacaaattcttttatttaaccccatggtattagaaacttcaaatttaacctttatgatatttgaaaactcttgagtacatctaaattaaaatagtggattgagtttaactaatagaattttcttcccctgcctgatacttgaaatgagtacaaagtaataaaaactaataaaaataatcagcatcaactaagaaagaataatgtaatcagatgcaataagcttaaaagatgatggtcagggaaagaaactgaagatttcagagtgaagaggcatagaatgatttggcaactttagttagtcctagtccccagatacagaactagtgaattagcaaaattctgaggattaccactaatacttccaaaactgagaactaaggtgtgcattccttttttttcttttttcttgttcattagagaaatagtagaagtggcaatggaagaggaatatagacaaaatgtgga

SEQ ID NO: 11457 - DNA, 1284 bp, Homo sapiens
acatctgagtgaattaatgcatcgatctttgaacatataatatataactactgaatatataaagtcatgctgttttagatttcatgactgtatcaacaaatactctgtaagtaataatcagggtaatgtagttatactcgaagtgttacatttttgaattactgaagtcatctttattgaattatgtatttgaaactttgtctatgtcagaaaatgatttcaggtgacttctaattatttggagacatctctccattaaacctgaatggtattacacatcatttgtaattgttgaaattggcattatttgtataggctactttgttctaaaattaatttctatccccaatagctcactggtttatgtttgtggaacaaatttccaaaactactttttttggcatccttttcagtgatcaagaattgagttcatctttgtaattttctcctatttatgtagaaagttaggccctcctatttgatgtttgaagataaatgcaagagtatactttggatttctgaccattaagtcacttggtcaaatctttctagactgatacattgaatcatctttcttgttttcctaaatactcgagaaataatgtctttcctatatcattttgttttatcttgcagtttctttgctagtttcctgtttttgattgacctcacttagttctttttttcatcttagcatttcttccctccctaatttcttgaattccatatgctattttttttccaagagtgtgttcttcttaggatgaagaacttgtatttttctatgattatgtatatcacctgtattgttattttacttacaataagacgctccaaagcagtgctgacacaggaacatgtaacaaagccctgcgaagagtctaaaattgattgttttgtaactgttaccaaaaaaaaaatcaaaaatatacataaagctattattttggaaaagaacaaaaatgctagccataacaatgaatgagtttgcaaactatgaaatataaaaggttagagagaggttctcaatgagtaatagaatttctaagggaaatttttataccttgattactatagagtgtgtgtctatctagatgaagaaataaaataatgaataaatttgcatattttcttctttctttctgttactagatgaagcaaactttaattagatcccaatttgcttgtacttataaagatgactacatgataagcaaggataattggaataatgttaatttagcatcaaagcctttgtgtgttctttacatggaaaatgacctt

SEQ ID NO: 11458 - DNA, 1050 bp, Homo sapiens
ctgaagttttgcatgtgttacaccatattactatagtaatagataattgatacaaatgtcctacatggcctggaccatgcattccttgctaaatttatttcttgctactctgtccctctttcgtcactctctagtgatattggccttctgtttttatgatatgccaagatcatttctgacgcaagactttttccctgctattctctttgtcaggagcatctttctcctgttatttatctgagcatttatcactcattattgtgatgctcagctcaaatatcatggtttctgagagtgcttccttgaccctatgagctaaaggagcccccttcccactcattctttccctattcctttcactcctttattttcttcactgtgcttctgtctaaaattatcttacttgtttacatgcttattgtccatttcctctaatgccagtgagggagatggtatcaagaacagagtatcaagaacagagtctggcacatagtagcctttcaataaacatgtaataaatgtatgaattattttttcattaagagaacagatggtagaaactatgataggttctagaatatgatagagtatttacttattacctaggtctgctgtgacaaattaccacaaacttgatggcttaaggcaacaaaagcccaaaatcaatgcgtggacaggactgtgtttcctccagagactctaggggagagcccttccttgcctcttccagcttctggtgactgttggcattcactgccttgtggtagcatcctctgctctgtcttcaatgaccttctcctctttgtgtctgttcctaatattcctctgcctctctcttataaggattcatgtgatggcatttagggcccaccaggattatctcctcatctcaagattcttagtcacatctgccaagactcttttaggggtaacattcaaaatgaataaagaaaactacaggacaatatgcctgatgaacacagatgcaaacctcctcaacgtaatactagcaaaccaaatacagcagcacataaaaaattgcttcaccat

SEQ ID NO: 11459 - DNA, 1001 bp, Homo sapiens
aacatgacaaaaagaagcaatgggtaaaggaatccctatttagtaaatggtgttgggaaaactggctagccctatgcagaaaactgaaactggaccccttccttacaccttatataaaaattaattcaagatggattaaatacttaaacataaaacctaaaaccgtaaaaccctagaagaaaacctaagcaataccattcaggacatagacataggcaaagacttcatgactaaaacaccaaaagcagtggcaataaaagctaaaactgacaaatggatctaattaaactaaagagcttcttctgcacatcaaaagaaactatcagagtgaacgggcaacctacagaatgggagaaaatttttcaatctatccatctgacaaagggtaatatccaaaatctacaaggaacttaaacaaatttataagaaaaaaaatcaaccccatcaaaaattgggcaaaggatatgaacagacacttctcaaaagaagacatttaggcaacccacaaacttgtgaaaaaaagctcatcatcactggtcattagagaaatgcaaatcaaaaccacaatgctgtaccatctcacgccagttagaatggcaatcattaaaaagtcaggaaacaacagatgctggagaggatatggagaagtaggaatgcttttacactggtggtgggagggttaattagttcaaccattacggaagacagtgtggcaattcctcaaggatctagaaccagaaataccatttgacccagcaatcctattactgggtatatacccaaaggattataaatcattctactataaagacacatgcacacgtatgtttattgcagcactgttcacaatagcaaagacttggaaccaacccaaatgcccatcaatgatagactggataaagaaaatgtggcacatatacacgatggaatactatgcagccataaaaaagatgagttcatgttctttgcatggacatggatgaaggtggaaaccatcattc

SEQ ID NO: 11460 - DNA, 1107 bp, Homo sapiens
ctagcccaatagcaggcactcatgggttattttttgagttgagttgagatgaggcctgcaggtctgcagcaaattactattgatgccatcttgagcaagtcgttttctttctccaaactcactcttctctcttacaaaataacagacaagaacaagacaacttctgacattccttcccactcagagattggcatcccttttttaaaaaatcccagaaatttggacttaggagaccctttgaaggtcaattagcccaacccacagcttgttcaaggcagagccagattattcaaagaagtagagatttggcaacttcatggcttgtataatagtggaaatcagccaaaaagaataattgaggttaaaaagttatttgagggccagaattactctctttggtcaatatccatcacattaatgaggaatagtgaaatctctattttgctttggttttctcctttgctctctactgatatataacatatatacatcagtaaaatgcacaagtcttaagtgtacagtgtgaggaatttttacatatgtatccacccatgtaactatctcacaaatcaagatacagaacattttgacaactggagaaagcttcctcatgccttcactaccctctctcaagggatagatctaatttctatcactgtaggtttgttttgtctagttttgaactttatatgaatggaaccacagcgtatataacccattgtgtctgacttttcactcaaccttgtgtctaagattcatccatattgttgcatatgtcaggagtctttttgttgttgttgcaatgtgtgaattgtaagactaccacaacttaagaattcatcagtgcagattattagctacagacgaggagaaaaagttagaagatttgtctcctaatcttattattaagtagctacatgaacctctctctgggcccattttcctcaactgtgagtgaagaggtcaggctaaagaatcactagcaatttttctaattctaaaggccaaagaatgtatgtgaatcacagaccaaacaagcatctggaagatatgaaaaaaatcacatatctgacaaagaactcatcctagaatatgtaagtgactcct

SEQ ID NO: 11461 - DNA, 1105 bp, Homo sapiens
cgagaaagctggccgcgaaagtcgtgctggaatcacttccaacgaaaccccaggcatagatgggaaagggtgaagaacacgttgccatggctaccgtttccccggtcacggaataaacgctctctaggatccggaagtagttccgccgcgacctctctaaaaggatggatgtgttctctgcttacattcattggacgttttcccttagaggccaaggccgcccaggcaaaggggcggtcccacgtgtgaggggcccgcggagccatttgattggagaaaagctgcaaaccctgaccaatcggaaggagccacgcttcgggcatcggtcaccgcacctggacagctccgattggtggacttccgccccccctcacgaatcctcattgggtgccgtgggtgcgtggtgcggcgcgattggtgggttcatgtttcccgtcccccgcccgcgggaagtgggggtgaaaagcggcccgacctgcttgcggtgtagtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcggtgagtgattctggaggagcagacgtcccccctccacacacgcggccgcttctcgaaggtcctgggggcgttgaacgtgggaggggggatcccggggcctgcggtgggccaagggacgtcaccattcctcgaaagagggcaagggaattacgtttattctcttcttcctctggaaataaaaaaagagagcaacatcatctaactgccctacagatctaatagtatctcgcccggaggtctcagcgacctcggggtggggcctctctgaggctctggctcccccgggagctgtgcgagtccctcccccctccccgcccggaggactttttcggccaccgcaaccttcggccatcccagctttcccgtcccctaattccccagactccgactcctcgcaagcccgtgtcccttcttagatgctggcctcgggagcgtgaggcctggggccagcggaatggcagt

SEQ ID NO: 11462 - DNA, 1859 bp, Homo sapiens
gttttgctggagttcggttcttaacatttctcccccttctcatgcctctgggctcaatttcagttcccctcgccagaggttgcataaatcctatttgcattctgacctgtgctaacgaaggccgaagttttggcttgatcagttgggaggccttggctcggcctgcgcgcaacacgtgtgggtgtagaagaggcctggtatcagtctgcttaacgttatttataaatgatcggagacacactgtttagaagtggtgactgcctccgtatttcaggatctactggagacttcagcatctgaacttaaatagatgttctgtcttggctttacctttggtatttaaaccagggaatgcactctttcatccccacctcccttagttaccaactgaattttgcaacccctacccttccctatttgatcatcctccttggagaagtgtgatgttgaagagtttgcccgtgttaaatcttcagggtcggtcagagctgacgatgaagttgatgtggatggtacagtagaagaggatctgggtaaaagtagagaaggatcaaggacggatgatgaagtagtacagaggtttgtgttcatttgaacttacgtatacagataagccgtgtgaaccttgtgagttacggtcacttcttatgtatctcttctccaaaggtccagataaagtctaacaccctgtatttaaatacccggtgagttgtgtgcatacatacctcctaacttgtccctaggagtgatgaaaactgagtgaattcctttgaaaactatattgcagaatactagcaccataaactttgtaagactttatagaagatactttcagttggatttgtattcattaactgtgtacaccgagtaagtttaaaaatgggatttctgtcagttgaacaatattttaaaatttggcctcttgggacttattgacagttttgaagtcctcactgtggagcataaatgagtatgactttgctttttagtagaggaaagttgggatttttttttttctggcaattttaagaaccgagtatttccagtgtaatgttaaaggtagcctactgctgtgctaacataatgagacggtatatcagttatattttataaaggtttccattttaacccccaagacaatattcagaggcccctgtgctttcatcataattcctctagttttgaagggaactatgccatgcaatatttgcttacctaactgatttccttagagaggaagaagctattcagttggatggattaaatgcatcacaaataagagaacttagagagaagtcggaaaagtttgccttccaagccgaagttaacagaatgatgaaacttatcatcaattcattgtataaaaataaagaggtaagcaacatgtggttagaatattttatctctgtatggtggcatacttgtttacttaaatttgcttaatttactgcaaaagtaatgtagtatccaagtaagtaggtaacaacctttaaatacctaatatgtccaagaattgctaccagatatctgggaagaaagggagtgtcagacattttccttttcctttacctctaaataggttcacggcctgataatagttgtgagtctaagggcagtcacataaactaaacttcttgcattgcatacctgaagatcactgttaggtgaataagagtgcttttataaggtacagagaagaaataaatgggtttggcataaaatcgaatatcttaatgcatcttgaggatagtctaagtgtattccctctggcttccatttagattttcctgagagaactgatttcaaatgcttctgatgctttagataagataaggctaatatcactgactgatgaaaat

SEQ ID NO: 11463 - DNA, 1175 bp, Homo sapiens
catttaggccagtctgcccatttgatattaatactttctcaaatacataaattactttaagatgtacactttcagaaaaggccataaaaaactatgtggaggaaaatatctcagtttagttttctgtattggaattgatgggacccaaagctggttagttcctcaatatttgtttggcataatgtaaatattaaatacaactatctggttcttgtcttgcatttagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacgtgagtatgaccaattccttataagaattaatagtcatggtgaggatcttgactctccagttctattctctgagcaaatgacttattctgggccttaattttcctgccttataaaatgaggaaacagaactgttgtcacttgaagaaatgtttgaggacctgcaaagggccaggcacaaaggtttgtgattgctgttgtacatggagggtataaagtaggaaatagcagcagcttccccaagggagaaggcttcttgggtacccacagaggaggcactgcttggtcagtttcccaggttagaagagtaatttgtctgtggagcatcctgaataaaggcatggaggcatagcatgctcactagatgaacagagttcttttcggtggcagttatggatagaatgtgatgaacttttatttatttatttattttgagacggagtctcactcttgttgcccaggctggagtgcaatggcacaatcttggctcaccacaacctccgcttcctgggttcaagcaattctcctgcctcagcctcccaagtagctgggattacaggcatgtgccaccacgcccagctaattttgtatttttagtagagatggggtgtctccatgt

SEQ ID NO: 11464 - DNA, 1036 bp, Homo sapiens
attctcaaggtggtgtggaggatgtgaggagtggacaaggggagactctttgggggaaatattcctcttgaaaatattcaagatgagtggtagcaaccagggctggggctggcttgtagagataaagggcttaaagaaagttcatgaaagttgtgaaagctgtggaataaaatacgtcatttaaggatagttacaagtttttaaatttgaattaagatccctcttaagccagtaactgttgtttgtatgggtgagacagagccagtgccctacagtagctctcgttgcttatagcactgtgacgtagacagggcagctttttgcctttttaaaattttaccatcttggagatgaggaaattctatttcagaggtcagttggcttgccaactcctgctaagtgagtaacagaatgtgcccacagcttcaatttttttttcttaattcagttttaagttttcttaacattaagggaaagaagcacatacttatcattgtgaccaactttcttcatcctagaaagtaacatttcctgtttttactgcagcagatgttcttttaatgaagactaattagatgactgcattttagtacttttttaacttgtgttcccaatttaccttcccctgccttcgtcactaacattgatgtctccaggtttcatttggaggcatcactaagagttatgccccagtgccctctctttttaagcactgggctagatgttggagaaggatagggcaatcattcccaaggaaagatagaaagtgatgtcccaagagatgttaatgtcaggttgctaagaagcaggtgaaattatctggatataagctccatgaaggcaaacattttgttggaagctccattcccaaagcttaacacttaattggcagccatttgtatgaataagtgaggttaaacaggacagttccatgcagggaacgatggctgctaacacctatccaggacctagtttccatgaccatgcatatctttttaaaaatttcctttgcccacttcttaaatgttaacataca

SEQ ID NO: 11465 - DNA, 1860 bp, Homo sapiens
atagtagaaatgttctatatctgcacttttccattttggcgatcaccagccacatgtgactgttgagtacttggaatgtggcagcataactggaactgaactgtacattttatttaaataagtcacatgtgcccagtggctgccattttggatagtgcagatataaatataaaccagattaattttctagcttttttaaggaaaatgttttcattaattaggaatagttatctacaataatcattaggtttctggaataacagtaagagctatgagagtgcatgattccatttctctccagaatatttcagtgctttctcaccttgaaaaatgaaaacaatctattcagacggttgggaatattttaattttctacttaaaactaaggttattctccacttgaggtaatgtagaggagattcttctctttactgtatctacatgtgttacattttagctcacaaacccttgttggtgatggagagttaacatgaataattaggacatcttggattatactgaactgctggctattaccatggtatttaaatgaatttataatcagatcttctaaatgttaggtgtctctaaacatcgaatttttcttgcagccttgtcttaaaagaagaagcatctgattaccttgaattggatacaattaaaaatctcgtcaaaaaatattcacagttcataaactttcctatttatgtatggagcagcaaggtaaatctatattgattaaaaacttatatgtattaccttggcacgtatttaaatattcaacactaaaagaatgaaggcaggccggcgcggtggctcatgcttgtaatccccgcactttgggaggccgagacaggtggatcacctgaggtcaggagttcgagaccagcctggccaacatggcgaaaccctgtctctactaaaaatacaaaaatgttagctgggtgtgtggtagcacacgcctgtaatcccagctactcgggaggctgaagcaggagaattgcttgaacccgggagacggaggttgcagtgagccaagatcgccccactgcactccagcctaggtgacaaagcaagactctgtctcaaaaaaaaaaaaaaagaatgaaggcaaaatgtggtctattagttaaggatactctcagggttttcttacaaaaacctattttttgacctgtaatgttatatcatattctgtagacaaaatcagaattgttaaacaaatgagtttaaccataattctcttatttcaacagactgaaactgttgaggagcccatggaggaagaagaagcagccaaagaagagaaagaagaatctgatgatgaagctgcagtagaggaagaagaagaagaaaagaaaccaaagactaaaaaagtaagtctggtttatctccctgcataagatattgtttaacatgtataggcaaaaccaggaaaacctaagtatgcactggctgatttgaagtcagcttcagttcaggtgctaagtccatggagccagcttttaaaataaggcctttgtttgtatgttgaatacattgtcctgtagaaagttttaagtatcaaacccaggtcatttttatgaagagttttctaacttttatatattgcctaggactggtggcttatatgtttggaattttaaaatcttaaaaagccttctgagtcctcttttgtctttttatcatgcagagattaaccataaaaatggttctctggcttgcttaggtagcagactaagaagtattgatcatggtggttgagaaatatttttgtaaaatgttggatttctttaagtcatgaaatgggaatatataatatgtatttccttctaacctcaaaacaaatattttcaagaa

SEQ ID NO: 11466 - DNA, 1062 bp, Homo sapiens
atactttgcttttgatacagttggcagaaaccttactagataacaggtatcctttggtgccctttttttttttttctttaatttggagacagagtctctgccacccaggctggagtgtggtagcacgatcatagctcccttcatccttgaactcctaggcttaagcagtcctttcacctcagcctcccaagtagctaggaccacagacacacgccaccatgactggctaagttttaaaaattttttgtatagttggaggtcttgctatgttgcctggactggtcttgaactcctaggctcaaacagttctcctaccctaacctcccaaagtgctaggattacaggcgtgagccaccacaccagtcctctgggtctttacatagtcttttgaaatctactgaagccatggttactgctaggataaccttggtgagtgctgagagagactaatcaaatactataataacttcaggttgaaaaaactgtctgggactgggaacttatgaatgatatcaaaccaatatggcagagaccatcaaaagaagtagaagaagatgaatacaaagctttctacaaatcattttcaaaggtaaatatttataattccctagtttctggttattaatgaatagacaaaatatcaccctcttagtttaattgtatatggtatgtgaccatgaatatgagatggtccattcccattttttcccagtgagaaaattcaaaaaaagacctttaggccaactataatatgtctacttctggtttattgacctagtcacaattaaaatcacatttatgaacctttgagattgacacctcagtagagatggtctttgagagtaattggtttccagaacacaccatttttacttaagttgaattattatactcatcactacttcaaaattgcagcagttattaaaattagtcctagctcttagtgaatagtgaaactacaaaatcaagaatgtttgaaacagttttatggctgtttaaacacaattggtttcctttttattcctgtgtattttgtaatatgtgatttttttaaaaaaatta

SEQ ID NO: 11467 - DNA, 1866 bp, Homo sapiens
cctaagaatctgattctttttctcccaacatttaataatgaagtttcaaacatctagaaaaaaattaaagaattgtacaggtccaggattaacattttgtcatctagacacatagccacctttttatcaagcctttcattaaacctttcccctccaatacttccataattagaagactctttagtttttgaatttaaaagtatttgaaagtagcatatttgttcacttcatttagatgctagagagagagtatcactgagtcctaaggttagaatataaacattaaggcaatcttgtggctatttgcacggacagctgaatttcagcccaatctgaatgaattggagtgcttcaccatttcctgcccctcaataaatggcaataacgatatcgtctttgtgtttttcacactcctgcctgggtaccttacattctcaaaagttggagattaacttctctaatcagttattctttcattgtgtttaggtgattaggaagaagcttgttcgtaaaacgctggacatgatcaagaagattgctgatgataaatacaatgatactttttggaaagaatttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggtgagatgaactcataagtgttgtcagccattctggaaggtagctagggatttatagccaactcttgagggggagaaaaggaaaacttaattgtgtaactggagtagttataaggcctggtcagtcactgacaggaaggtcatttatattctctgaacctcttaattcttcacctgtaaaatggagtttttaataatgtataaacatagcagctgctaggataaacaaatacaccagggccagacttggaaaactttgtgacttcttaattttgtaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaaagtgagaaaactaaggagagtcgtgaagcagttgagaaagaatttgagcctctgctgaattggatgaaagataaagcccttaaggacaaggtactgtggaaattacaaattgtggaaatattagtatcagcatttaagagaaagttattttgtgaacaaattaagctgcagctggttactttgtaaccattagaatggtaaaaatttaattaatgtaattaaattattgggagaaagcttaaaactttcgacaatactgctttgttaataacttgttacaaattaaattttatgtttttaaaaggtggtatttaaacttctgactagaaaattcagattatcaagtaagtgcccctacaaattctcctaaaccttaagaaaagctatttttatgacctgcttctgtgtttatgatcttaagtgataaagtcttagacagttgaaagacaattgctcaatgaccttacctgttgatattaatttatatgacttgatttctttccctaagattgaaaaggctgtggtgtctcagcgcctgacagaatctccgtgtgctttggtggccagccagtacggatggtctggcaacatggagagaatcatgaaagcacaagcgtaccaaacgggcaaggacatctctacaaagtaagcatcctcgggaaagtccctgccagggc

SEQ ID NO: 11468 - DNA, 1558 bp, Homo sapiens
cacatcccaagaatacggtattttctatctgagtttggttgctgaacctgcacatacggagggcggactgtatttattggaaaaaaaatagcatataagttcaaacctgtggtgttcaagtgtcaatagtacattttgattttttttttttaccaagagttgttctgtgtaattatgaaagaataagggaaacgtatgaaccctaaaattggatatgttttgttaatgttcatttttatctcttaacagttactatgcgagtcagaagaaaacatttgaaattaatcccagacacccgctgatcagagacatgcttcgacgaattaaggtagtattaaagcagtcctcttgcttgtcttttaatttgagtactttgtatcttttaatattaatctagtgcatcttcttgcatttcaggaagatgaagatgataaaacagttttggatcttgctgtggttttgtttgaaacagcaacgcttcggtcagggtatcttttaccagacactaaagcatatggagatagaatagaaagaatgcttcgcctcagtttgaacattgaccctgatgcaaaggtttgtatccccaaccttcccgcaaaggctggctggctttctttgtttctgttctttcagaataggcctctcatgattgagggatgtagctttgcgacatttgcctaatttctaccttttgaaagaattttattgaatgtttgaatccctgtagtgtcaggcactgcactagaaactaagtcctccttttacgtcctctttcctttttgcctgcctccttttgttagcttggctgttcattctagttaagaggatttagtctgtggttctgaataaacagaagtgacattaattatgattttatacatataaatgagcaaagtggaaataaatccaaggcattaatgggcccataaatgttgtgtttaggtggaagaagagcccgaagaagaacctgaagagacagcagaagacacaacagaagacacagagcaagacgaagatgaagaaatggatgtgggaacagatgaagaagaagaaacagcaaaggtatggcaaatcaagaatgtgacttgcattttcagttctggcaaagttaggacagagttttagttctggcaaagttaagactgtgtaacttacagaagtcagactgagcatttaaattgtttatttcatgcacaaacctgtgagctaggttttttttctgctaacttttaataccttctgggttttttttatttatttacaggaatctacagctgaaaaagatgaattgtaaattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgtaaaatcttgtcatgtgtataaaaataaaaaagatcccaaata

SEQ ID NO: 11469 - DNA, 1074 bp, Homo sapiens
tcgttgatgggaaactcagtgtgaatcaacagtataatgtgggtgccagtatagctagtgtcatgggttctgcagtttgtctccaaaatgagcaagttggtagccctgctcattttcgggctgatgaggctttatctggagttttgtttgattccgagcaccaaaaaatgaagaaatttgaaatcatactacatgaggaattatactatttgaggaatactgtatgaggactggcttattctaaatctttatatttacagtttctagtagactgtacatatggtgaatacacagacctccatctagcaataccaaatggaataatagttatggtgctatcgcatcataatttacataaccagacccctttagttgagcatttggattatttagccttgttcattattttgtaagtattcagtatggtatatgctttttttaagtgaagataataaaatgtatttagaaaatagcaacttaggctgggtgcagtggctcacacctgtaatcccagcactttgggaggccaaggtgggaggatcacttgagaccagaagttcaagactagcctgggcaacatagtgaagccccatctctacaaaaaatttaaaatttagccaggcatagatgcatgtacctgtagtcccagctgctcaggagactgaggtgagaggattgtctgagcccaggtgtgtgtggttactgtgagctatgatagcaccactgcactccagcctgggtggcagccagaccctgtctcttaaaaaagaaaaaagcaacttaaatccctaaaatagtgtaaaataattgaagataaaagaagttggagtcattaattttagagaaaaccttaaaaatttagttttttgaaatacagcaaatctagctaggcatggtggtgtgtgcctgtagtcctagctactcaggaggctgaggcaggaggatcacttgagcccaggagttggaggctgcagccaactatgatcatgccactgcactccagcatgggtgacagagtgagaccccatctcttaaaaaaaaaataattaaaaaaataaaaaaatagcaaatctg

SEQ ID NO: 11470 - DNA, 1031 bp, Homo sapiens
cagtttgcattttcatgaagtgctcaaaatgggacatgtgaaattctgagagtagtagtaagaaacatgggagagtggtaggtagattgccttcctgaccatgtgacagagtaaaaacacgtttcatacatttttttttttttttgagacggagtttcgctcttgttgtccaggctggagtgcaatggcatcatctcggctcaccacaacctccacctcctgggttcaagcgattctcctacctcagcatcctgaactagctgggattacaggcatgcgccaccacacccagctaattttgtgtttttagtagagacagggtttctgcatgttggtcgggctggtcttgaactcctgacctcaggtgatccgcccgccttgacctcccaaagcgccgagattacaggcgtgagccactgcacccagccacatctcatgcattcttttgctcgctcatttattgtcaccatatgcctttgtttctatatattcaagctaaatcaaggtgctattagaatctcgggaagctgccgctgaccacagtcagaacttgcagtttctttagttagaattgccataggaccactgctcaagacttccagatctaacctagccatatccaactcatcattagaatatttaaatcatgaatgttgaacaaccaatattttaacaatttattgcatagagctactaataatattaaataaaactatggaaaaaaaggacattttactttgtgccaggtatgcttctaagcatagttctacatcttaacttctagtccctgtctacatattttcccttatgtgtagccttagttatactattttgtattcttttctgttttaaaatatatataaactctttcctgttcttttacataagataaataaacttaattttttagctgcatagtattttctcatgttaatgtattgtagtttactaagtcataactttatttttatttaatttgtgaacaataaaagaaataaaactcttatgatacaggttaatctctttctcac

SEQ ID NO: 11471 - DNA, 1087 bp, Homo sapiens
tgatcatgccactgcattccagcctgggcgatagagtaagacccagtctctactttaaaaaaagcaaatatttctaaatggcataaactaactttgtttttcttttctggcagttgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagaaaaagtagggtttttgtatactagcttttgtatttgaattaattatcattccagctttttatatactatatttcatttatgaagaaattgattttcttttgggagtcacttttaatctgtaattttaaaatacaagtctgaatatttatagttgattcttaactgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgtttgtgagttgctcagtagtaaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttcta

SEQ ID NO: 11472 - DNA, 1044 bp, Homo sapiens
agtctgaattttaatttctaatatggtaaatattgatagatataacccacatgaacaacagctctttgaggccgtcaatagtttttaaggatagaaagaggttctgagaccaaaactgagaactgctgctctaaggagtgggttttacttggtaattgttttctaaaacatttgtaccaacttatactcccactggcagtggttgagagttcccatggcttcacatcttggctaacacttggtcttgactatctttgtatgtgccaactggatggctattatgtggtttcttagtgtgggtttaatttgcatttccctgattactaatgaaattgagtgtctcttcatatatgggtccatcatgattcctcttctgtgaaatattcctgtcttttgcccatttttctattaggttgtctgtctttttttcattgattcatatgatggataccaatccttggtcagttaaatatattgcatatatcttctctcagtttgtgtattgtctttgtaattgtaaataatctgttgatccacttggagaaaactgacatcttttcagtaatgagtctttccagccaaaaccattgtgtagctttccatttattaggtcttctttcatgtctcaatgaactttaaaaatgttctccataaaggcctttacatcttgtattagatttcatcctagtggttttatagtttttaatgctgtaaactgaatttttatctttttaaaatttgtttttatcttaaaatttttctcattatttttattgactttgttaatttcattcaaaatgcataacaatatttctatataatcagcaataaccagaatggaaagtataattttaaaaattcagtttaattaaattcagtttacctgttatggatggtaactgaattttactgaattactgaatttttaaaattatactttccattctgattgttgctgatttttaaaattcagtttaattaaatttagtttacctgtttctatctggtaacagataaaattatacctgttaaaattatactttc

SEQ ID NO: 11473 - DNA, 1026 bp, Homo sapiens
ccaccgcgcccgactaatttttgtatttttagtagagacagggtttcaccatcttggccaggctggtcttgaactcctgacctcatgatccacccgcctcggcctcccaaataagcagctatacttttgaatgttggcgtgatttatgtctaatgaataggcctcatgtcagtgtaactgtggaatctgtatgttccactgagttcacccctttgtgaaattttaccattagtgcctagtttcatctgtagcgttgtgtattgcttcaggattctttttaagaatgcaccaggtaggcagagtgttcttaattttgctccacggtttcaaatgtcaaggaaacgttggaagttggattttggcattcagtatagatgcagagttgaaagcaagatcaaactgggaggtgttttgtgaaagttgagataaacgtgtattaagcttcttttttgaagcttttctgaattcgggatttaccgggaaagtaggacgtttaattttagcggagtagtgcaatgatttaaccctgactagaactctgacgtttacagctagccttgaggccatgttttcagccagtgtgcggatttgccggggtcagactccaagcttgattgtgagttctagcctttgtcagaaatgcagcaagtcatgctaacttgcaagggagtcaacagagggcacgcggtgcctgcggggccgggacggaagccccgcccccggcgcagttcccgcctgttagcgggggagaagcaccttacacgctccgctctgcttttgtgccacacagaggacggtcgggccctggaaggaacgctctcggaattggccgcggaaaccgatctgcccgttgtgtttgtgaaacagagaaagataggcggccatggtccaaccttgaaggtaggagagagtaacgtatctttttaaacgggggatgagctcgttgagctcagcgtggtcacagcctgccttttaaagccagcgtggatgtgaccctccaaacgggacgcagcgctgggaaatgac

SEQ ID NO: 11474 - DNA, 1017 bp, Homo sapiens
ctcgggaaagagctaggaatctacccccgcccccccgccttttttttttgagatggagttctgctcttgttgcctgggctggagtgcagtggcatgaactcagctcactgcaacctccacctcctgggttcaagtggtgtggttctcctgcctcagcctctcaagtagctgggattataggcatgcaccaccatgcctggctaattttgtatttttttagtagagatgtggttttgccatgttggtcgggctggtctcgatctcctgaccacaggtgatccacccacctcggcctcccaaagtgctgggattacagtgtgagccaccacgcccggcttgccttattgtttttgttttgttttaaataagctccctccaataatttttaggataaatgtcaagtttgagacgctttaatattattgtacatagggtagtttgatcaagatcatttgatgagataattagaattgcggaaaacaaaggactagtctttaatacccaaaacatatttgttagaaaacagcaaataggaacccaatgggggaggaacactttttgttgaacactttaacaatgaatagaaaaatagggaaccaagctgtttgcagccagggcttttgtatgtccatgtataaagttggaactagggacctccaagatggttaagaactatgaatagagttcctactgctcaaagatgtggctttcataaacatcttggtttttaaagcaaagttccagtattcttatagggaacctcttttgtatgtaaatcagcatctccctcaggattccagggttttgaaatcacttgtagagaggcctattggtggtactgagaggagaagcagagtgagtgaaaaagtatttactggaataataccaagtgtcagacatagttaagactttagtagtttgaggtaatcctgggagataagactaaaactgacaactcagggcttaaataatttcttcagggcaatattaggagagatgacaggcaccaagcaatgc

SEQ ID NO: 11475 - DNA, 1064 bp, Homo sapiens
ctaaaatatttctccctacagttttcctcctcacttctattctttatttcaacacctgtcttctcttcctaccacaacccacttttccaactgcctacccgttcagaatacaagaccaaagttttccattcctttcctcctctgttcccacgacaatcccataagtctttatttttggaaaaggaggaatcctgccaatgataactttttggcttacatatcgaggtcagagagctagtcttattctttatgcctgtggtcccaggcatatgttagagcccagcagatacctaagcaaatatgcctgttaatgattataacatttatttgttgaatacctattatgtgttagactctaaatgttgttaatacttagtgattaaatccccacaacagtcctgtgaaggaggtgatattatccaggtttacagaagagaaaataaaagccttgagaatttaaggagcatgcccagattacaagctagttaagtggcagagtcaggactagaacccaggcctgtttgcctgcaaagctcactctcatgtactcatacttctggcacttggccttatgttattgctattgagatacatgcttgtgtccttgatgagatgctgtggtgtgctcatgattcgaggtcaggcccatgcaaatcttggtattcctagcatagtgctggcatatggtaggtgttcattcattacatgcttgctgaatggaacttcattcttctgtgcctacttgtactttctttaagagaacaatgaggctgggcttctaaaaaaaaatatacattttaatatcttccatatattgaaaaaaatttctttagaggcaaggtcttgctctaacccaggctggagtgcggtggcactatcatggctcgctgcagcctcaacccccctgggctcaagcaatcctcttgcctcagccgcctgagtatctgggaatacaggcatgtaccaccacacctggccaatttttaaattttttgtaagataaggtctttacaaaaggctttttgttggcttaggcttattttttaatacctagtgtgcattca

SEQ ID NO: 11476 - DNA, 1109 bp, Homo sapiens
aaaaaaaaaacctgtctgtaaggcagtgaatatgcaacattaagactaaaaaagtcattgcaaggaagacttaggatttatgagtgagtatccatattctaaacaatttctgttattgtactcagcaaaagtagtgtctctgctgtagtagttgaggtatcagctaagggtgaaaggtgagtagaaacacgaagaaggaaaaggcattctaggcaagagaatagcaaggtcaaatgcatggaattgttagaagttaggcacgagaggaccattagatttatggaaaaactattatatttgataagctgggcaacaattgaataacttcatctattaatatcctgagaagatgtttttgtcaaactattatacattgaacacaagatcttgctatccagttgtagtttttatctactgaatttcttctctggcccctagtgtccctttgtggtctttgctagtacatagaatgtccttcacaatctacgctttttcatcatgtaacaactttgaatatttgtcccactttaattttgcatttctatctttttttttccccctcgagacagagtatcactcttgcccaggctggggtgcagtggtgcaatctcggcccactgcaacctctgcctgcggggttcaggcgattcttgtgcctcagcctcccaagtagccgggattacaggtgtgtgccatcacacccagcaaatacttgtatttttagtaggaacagagtttcgccatggtagccaggctggtctcgaacacctggccccaagtgatccacccgcctcggcctccggaaatgctgggattacaagtgtgagccaaattttgcatttcttaatagggctttaaatgccaggaaactgaccttgctgaaactaaaacatgttagtttatctggatgttcttcacttagtgtaaagccataaaggcttttttctttccgttgcataaattacaaccttatttggagattattgccaaaagtttgggtcattaagaaagtaacttgagaaggtgcagtaagcatacccataagctttcttccccttgatccctataggagcttaatttttggtagtcgtggaattttgccattaaac

SEQ ID NO: 11477 - DNA, 1045 bp, Homo sapiens
aaaacttcttcagtattctgccttagaaaccaaattagattaaactttaaaatgatttttaaaatatcaccttataggatacaggttgcattaagggctgtagactatcagtaaacctgctttttcagctacttggcaacttgcttggaaatggccactttcttttttcaggttattgctgaatctgttattgtttgagtggaattatgtgagagaagtctaaggtttccagctgattctaacaattttactactctattctgcataattttaaaatctactctcagaactatctgaatatctgttaatttttatcctggagtttaactaatcatcatggtgtgtgaagtacccaggtattaattattcgttatgctttaagctctatagcttaaaaaaaaatcatggatttttaacagcccatttccaatctgtcatgttaacctttccaactcactttaataattttattttccaggaggcagcccaatatggcaagaaggtgatggtcctggactttgtcactcccacccctcttggaactagatggggtaagcttttaagatactctagaagtgatgttgccgaagtagttttcccctggcaataatctaactggttcctaaagcctaattaaaaaaatcaaaaactaagttaaagaaaaaacagccccaaaacatatatatcttttatttgagccaagttaaaatggatcaggttaaatgctaaaaatttaggttctttggcacagagtcaagaagtaagaaccctgtctacaagctatgatttaaaggtaaatatttgagtaatctagcatatataggggcttaataactgaaaatttaaacttttcatatgtggatttgttttaaatctacctcctacattcaacaagagttggaatcagataccctactgtatagcccttgctgcttctgagtcttgatgaattatatgttcataatatttactgaacatttattatgaaccaaggcaatgacgatatagcagtgaactcggcatattcaaagttcatgcccttgtg

SEQ ID NO: 11478 - DNA, 1030 bp, Homo sapiens
tgagccaccacgcccagccaatatacaccaaattttatatgcagtttaagacccactgcactctaatcatccccagcatagcaacccctttatcagttacctctgcatagattcaatggcaagtgcagatgctgcttgaattacaatgggggactacatcctgataaaatcctttgtaagttgaaaacaagtcaaaaatgcatttaatacacctaacctcccgaacatcatagcttagcctggtctaccttaaacatgctccgaaaacttacattaacctacagttgggcaaaatcatctaacacaaagcctattttataataaagtgttgaatatctcatataatttactgaatactgaactgaaagtgaaacacagtatgggtgtatgggtatcaacataaagagaaaaatcgtaagtcgggtcgtctgtatagggttgtgtacatagtaagatttcaatttctggcatctttatcagcagtcagttaattttgtatctttgaagtatacggaaattgtggaaatctgcccctctttttgttttgttttaggatgatgttaccgtgtttggtatgtaagggtctctgaacttatggatgttgtaagagttaggaataaactttattactgaccacattaagcaaatataatacaatatttcttagagttgtaataattgttgactttgttctttgaatgtttgtaaggcttggaaagcaggttataaactgatttctcaatgttgttgtaggtctcggaggaacatgtgtgaatgtgggttgcatacctaaaaaactgatgcatcaagcagctttgttaggacaagccctgcaagactctcgaaattatggatggaaagtcgaggagacaggtatgagagggaaaagctactcttctgtttgtgcttttgggggtttgagctgcaatttttgtgatgcgtcgtccattttcatgaagatagcaaatagcctagttgtttttattgtttacatttttgatggatataatcactggagttatcctttgtc

SEQ ID NO: 11479 - DNA, 1038 bp, Homo sapiens
gattttgctatcatatcatcctatggggccttgtgtggaggtatggtaaagtgtaagtatgctggaccagaccgcctggttttgaggcttggctccagcacttactaacattgtgactttgagtaagtctgttaactactcagtcttaatttatcctttttactatattattgtcctcattatgaggatgaaatgagacaatgtagtgaatggcctttgttaactatgaagtttacaattctgaggaatgattacttaataaggttttcatattggttcctttgtaggcaacaaataataaaggcaaagaaaaaatttattcagcagagagatttctcattgccactggtgaaagaccacgttacttgggcatccctggtgacaaagaatactgcatcagcaggtaaaggaaaaaagcagggtggaaaagaaaaacccattgtggatattgctttcgcatttttcttcaaacccactgcgtcaatttcttgggcttcagacagatttctttgccacattgtgccctctctgggggcaggggtttgggagaaagagaaaaaggaaaaatgattttaaaggagaacattttaaatattgaaaacttcaaacattggtcatcttgctacacagagtatcactaacatactagtatagatttacatttgtattcgaaatttatttatgcatgtatgagtatgaaagtatgtaataaaaccaaatggatattcacaaacattttgtaaaataggtatgatacatatatacatttagattttgtaaaatgaggatcatgtattaccctttaacacttgcagagtggctgctaaaagaattagaggctgtcaggccatttagatttatcagaatctagaccctactcaatgctgtttgaatggttgcagtgtcagtgtagaaggacctcctgaaacaagtcaagcaaggagatgttttgctgtgtggtttatttttgcccgtcaaatggtaacactgctgacattgttcaggagctttcaattatgaagtcattaagacagagtg

SEQ ID NO: 11480 - DNA, 1061 bp, Homo sapiens
ctatactatagtgattgactcgaactccattcagtgaaaaaaatggaagaattagctatttgtatccatatgggatacaaaaaagcagggtaacaaaagaatctacatcatcttgccatttgcaggtaaagcttcttaaaaaaacaagagaaatgcaggaagaaatgcctaggaatgataagaccaactcggtggagggaaaggaggaaaaggccaatggggtggcacacacagggctaactgggcactttatacccttctttatatccaaaatattttatggtgaatttcttttagagggttgacaagcacctgtgggtacctgatctgttttaatcatcctcatgctaacaaaattcttcagtagatataacctaaattttttttctctttcatcttggttttaaaatgtcttcccccttttattctctggagaaatagaagatatccttgatcatactacttctctgttttattcattttggtagtcgcctaagatggttttaatgcatatggcattatctgaactgttccctgttacctcatttgctcaggcatctgaagatgttgtgctttctcttcccctgcaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattag

SEQ ID NO: 11481 - DNA, 1034 bp, Homo sapiens
gagaaggtgtgcctcctagtgtccatccctgtgaacagcaggcttccactttggtgttcagttttactggaacacactttgtttatgggcttgagtgaataaggtcacatagctaaaaaattttatagggcttgcaaatcaagggggatgggcaaacagtttagcagataattctgggaaaacttgtttgctatgtgtgtagctataaaactggatccctacctaacactggatgacaaagacagacttgaaacatattgaagacctaaatgtatgtggtacagccgtaaaatttatatggtacatataggaaaatacctctgtgacctagaggtgggtgagggtttcttaaaccatggtctcaagcacaaaccaaaaggcaaagcactgatgtgccagttgccccagaagttctgattcacgaagaccatcatggaaaaagtttaatagagagatgaccatgtgggaagggactgttctgtgtctgaaactgataaggaatttagacccaggtgacttcaaggaactctggcgaatcaacaagaagacaggaaccacaaaagaaaatgggcaaaggacattgaactgcttattcaccaaagataaaacccaaaagtcaaccaggataggagagctgtacaaacttgcgagtcattaagaaaggcaaattaaaataatgagagattgctttacagccatcagatttgcacacatcagaaagctggttaatgccaaatgatgagctaggcgaggggaccgtcaggccctgctggttggagaggagactgtttgctgctcagtgtttagacctcaagcactgtgtagcccatgacccagcaatacggctcttggctctcaaccccagagaaattctgtgtatccccaaggtaacgtgcacgaagacacccgttatggcaccgtgtgcagtgtggggaaattgaactccatcctgatgaccctcactggggaatagatgagtaggctgcggcagatgcaagatgatggagcggtacttggggagtactcatgacatg

SEQ ID NO: 11482 - DNA, 1055 bp, Homo sapiens
taaaaatacaaaaaaaattagccgggcgtggtggtgcacgcctgtaatcccagctacttgggaggctgaggcagcagaatcacttgaaccagggaggcggaggttgcagtgagctgagattgtgccattgcattccatcctgggcaacaagagttaaacaccatctcaaaaaaaaaaaaaaaaaagaaaaagaaaagaaaaaaagaaaatttaggaggtatagaagaaaaacaatcattattccaccaccaagaggcaactggtactttaaaaatatattatagaatatatttatatatatttatatattctgtatttttctcaactatgcaaaatgcatatacatagttgagataacatcatgcattttgtatcctgtttgataataagtattttagacaaatacatcattgtcacaactagttattaaagttaaagacaaagtttaaccataactgtttaaatgtatagacttgcatgtgtctccacctcccaccctacccctttgcaggatgtcagtctggtattattttttttgctgtggttgcacaaatttaatgttacgttacagaatctttttgcttatacatggaatagtttggagtcttaccaatttgtaggggctgttcttatgttatacacctgaaacttccattgaaaaggtgtcaagagggtctcaaatatgagactgttatgaattctgaaaacagcattgaatcactgaaggatctcatgtaccccataaatatatacaactactatgtacctataaaaattaacaagtaaaaaaataactgaaggagaagacatttttagcatggggtctctccttgatcatttaaatgtttgcacctcgatggagcattttcattgctgtgctcagatgagacagatgtaggtgatctcctttgattgttacagtcctcattttcattgccttccaaaataaaaaggggtgatcaggcaccacagaaagggtggtttgggggtttccgtggggtgaggggtgagggaatccatccttcagcagaggtatctgctgtcagtatttgtct

SEQ ID NO: 11483 - DNA, 1035 bp, Homo sapiens
ttaagcagaaagatatttactagagggaattttgtgcttatagaggcataagggggctggaggaatggggctccaggaatgtctcccagctaatggtagtagtttatataataattaataaacaaacgtatgttggcatggctgttcaaaaaaaacaaaaaacaaaaaacaaaactgactcactaggggtgctacaccctctgatactgtgtctggaactattgagttcaagaacaaattgatggcaaagccggagagtggaccctataatgctgttgcaaaaaaccctcgtgaccccatctccatgcttgccagcggccaaacagccccaaaggcaagaagatggcctctctgccccacatctgctttctaaatctcaagtgagtgcttctatttgggagagccaaattcacatctagaaccttagcttcaaagaagcctgggaaatacagcttttcaattaccagcctctgcaggctagaaagctttctagaaggagggtagaatgaacgatgagcaaataatcacaatactcaccacaccctattggtaaaacatatttgagcagccatccctcaatatattttgtttataaataatttctgcatattactaccattatctacatatctaggataggatcctttctgactagtgactgcaaacccctatgtcgttatctgttggataattccgttggctgactctttatcaattctgattctttcatccttttgaccttgtaatgttgtccacaaagatacaatggagagctagtactcaagagggaggaatgccattttcttgtgtgcctggattgtgacaattatcttcaagttgtggtttcttggctgggatctctttaggcctcagttctattttgtgaggaataggatagttaaaagtagataatataatctgtaaatttacttatgattcagttgtaaatggttattcattgaaatatgctgagaatggtggaattattgaggtggtcactccagttcattttgtggttgaggatacctgcctgag

SEQ ID NO: 11484 - DNA, 1040 bp, Homo sapiens
tcatccttaggattcaaattcaatgaaaagatacattttcactgctactcactaggtacccattacaggtgttaaatcatttagtcttctccacagcctggcgaggagaactggcctcatcctcatttttaggtgggactcagagaagttttgtaattaacttaaagtaacccagctagtagttggtggagctcggatgccctggctcatctgactcaaagtgctctaataagaacttctctctgcaaagcgtgggctggcatctgcgagaaaaatttctttttgtgatttaggaggaaaaacatatggagaaaccctattgtctgaatgctgcgtctctccctaattcatgtgttgaaacctaatccccaatatgaggctcttagaaggtggtggtctttgggacgtgattaggtcatgagggagccctcatgaatgggattagtgcccttataaaagagaccccagagagaccctcacctcttgtgccatgggaggacacagtgagaaccaggaagtgggacctttccagacaccaaatctgccagtgcctcgatcttggactttccagcctccagaactgtttgagcaataaatttctgtagtttacaagccacctagtgcaggatattttgatatagcagtccaaatggactaagacaaggaacgatccttgagctgaaaggaaaatgaacaattgctctgcagttggaaagacacaatgatagctctaggaggcattgtgcactcaattgtcctcaactgattggagaaaggaattcagttatgaggaagttcatttagtgagaaggtctaagagctcttcacatgtctcctatgactctaagaagggtgatggctggcagcaccctgagaatgaagcctctccagggagctgtgtgttgatggggctctcaagtttgggaagcaacccccctaacaggaagtgggggtgggagacagggagagaaaaaccaaagcaaacccataactcaaactgtatctttcttcttgcaaaagtgaaagacattgctgatcgt

SEQ ID NO: 11485 - DNA, 1062 bp, Homo sapiens
catccccccacttaagactttaatgtcttaaaaatgtccccacttcttctgtcttttagtggcttcacgtctgaagtctctgcttactttttggaacagatggtggttctcatagacttggcccggagtcagcatgggagaaagtcatcctgtctgaaacagtgctgattcgggtcaccacagattcaaggtttctaaccttggctctacttaagaacaacttggacatcctttcatgtagttcattgatacccacatgcctcctggtgcaatatctccaaaactggactcctgcatcttcacatgctcacccttcacaccccatccattctccacacccttcacatcccagttcctgaaggcaggtcccttggttacagtctctccccatgcatttggttgttttttgttgagatggagtcttgctctgtcgcccagactggagtgcagtgacgtgatctcagctcactgcaacctctgcttcctgggttcaagagattcttctgcctcagcctctcgagtagctgggattacaggtgccagccaccatgcccggctaatttttgtatttttagtagagacaggattttgccatgttggccaagctggtcttgaactcctgacctcaggtgatcggcctgcctcggcctctcaaagtgctgggattacaggcgtgagccaccgtgcccggcctccccatgcactttgactttttttcattgcactccatttgtccatgcagcaatccctcaggatgtgattcattcagcctgccaattttggataataagagaagagagttcagatacaaactccccaatgttacctgcatctctttggttcctgcttttggagagtaaggggtacctgagtttgttttatgtctcttcttcagtattctgctccacaagctccacgtgtacttattcctcagtacgcccccttagtgagtttgtttattgggtgagtgaaaggaacagatgagtagatgaatgacccaggtgaggcctggggtcggggaggactgtggctcttcttacctgctgttgaagctggcctggt

SEQ ID NO: 11486 - DNA, 1050 bp, Homo sapiens
aaaaacaaaaaggaaatgctcaatagatgtttgcttttgtaaagcagagtttacattttccctgttgctgttgaagcaagggtgtgcatcatatccaataactgggaaaaacaaagcaaaataaacctttttaaccttgagatgtgtcagaaataacagggtcactctgtctcattctggtcccctgaataaaggaaatcttgaccattttccataagcctggattatccaaccatcagctttatccttaacttggcaatgatgatatgattgcttcttgtggttatgatcatatatgagaaatgtggcagcagcagaggtaattatctcttgtgattatttatgtggtgtgacagtctttcttatagctggtccccctgaacctctttgcaagtaagattttttctttcttaaatgcttttctcttccttctatgtgttgctgctactgttactcctgctgtttctaccactaccacaacaaccaccactgccgcgccaccaccaccatcactaccaccactaccaccatcatcaccaccatcaccccagctcaaccagaatgactataatccttcacacccctgccaggttatcttccctatgatgactttcttaaccagcttcccccaaacaagtagtaacattttccccacccaaatccatcttgaattgtgggaaggatcctgtgggaggtcattgaaccatgggggcaggtctttcctgtgctgttcttgtgatagtgagtaagtcttatgagatctgatggttctataagggggagtttccctgcccaatctctctctttgcctgctgccatccatgtaagatgtcacttgctcctctttgccttccaccatgattgtgaggtttccccagccatgtggaactataagctcatgaaatctctttcttttgtaaattgcccagtcttgggtatgtctttatcagcagtgtgaaaagggactaagacagcattctattattttgtatcttgtacctgcttctgttttaacacagtgtatttgaagtacagtttttgagtctcctg

SEQ ID NO: 11487 - DNA, 1049 bp, Homo sapiens
ttgcagtgcaggatttctgattctgacagaaaccaaggggagaactcactttttctatttaaaaaattatcagtaataaagcactcaggtcttcgaccactcttgcaaatactgttgtttttctctagctgagtctaggaaggaatacgagtttatagtgcagtgccagtaaggttggaattttctgtgataggggagtaattgagacaggtacaaatcgtaagatcttcccgaggactggatacaggagaaagaaatgcagccccagaaagggaggtgtgcagttgcaggcagatgggccaaggagatggtctgattgccaagtggattggagcccaagtcttcaggttttcaagtgggtaattagaacaggaaggagccaaacacaggcctgctggcgccaggagccgcaagattttccgttcaggttgtgtcgtctcagagctaagatgggtgcatgcgagtacttccccggccagttaacaaatgcgagcatccagtaccgtgcccatgactgtgggtgcagggagcagagtgtaggcagatgagcaaatggggtttccatgcctgaggaacaagaagtcttaggctaagtggtgagtacctgcaaaaatgagagaatagcacaagacggcatagctgagtaatacattgcatggttttgcttccaagtgccagcatctccgagtagtgtatctgacaccagcacactctggtgtcagaatcttgggtttatattctggctactcaaactgtgtggtcctgggcaaattctttaatcttttttgggtttcaatttccatagctataaaatgagaatagttgtagtatctatctcgtgaatttattatgagaattaaattattttctctgtggattaaaaaaaaggacttttgcccctgattcttgtttttgaatacagtcttgatccccagaagtgtggcagctctcttgtacacatgatgaagagtgtgaaggggaaaagttgatatgcaaacaatggtggatgagggggtgaagctgttgggatccttgatgactgtggggtg

SEQ ID NO: 11488 - DNA, 1082 bp, Homo sapiens
gttcagtgtcctcagacatcccgctccatttctttgttcaacgctaccaccctctaccctggccagactgggttcctctctaactcaaagacacatgatgggacacacagtgctttacagggaaggacagtggaggccaggagagagaaggctgaaccaaagaaacttcctaaggctcaactgtttatacagttctctccgtctgttctccatgttctctccatcagcctctgaggagctcgaagctcctgtaaaagtccttggccctttaggtgcgctctggtaccgtctttctctatggcaccttttgtggccttcaggtaaagagccaagaaggaacaccccttttatttccccttgatttttgtgccgtttatttatttatcagtattgtctagccttttaagagcctggatgtgagtctcggctctgctactttgcagctgtgtgaccttgggcaagtgacttaacctctctgtgccttggtttctttatctgtaaaatgggataatagtatctagctcatggtattgttgtaagaatcaaaggagctaatcaaagtaaggcacttagagcatgaccaatatatattaataggaggctcacaaaaaaatctagctcttactgcaactcctactactcctattttttttttttaaaacaacttttatttttgcacccctgtactggaatagatgatcttgggcctggtttctgtaagcaacactgactgtcatcatctgtaaggataagcacttagtgactaaactgaaatctccaagtcttgcttttaaaaaagaaagacccttggctggctaggcacagtggctcacacctgtaatcccagcattttgggaggctgaggcaggtggattgcttgatcccaggagtttgagaccagcctggccaacatggtgaaacctcatgtctactaaaaatacaaaaaaatgagctgggtgtggtggcacgcacttgtagtcccagctacttaggaggctgaggtaggaggatcacctgagcctggaagttgaggctgcagtgagctgtgattgcaccaacagcattccagcctgggccatggg

SEQ ID NO: 11489 - DNA, 1076 bp, Homo sapiens
agaatgcattgacagtggctcatcagtcacaacatatgtaccacaccaatgcaagatattaatgatagggacaggaggcagggaaattctgggcagaagagggttggtccccagcgaggtccctaccctcaagctgaaaagcctaatactgtagcccaaagtgagaccttacatccctgttttcccgctcaaatgttgcctgccccgacccccatcctgtgcccataaataccccaggctcagccaacagagaggggagaagcagctggacattggagactacagttggatgtcagaagcagcttgacttcagagggacagcttgatggcatagctttagagatgagtccaatcggggaccactggactccaggggaaaattaccttcccactccttcccctttttagctccccttcctgctgaaagccactttcactggcaataaaatcccccacattggccatcttcaagtcatttgtgtgacctcattcctcctggatgccagacaagaactcaggtgccacaaatgtgaatgcaaaagggtgtctgtcacatggaccatccactgagctgttaacacttaatctgtccatggatggcaaagctaaaagggcactgtaacacttcttccggggcttcaggggtcatggacaccctcccctagatgctgccacagggtcagtacagagttcgctcttgctggcacccaaaagcgttcacccccacctcctgcacccattcacctgtgttccccctcctctgaggggtggaacagtgagtgagtggaatttgcccctgccagcacccatgtactccagttcctgcctgcaaaggggtcagggaagtatcctgcttcattaataatgggaaactgggggttaaggtatgagtgtatgtatatggaagctctatatactttccactcaatttttctgtcaacctaaaactgctcaaaaaagagaatctattaatttaattaaaaacaaaactgggtggaccctacccaccttcctaccagcaaacatgagaaggaggatggctgttccccagtgctgacgggggcactcaaccttct

SEQ ID NO: 11490 - DNA, 1028 bp, Homo sapiens
gacttaaatagcaatttattttctcacacttctggaggctgggagtctaagatcaaggtgtggtcagggttggtttcttctcaggccatgagagaaggggctgtcccaggcctgtctccttggctggtagatgcaccttcatgttcacacagcagtctccttgtgtctctgtgcaaatttccccctcttgtcatgataccagacacattagattgggaccccaccctaaggacctcattttcacttgatcacctctgtgcagacactatctccaaataagggtactgtctgaacgactgggggttagtacctcagcatgtgcattttggagagacacagttaattcatgacagcgtgtaccttacattccatggtgtttatctggagagggggaggtagccctggggaccgtaactctggcacttcctagcgccttgatgattggcttttctcctaccttctgcttccattctcctcctcccagactctctcatccaataacccccgcatctgtaccctgttcgctccataataatgataactactccttagtagttgcttcttaggtgccaagcaaagtgctaggcattttatttttattaactcatgtaatcctcatgatgacccttgaaataggctctattgccgttctcattgtataaacaagggaactgaggcacagagagatttagtaacttgcccaagggcacgctgctagtaagtggtgaagctgggatttgaacccaggcagtctggctgcagaggatactttataaaccacttctacttcacttaataggcgtaatattccacttgaagcccttcacatcttaccaagggctcccaaaacgttctctcacttgatctccatcaaaaaagagcaccattggaggggctcagaggaatgggttctaacatgtgatgtgtctggatccgtgctcaagaactgggatgatgccatggataagagcacagctctgtgttctgcatcacagactctgcattgactagctgtgtgactttgggca

SEQ ID NO: 11491 - DNA, 1050 bp, Homo sapiens
gtcagagggaacaaaagtcttagcatgcaggtcgaggggtccccatggcctccaaaaagcagaaaaacaacaaaacctggttctaactagctagaactggactcagttaggaacaaaagggttattcagctgaccagaggatgggcgaggaacagaaggggaaggtgagtggagattagcttgtcaaacagtattttcttgtgaatgctgcagatcaaggcagtcttttgtgacagcatttatattaaaagaggcccaagatatttatagcccctattggagcctagagcctaaatagcaactctgtttgatcagcctttcacaggtcatgtgatgtttctccttcagggtgtccatttgaaagtgggagaaaccactaggaatttggggggaatagagcagagagagagaggtagggaaatttggtccatttgcagattcacggaagttcaaatgtggcgcatagctgcgcacagcttcccctcctccttgggtaccatgttgccaagacgggcggttagagattcaatggcagagggctagatgattctgtttccaaggggccctgcttgccttccagccccacctcatatcaccctgtccctcagttgctgttccagcctcttggcccacattcctcaaacatgtcaaacaggttccaccaaaggacttgcatatttgctgttcccactcctggaacatacttccctgagatctttctgtggttggtgccttctcatcaagtctcagatgaaatatcacctcctttgagaggccttctccaaccttccaggcactgcttcttgcattgccttgttttattgtcttcatagcacttgtcaccatcagaagtgatcttgctcattaatttgtctggtgtctctctcatcacctctagaatttaaccttacatttaacttttattgctggatatctctattggcctatcttagggcccaatggagaaagaaaaatgttctaataacatattgtaaaggtttgcctagaaaggtatatccttccccaacatttccattcactgaaagaaaa

SEQ ID NO: 11492 - DNA, 1034 bp, Homo sapiens
aatttttagtggcgatggcatgttatagttcagcgtgttgctgggaagattaaacataatgtatttaaatcacctgtgaaggtgcctcctacagagtagctccttagtcatactgtctgctgttgtcatggtgaccatcaccatcctttgtcctggggaccatgagaggagatggacatggagcttaatgcagggtgcaatggcttctccctggtggctaccatgatgcccctcagttccccagcaaactcatcagtggccctactttaggcccatcccaatggccctgtgcaccttttagtaaaaattgtgcagattgaggttcaaagttggaggagcaggggcagatacttgggttgcactcaagtcctaggctctactgacttggctgtccaggtgactggaggatttcacggatacagctgcattctcaggactcaaagccacccacagtctggcctggaggaggcggtgactctggggctccgagtccctgtgaagtgagtggccacaggagttgagaaaaccaagaatgaactagacaggagggttgtgctatgaagcacactcagtgttgtgggtgttcagtggagggaatggttattccacttgtgtggcaggggagtgtgtggggccatgaagaattgtcaagtttggggccaggcacagtggctcacccctgcagtctcagcactttgggagactgaggctggccaatcacctgaggtcaggagtttgagaccagcctgaccaacgtagtgaaaccccgtctctactaaaaatacaaaaatcagcagggcatggtgatgcgtgcctgtaatcccagctactcggggggctgaggcaggagaattgcttgaactctggaggcggaggttgcagtgagctgagatcgcgccactgcattccagcctgggcaacagagtaagactctggaaaaaaaaagaaaagaaaagaattgtcaagtttataccagcagagattgagaggggagaatcccagatgggcccagcctaaggaacgcttgcggcaaa

SEQ ID NO: 11493 - DNA, 1052 bp, Homo sapiens
caagtgggccctaatgtctggttcccttctttgcatccatgtgtactcaacgtttagctcccactaataagtgagaacatgtggtatttttctgttcctgtgttggttgcttaggtcctgatcatctgtgttagctttctgccttgatgatctgcctaatactgtcagtggggtgttaaagtctcccactattatctagctctctttgtaggtctctgaatgcttgctttatgaatctgggtgcttctctgttgggtgcatgtatgtttaggatagttaggtcttattgaattaagccctttatcattatgtaatgcccttctttgtctttttttatttttgtaaaagtatgttttgtctgaaattaaaatagcaacccctgcctttttctttctgtttgcttggtagagttttctccatccctttactttgagcttctgagtgtcactgcatgtgaggtgggtctcttgaagatagcataccattggattttgcttctttatccaagttgccacactgtttcttttgattggggcatttagcccatttacattcaaggttagtattgatatgtgtgcatttgatcctgtcatcatattgttagctggttaccatgcagacttgtctgtgtggttgctttatagtgttactaatctacctacttaagtgtgtttttgtagcggctggtaacccagtctttcctttatatagttagcactcccttccaaaactcttgtaaggcagatctgatgttaacaaattcccttagcatttgcctgtctgaaaaggatcttatttctcctttgcttatgaagcttagtttagtcagatatgaattcttggttgaaaattattttctttaagaatgctgagggtgtggcacaccagcatggcacatgtatacatatgtaactaaccagcacattgtgcacatgtaccctaaaacttaaagtataataataaaaataaataaataaagaatgctgaatataggcccccgatctcttctggcttgtagagtttctgctgacagttctgctgttagcctgatg

SEQ ID NO: 11494 - DNA, 1122 bp, Homo sapiens
tatgtaggttaaaactttcccactgtgggccactggaattctaattttttttgtgtgtgtgtgagtttcatttttctagaaaagcaacatgccctgagtctgtagttcttatacacgaaattggctatagttccagatggaggagttctagactccatggatccagatgaactcatgattccctgtcttcttgtgacttatcataggccttctactggacccagtctctggaccctgtttggtaaaagaattgttcaagtaaatttggagagctcaaaacacaaatctgtgtagctttaatctgaaagggaaatcacacacaacctccagttgctgtgagagaggaatggttacaatagacccagcaaatacattcatttggtcactagggtgctcctgggcggttgttggaagtcgcctttggacgccacttctgacaccaaaaacttaattgttaaaacctctagacaaattaaatttaacagtttgtttgagcaaagaacaattttatgaattagcactcaaaactgaaaggttcagagtgttccactctgtggcacagagagtatgcttttataagtataaattgaacttggaagtaaactacagaaataactggattggttacagctaggcatttgccctatttgtgcatggtttgataacttgactgcctatgactggctgaagctcacctgtttctgtctggcttaaacctagctattcgttacaaaagtattctgctaagttaggttttggtttgtttattactgaggtagattgcagtttgttatataggaactacaagtaccaagggagtctcaggctaatggcctcctgcttatttaatttcacatatgtaatattggatgtattttgtttctcagagaaaccagagctagtttttaaagagttgggatatatagcatttggatgtcttcccagggtagaatgatctttattctcttctatggtagagtttagaaagcttaattttgtgcatggtgatgagtgaatttgttagcatcttttttcttcagcatggatttcagaaacatcaattttattttaaagtaaaaataaaggccaggtgcggtggctcacacctgtaatcccagcact

SEQ ID NO: 11495 - DNA, 1002 bp, Homo sapiens
attttaaaatgcattttattcctgtttacaaaaataatttaaaagtattcacttgtaaaattcaagtattccagaaataagtaacttagtgaatgaaaatacgtcgtatttctacatcatattactacatattggtagatggtgttcagatttgttcctgtacaacttctcttagtgctactaatactacttttttcttttccttttctttgccactgattttcattactgaagatgaagaaatttaaaatatatttctttctatgtctttgctattttcataatgtggtatctgatttcaaaattgaaagattagtttgtgtgtaacatcaagtgatagtaactatgataacccagccaattttttaaaaaacttatgtacttaaatagaatgaaactaaaagacatgaagattcaagtttctattgttgcatttttttatctgacagtccatgaaagggtgttttgtgtgtgtgttatttaatattcaggtgaataaaattgtcatgctcaacaccagatgtagaaatgccttaactctgccacagtgaaagatatttgtctcataatatattaataagtattttttgtggttattttttcttgaaatcagttgtcttccatgtgtattatagaacttttaaacagcttgttgtttagcctgcatttaatgaattttccccttttcccttttctgtttcaggtaccagccatcactctaactgctaatattatttggtttcctgataattttctgatccagaaaataccagcagctgccaaactgctagacagaaaaagtcttcaagccattaaaatacacagggatacttttctacaacagaaagctcaatcacttaccaagtaggttttataaacaagtataatgaaaatatttagatatcctttattttcaaagattatactaacacttaatgtatagtaccatttgaattataagattaaatgtacttgataagtaagggtcaggcaatctccagg

SEQ ID NO: 11496 - DNA, 1878 bp, Homo sapiens
tttgttgtaggtctctttcgtgtgatattaactataactgttttcttttaattaatgtctgcatggtattatcttttttgatcctttcacttgtggccttcctggctccttatagttaatgtgtgtcttccgtaagtaacgtatatttttctcctatctgataatctttgtttttttttcttcatagtactattttttctatatgtcattgttgatatatttggttttaaactaccacctgactagttgctttgtatttgtctcacttgttctgtgtcccttttcttttcctctctcgctcttttttggagtatttttaattttatttctcctcctctctattagtttaattctatattattttattgttcttttagcggtcactctagacattttaagatgtatcgtttgctcatttagctctaatgtatgttagtagttttaccactttcctgacggtataaggatcttaaacagctttagttctatttatctccctctcatcttctgtgctgttgttgtgtactttgagttcctctgtattttaaacctcacaaggcattattatcgctattgttgtttttatagtcagcgtttatttagatttactcatatttacctgttctgttgctttttattcttcctacatctcttaattttcatctttctacttggggaatacctgctagtatttcattaatacaagtctctgttgatgaattgtaatagtttttggtctgaatatgtcttcatttcaatcattttgctgtgttagaattctaggttggtggggtttttttttttcttctagcttttaaaggtgtcattttatggtcttctggcttcctttgtttttgttaagaagtcaactgtaggtttgttgcttctaaaatatgtatctttctttactttttggcttttagcagtgttcctacaatgcccctaggtgtggttttctttgtgtgtttgtgctactttggggtcagtagagcttcttgaattcatgcaatattctttaccattaactcttcgagcattatttcttttctgtttcctctgttctaattctctcttcatctgtctctaatcaattcatctactgagttttaaattttaataattttactttttagctggcttttttatagtttacagttctcttctgagatacttgattttgtgttttattttcttcaacacattcagcttattttgaagcacatgtctaataatttcattatttgggtatttgtcttatctgttgtttctcttgtttttgtacatctcttaccttttatatacccagttattttttatagagtgccacacattatatatgaaaagctgtagacgtaatttgaggatctggatattttcttcctccagaagggatttgtatttgtatttgtatttgcttttgtacacagctagtctaggacggttagcaacccaggttatatcaatctagtaggttgatcaagatgatttgaagcaggattttgatcctgtgatggttgtttaattcacccttacttttttggggggttatccttcaggatgccaactcagaacttaggtggtttatgaaaaccagctccgatgagccccaagctcctgtttttatttcccttccctgtgagatgttgttgaaaggtatgtttggcttttgtctttaaggcagatgatttaagagaaagcaaccctgaatgccaggatcacttctctgagtttctgtcttccagatcttggccttatatttccttatttatttgaatcctctttgatgccttatgaggcatttttaaaccgttttgcccatatattctagttgttctcagtgggaaggctgatctaaattatttattctatcattaacta

SEQ ID NO: 11497 - DNA, 1027 bp, Homo sapiens
aaatttcttgaagggaaatttgaattttggtttccagctgaattaaggttacagcacaatttccatttagtattcatatttataacttacttttttgttgttctggagaagctgacatttttcttgttattggcatttaattttccactcttggaagaaatattgagcctttttcattataagatagttaatgatcattctgttgccctttaaggtgtgaaatagtcacttggcaaagattgtagacatgttaagtgtgggtttttttttggggcggggggggtcacaattttttttttttaaaagatttttctttccaacttagagtcagggaaaatggagcatgtgatgcaagtatttaagtctagtcatagcaaataatattgaaaatgagtttgtttttatttaccaaaaccaaaaatggtcaataaatgtttattttaaactctgatatttgaatattatgcatatcatttttcaagtatggtttacaaaagcatatgtgcagaattctgacaatgtcaggcattggagtgtttgttacctttgtttcattttgatagtatttcttttgtgacttttctatactatgttgggttaagtgatgtagggaatgcgaactgtgtaagatggaactcttccttctgtagtagatgtcattcctttcatattgttttgggattcttcagttttggtgtgactgattactactttacattgtagagtccaaacacaatgtgactgttgttttttatactggcatcgagctgtcttcccaatttatttagatgatgtatatgaaaatgctgttgatgcagccagattacatgtaagtaaagaacaatataaagaataattctatcattttaaaagtcactgtgtaaaccgttttagtttaaaatagatcatttgatttaataaacttttaaaattgactgttttgtaaactgcatattcataaagtgtttatagtctgtagttaaattttatgttactgttaacgaagttaatttatttaatttcttcc

SEQ ID NO: 11498 - DNA, 1053 bp, Homo sapiens
tttccattccattttctggaggcagttgctaacaatgtagtgtgatggctttcagatatctttgtatataaacatgtatatttacacacatatattgcttttaaaagcagtatagtaaaaatggagtaatattatacatagcattttgcactgtgctcatcacgtcagtacatacagatctgcttcaagttgatagggatacatccatgtatatcataacttatttaaccttcttctgttgaccattatttaggtttttctaatttttcattcttacaaacagtgctgcagtaacatctttacacatctatctctggaaatctcagactttctgaaaacttccttaaggagaaatttctaggacaaggaaatgtgaacatttaaaattgtggtacatattgcctagcactccaaaaacacttcactattgatattcccactgataatttatacgaatgctgctgttagcagggtgcagtggctcatgcctgtaatccagcactttgagaggctaagataggtagatcacttgaggcaaagcatttgagaccagcgtgggcaacatggcgaaacctcatctctactaataataccaaaattagccgggcatggtggcacatgcctgaagtctcagatgctcaggaggctgagtgtattagtctattctcatgctgctatgaagaaatacctgtgactgggtaatttataaaggaaagaggtttaattgactcacagttctgcatggctggggaggcctcaggaaacttataatcatggcggaaggtacctcttcacagggtgacgggaaagaatgagtgcccagcgaagcgggaagcccttacaaccatcagatcttgtgagaactaactcactatcatgagaacagggtaggggaaactgcccccatgattcagttatctccacctggtccctctcaggacatgtggggattatgggaactataattcaagatgagatttgggtggggacaaagccaagctatatcactgaggcacaagaatcacttgaacctaggaggtggaggttgcagtg

SEQ ID NO: 11499 - DNA, 1024 bp, Homo sapiens
aagagaaacttagagaaagaagtaagtcatgtttctgggacttaaaccagggttatttagctataagtccaaatgggttttatattcttgaaagtttatattaacaccaaacagtaaaatcttattgactatattttgggaaaattctgccttgtgagattgatttattcatttatcaagcatttactaagcatctgttatgccacattttctgttaggtgctgggaataccaacccctttgctttcaggagactttaggtttactagtgggtaatacgttataagcatttcattctggagtaaagttttttcagttaattgatttgcatattagacatttctattatgttttagtacaagaacttggaggattttacctttgtaaatgttttattataaaccattcaatattaagtattgtcaaataagtacaaataagttttcttcaagtggacatttaatattaagcggcaaacttatggagcaatagttcttaaccttttttgagaatctgaggaaaactccaggatgattgttccagaactaatgcctatatgacatacgtacacaattttgtgtatgatatgctagagtccatgtgcttaaagcttgggtctatggacctcagattaagagctgtccttctagagcagtgttacttaagttttatttatacacatacccagaatttttgcatcctgttaatactgccttcactattgttacatgtttttattttttttgagagtataatttttccttagaaataacagttgttaaatcatagtccttaaaatgctagtcatttttgccctaaatacataatcactaagtgttctttggtgtgccatctaatgtcaccttgcttaccaccaggttgcagtccacaattggggaatattatccttttcattttaatccatcgttttactctttattctcttcttagaaaatataaattctttttttttttttttgagacagagtcttgctctgtcacccaggctggagtgcagtggcatg

SEQ ID NO: 11500 - DNA, 1031 bp, Homo sapiens
tgagcattttatgaaacacttggcctggacaaaaaatacacggagattgttctagattaggagaataaagagacctgataatcacatgtaatgggtgatacttaatcatatcctagataaggaaagaaacagctgtaaaggacatttgaggaataattgggggacatttgaacatggattgtatattagttaatactgtattatattcttgggtataacagtgttttgtggctttgtagaaaaatgttttcattcttaatagattcatgctaaagcattaatgggctaagtgataaaaggtccacaactttcaagtgtttcagaaaaatagagaaaacagttgtgtcaaaatgttaacaagtggtgaatctagttgaagggtatacgggtgttcattatactatattttaactttttgataggcttgaaatcttaaaaaataaaaaagtatatgggaaaatgcatgcatttctgtgagaataaggccccagcacagaagctttgctctggaatagtctgttagatagcttaagctctttgccagattacataagccatttacaaagttaagccatttgaagtcatgtgcctgaaaatggtttaaatagtttctgatgtgtgtctcaaaggaaaggatcagacctttaccttatgttaaatgatgccattcactccgaaagtgttgaccatttaaaaaatattttgaagcagtgtgaggaaatcagagagtaggatattgtcttctaagatctctagggtaaagctgactgctagttggaagatccagattggtgcaagggagtggttgattgaagtcaaggaaatgtagggtcatgataatgaatagattatctgcatagacaggggagaactggagcaggcatcctaatcctgcgtaattgtaggacggtggttaaaaggttagtagatgtctgctgttaggaagaagtagttgagtatttgggtagttagatatagttggattatgtgagtcacaaaggaagatttctttcttacagtggtggaggaat

SEQ ID NO: 11501 - DNA, 1034 bp, Homo sapiens
atttgtaaaattgtgggaaagatgagaaaatattggatacttcatgttattattttatgctgagtctgctaaatgtaaaaggtaggctttaattgattttaataattgtaacaggattttctttccagcttcacattgcagatgtttcagaagacggtattcgttttttaagggaagttttaataccacattttttttttaacaaaggctttcagatgttaggaatactttaataggctgtcaaagatgtgaagtttaaaaagggaatccagaataagtggaaatctgtagagactaagcaaaggcagtgaactcaagagatggtgatggcaaagttagagttcagtttataacacaggtcagcatatatataatgtataagaaaagttgggcaagtaagtattttcttttcagtagtttggctcctctttaccactcagttcacctgatacctccatttcccattagtggagatatactcaggaatgtacatcaaatttattcagtcgatgcagatctgataccataattcttggatcatctctaaggactataaatacattctgtaggtaagagtcaagcattctttaataatgccctcatttgatgggggaaggagttaacttttatacctagaagcacttgtctttatcagattagtattaaagtatttactcttttcagaatctgtacaaaaggtagcaaagtattaaggatattatgctttaggttgatactgctattgaataaatcgtcaaagcttaatgtattgagaaatatttggagattgcttagtatctggttctctcttgaggtcatctgtatatagcacagagtggttagaagcatagactctggagccagaacaatttgaatcccgatttcctgcttaggaacagattccttaatatctctgtgcttcatttccttgtgcaaaaggtgggatgataatgacagtatgtagctcataggttgtttgaggatttaatttgcgtaaagcactttatatattaggaaacagtaactaaatatta

SEQ ID NO: 11502 - DNA, 1049 bp, Homo sapiens
aacccttaggaggtagctctccttcctgtttgctcttcccccacaggcgcaagtgagttatgcttcggattctgcgcctctatgttcgtttggatttccatcatcgtcatctggttgatcgtttaacagtacatattttccgtcattggttagtggtatggacagcattaattgagccagtgcttctggatcctgaagttaggagagtttaaaagggaaaaaagaaaaggcttaagatgcatttaaacccctttggcctggctttcaatatgttctgtaatctagtcttgtttctcctgactcttgtgtatatgtgccttccgctgagtctccttgcttctcaaactcaggcatgtcacttctagaatctagactgttttcctctgagccaaaatattgtttacgtagtcaattcgtatcatcttcccaaagattccacagaggaacttccttcacagaacttttgtcttctctatctttaaactccttcttttctcacgtttaatctataccagaagttggcaaactatggtcatttggctaaccatttgatttttattggaaaacagctgcggccatttatttacatactgtccatgctgctgctgcttttttttggtgggggggggggtggtgcggcggttggagacagagtctcgctctatcgcccaggctggagagcagtggtatgatctcagctcactgcaaccttcgcctccccggttcaaacgattcttgtgcctcagtctcccgagtagctgggactacaggtgtgcaccaccacacccggctaatttttgtatttttagtagagatggggtttcaccatgttggccaggctggtcttgaactcctgacctcaggtgatcctcctgcctctgcctcccaaagtgctgggattacaggcataagccaccatgcctggcctgcttttgtcttatgatagcagagttgaatctgttgcaagggagatagccaaaaacataaagaccctttatagaaaaagtttgccaacttttgaccaataccattaaatactagcttacagt

SEQ ID NO: 11503 - DNA, 1040 bp, Homo sapiens
ctagaatagggggaaaagtcagttactgaataattaaatataggctgcaaattgtctttttaggaaacgtatcacaccttctaattccaaacccccctaaactatccatcaacacccttgagagatggcatatcagagctagaagggtcctaggaggttagctagttccctgtatgtcacaaggctgagaagacaaaggcccagagcatttactgacttactcagggacatctagctgtgtataacacaaggcagagatatcgttagaacccatgtctctcaactgcaggtctggtattccctccattgtgcacatcaaacatttttgtaactttacaaagagaagacatacatttacccaggagaaggctacgggattaaccctcgctgactggatctttagttccacttcctttcatatagtgtcttccttagagttccatttcataaagcatgctacttgtatcaactgttaaatccttaagttacggtgctgaaatgtttctcggacttgttgcctctttctcctcttttttaaaaacatttgtttacgttctcatgttctgcttcacagctactactacatcaacatcctactgggtcttgcactctccccttcttcccacaacctgtatcctaaaatttatcctactcaggtacagaatagtcttccctaaccctggttctgaccatcgcccattttctcaaaaccttccattttgctccattgcctgtaactcctaagcagggcacccaggtctttccagttagactcaaacctattttctggccttaccttctcccattccttctcagataccccgtgcccggcatgtgaacgctggctccacactgcacagattctgggaagttacttaaccactgagttttctaatgacttccttctggggtcattagatatttgtaaaaaatgtaatggggttctttctaccatgccactaaaagatgaacaccaaatatagtcgtaattttaatttaccctttaatgccaggctttcattagtatgaaaatacaatcc

SEQ ID NO: 11504 - DNA, 1098 bp, Homo sapiens
caggagttggagagcagcctgggcaacatggtgaaaccccatctcaagaaaaaatacaaaaattaaccaggcatggtggtatgcacctgtattccgagctactcaggaggctgaggtgtgaggatcacttgagcccaggaggcagaggttgcagtgagccgagattgcatcactgcactccagcttgggcaacgaagtgagactgtatctgaaacaaaaaaaaaaaaaaaaaaagatttgaattttatgatttttttgccctcctttctctgtttttgaaaatttttttaaacccattttctcttcaggaatattactgtattttaattaggtattagacaacatttttgtagcaatactatcacaccaatacaaacctatcttctttttttctctaggccctgcaggagcagccaaagatgtgtaagtattgaatattaatgattttataagctgtctttctgaggaagttgctgtttttcatgattatgacctttagatctctgtgggtatggctgaaaagacatggaaatactttgtgtataatgcacatgtcaagatgatcgttgtaactaaagtgctattcagagagggttctttgtgcttttcattagcttttcagttgcctgggcactttaactcaggatcttaagaaggggaaatgttgaattgtgttttccatcccaactggtatagagattttttttttcttttagttaaaagcaagtgattataggagaaataagcatgtagctcctatgactacgcagtgttttagagttagctggggaggaaaggctggggccaagcagttaccaagtgtacattgaattgttttaaagttgataactagatattcgaatgaatatatagggccattcaacatagtcaccattgagctatctttagagcacagggcatttaataatgggcatctccctgtggagagatctggagctcaggagcattcaggatttccatgccccttctctctgcatcctcctgcctctaatctagctatagcaaggacactacagcagttcactctttaagagtatttctggttacccagtgaagggtgggatcaactctcccacc

SEQ ID NO: 11505 - DNA, 1076 bp, Homo sapiens
gcttacacagatgtggggcaaaaggggagtgatggggctcaaaagccttcaatggtcaaataccaaaaatagggccaggtatggtggcgcatgcctgtaatcccagcactttgggaggctgaggcgggtggatcacttgaggtcaggagttcaagaccaacctggccaacatggtgaaaccctgtctctactaaaaatacaaaaaattagccaggcatggtggtgggcccctgtaatcccagctacttgggaggctgaggcaggaggattgcttgaactgggaaggtggaggttgcagtgagccgagatcacaccactgcactccagcctgggtgacagagccagactctgtctcaaaaaaaagaaaaaaaagagtcagactttcttatttcttattacaaagaatttagagaagatgagaatgggattgtaaagctttctgggaattaaatatttaaatatgcattttaaaattaggactttagatacaaaggaagcagtaattgatggcttctagctcctgtttgctgtgttggagtttattacgtaaacatttagcaacagtgaatactgcaccctgaccgtattcctattattgcaatattttggtttctccttcagtctctcccttcaatttctatatgtgttgccagattaattttcctcaagcactgccctgcacttgcataggacctctgctcaaaacctttcaattattcccatcgtcctctggactgaacccaggatttattaggaataggaagagcatttatgttttagcctcaaaccgactggctcgcatggcgtgggaggagatgctacagtggagagtgagcagagcccagggctgggagggctgtgcagagcttcttcaggccactgttctcaggggcttctgcgacctcatgcttcttgctcctgtccttgtgttttgctgtgcccactgcctggagtggccctttccctttccctttctgtttatagaaatgacatctgttctgtagggcatgtgtgttatcctttgtgagaagtatttcctggctctctgagctgcatagtgtgtctttctcctcaga

SEQ ID NO: 11506 - DNA, 1026 bp, Homo sapiens
atgtgtagtttcttctgcagatgaccctaggctgaaagttatgcccacttagatgtgcagactacttccagcacagaggggcttaagtgatggtgctcagatgacaatggatggcctggctgcatcagaatcccgtgggggagtgccatgtaatgtggaggcctaggctctcccaggaggtttggaccaagtggggaagggatggaattgtgaccgaacagtctctatttttaatttggatgatgttaatatacatgcagctaggtttgggcattgcttatcaagatgtattttaattgtaagtttgtaagtctcttttcctacccaactttgcctctttatataattatcatcaatgcttggctctacactggccacctaagtcttaaattaatattgggtgaatattaaataggtgttttacttaaaagaaagtaaataacttgtaggcttaaggctaatacattttttaacctaagttgtacctgtttgctcactcttttctcctcttctgttgtctccttagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgttgcccagccagggccgctgcattttgacaacatttccaccctggccactcagcacatttcatggaggtcatgtcttttcactgatacttttttgatagtttttatataacaaaatccttattctatttataacttaagatgataaggcactataaattaatgacctaaaataatatatttgtctgttatcttttgctatttctacttcactttaatttttagctgtaaaattggtaaatggattcttacaact

SEQ ID NO: 11507 - DNA, 1032 bp, Homo sapiens
gtagtctagctaaagttcctcccatgggaagcatggggagtgggaaataagagttcctgtctaacggtgggctgtagatgcctattttttaacttgcactatatatatattttatatatatataacatatatttatataatttatgtttacatattatataagtatatatgttatataatatattatatatgttatatatataacatatatatgtttatataatacgtaaacaaattatataaatataaataaatacatataatagatataagtatatatacttatacatcagtattgaatcagtagtcaacacccaaaagttggaagattctatataaaatccagatttcaaggttctcctgtggaaaaatctggccatgctgggctcacattcccacagggcagcctggttgttgctgcaaagaggctgccttctgcagatggggcccaagctctccaggttgctgttctcctacccctttctacctcctgccaccccctaccgtctaccctggtctgcatcactcatgtctatgtcccctggtgtctttagatattttggtttggggcttacagagtagaggttaagagcacagactctggaatcagccaagccttctgttcaaatctgatctatgtcacttcctaaatgtgtggccttgggcaacttagctaaactccttgagactcagtttcctcatttggaaaatgagaatagtaattgaactaccttatggggctgttgcaagaattaaataatgtaatcatgtgagtctttttgtatatgtgcaagatacataattgatgggaattactgttactctttgaaaagcaaaactgggcaatgtgagaggaagcctggaagagaactagagcctctggcctgatgtacactttgtctggttttagcactgcccttggtctcatcggttttcagaaaaatattttcataagctcagttccaaggagtcccctttctgtagcaaggagtccaatagcagttttgggaattaggggttcaattagagcag

SEQ ID NO: 11508 - DNA, 1050 bp, Homo sapiens
cattttcctttttttttcttttttttttttttgagacagcatgtcactctgacacccaggctgcagtgcagtggctgcatgcacatggctcactgcagcctcaacctcctgggctcaagtgaccctcctgcctcagtctcccagggagctggagctacagatgtgtgccaccatacccagctaatttttaaacttggtagacacagcatcttgccctgttgcccaggctagtctcaaactcctgagctcaagcaatcctccaatctcggtctcccaaagtgctgggattgcaggtgtgagccactatgcccagccttattttcctttttggtgaagagaatccaagtagcttatcacctgtgtcttcacaactaaagtttaatttttatgtaggaagtcaatttatccttcaaccctggagtgaactgcaatatagtcctgaatcttgactttacagctacactttagaaataatgccctccttttggtactgttgtggcacaatgatattaccagagagaagataaatgtatatattgtggactcagtaaaagacatagcactatgttccttttgagataacacattgggcaaaaatgctttggcaaaaactaattcactgtaaaaccaaatgaaattcctggttgcctgaaccagttgaaaactggttctagctttgtgtagggacccttcctctctacatgtatacaggtgcctcctggtttttactgaagtgttttcctggatatggaggggccagatgagggtgaagacttctagctggagcaatgatggggctggggtaccccatgggtgaacagggaacaaaatccatctgacagtgtctgtgtaggaagcgaaagttgagagaagtgagtcagattctgggagtccttgaataccaagttcaggacctcccggtggaaacagtggaatctgtcccagaacgaaaaactcttttctccagttctgtggctgtgattcatccttggttttcattgcaagtgcagcaatccaggctgtagttagttgtgttcccactgggctcat

SEQ ID NO: 11509 - DNA, 1117 bp, Homo sapiens
agagaagagagcttgtgcagggaaactcccctttttaaaaccatcagatcttgtgagacttattcactatcacaagataagcatgggaaaaacctatccccatgattcaattatctcccaccaggtccctcccacaatagaaaggaattatgggagctacaattcaagatgagatttgggtgaggacacagccaaatcatatcactccatttaatgttccagtactgatttctcttctttctctccaacataattcatgtgatcttcctgctttgtgtgtatctaaatcttaaatcctctctaaataaggtggggaaaatgtttgataaaagaataaagtatggtcctttagtacgtgtggtgcattggaatgtgaacaacacctatacttaaactagaacaaatagtaattcagtggaaggacctttaagttcttctcttatgattttaagcatgagaagagagttgaaaaatttgcccatggcaaatattgctggtttcttcttctggattcccaagtctaggtttggggaagaggattaatcccagctcatgggcattgcaagctacactgtgctatgtctaggtggggttgggctggggcagggatcatggctcagtattttgaacccatgaaatcacaagctacatcttacaagggtgccattgtgcctggtacctcagtggtgatatcactgctgggctgtctccctccaagcgttctcatagcctgggcaaggcagctgtagaatggttctccagtgaaatcatctggcccaaatcatggctgccagcctcaccctgcacacccaggccccatcctaatctcccagcaggaggtgcttggggcaagctggctgccttagacacagtgatgctgggcctgctggcctgagggagcttagctcaggtagcctccccagagagacctggcccttcccaaggagctggatcttgaggccagctttccaaggccaagggttgccatcggctgccgttccctttccaagccatggatgctctggaacattgtaagtttccttcagtgcaatgtggattatagatgtgtgtataactgaaatgatatctcaagtgtctagcatagtgcttggcgtat

SEQ ID NO: 11510 - DNA, 1029 bp, Homo sapiens
ctttttctagaatttcctttaatatctctgaaggcttagatgtcctctcataggaagggagaggtgttttccatgacaagtgccagggtgagtgtagtatttccacttacaatgaatgtgtacaacagcttttctttgacagtgctttggaaaaaaacaaatgaaacacagaaatctgccaagcttgatgtttagaattgcgcaattttttttttttttttttttttttgagacagaatctcgctctgtcaccaggctggagtgcagtggcgcaatctcagctcactgcaacctccgcctcccgggttcaagcaattcttctgcctcagcctcccaagtagctgggactacaggcatgcgccgccacgcccagctaatttttgtatttttagtagagaccgggtttcaccatgttggccaggatggtctcgatctcttgacctcatgactcacccatctcggcctccctagaattgtgctattgaagagggctttcctccagttgttctgacttcatcatttttctgcagtgaaatgtttactgacttcacaaatccaccttgctacgaagtcttcagaagtgctgacaattctgcccttcagagatgtgacacagtccagtgaagattttggtttttgctaaatttatctccagtattacaccttcatgaatgctagaatcccatttagattttgcatttacatcatccaataggaattcctatctaagtcagaaattcttagtcttggtgaatggccagatggttctatgggtctcttatggatcagcttctgctggttcccctttcaggtgtcttcagaggcatgtcctctttattcctgtaattgaagggaaatgcacctgtcttctcatcctcccacctattattcagagagcatataaattacttgatgaaatcctagactattaagagccaaaaggagcccatgtagttacagaatccaacttctcattttgaactgaagcttacagatagaatagaatttgccttgggctgcaaacagaaa

SEQ ID NO: 11511 - DNA, 1049 bp, Homo sapiens
gcctttaattgccatccacttgttaatctcttcctagtttatatctccaggccactccattcccgaattcaagactcatttgttgcctccttgacatttccacctgaatgtctaatggagatctcaagcttaacacacccaaaccaaatttctagtagcccctccacacctaaacctgctattcctacaatgttcctcgcctccatcaattttaactctatccctctagttgctcaggcaatgtaggaagcaatcaccatatgtgtcatccttctgtagccctgagatgagctctgaccagacagtagttgagagagaatgggagggagaaagaactccctttgggtcttgagacccagctctcccaccagactctctgagccttattttccttttctcaaactggcaaacttcacttaggaagtgtcatgagaataaaataaaggattgaaaagtgcttaaaatcttgagtcatcaggaagagattaagttatattctgtttaggaaacctgtagtgtatgtatgtatgtgtatacatatttatatgcatatgcacacatgtgatttccataaaaatgtttaaaaattattctttttgttttgatttactttcctttgcttattttggaacattaaaataacttatgaaagtactgttgctggtacagagttctgatattcttcttgttttggctcacaggaaaaatggaggctgcttccagcatttttaaaggtaattgtttcacatttaataataattggttatttttcagatgaaaaagtcaagaaataagccattttttaaagattaaatttttgtcatcaacattttttgattttgtatagctgtgtttggaaatacaaggaattataaggtaaaatccctgcctgaaaggtgctggtttggagagtggtagtctaattttagagagaagtagtagtacatgcacagtagcatggcacatgattaaaaaccaaagtgctatcagcaaaagagcaatggtcagagagggccacccaaatgaagtgagacataaaccacatctta

SEQ ID NO: 11512 - DNA, 1038 bp, Homo sapiens
gtcagggccagtttcctgatcagatttgaaagccgtgttaaggatttggcttttcttctaaaagccgtaggaagctattgaggagtttctaagttggggagtgaccaagaatcaaataaaatggtcgtaaggtcaagaagtttctttttccccctaagagaccaggtcttgctacattgcccaggctggatttgaactcctgagtttgagtgattctcctgcctctgcctcccgagtagctgtgactgtaggaatgtgacaccttgcctggcctttttgttattttttaaaaggagctgcacataaatggagaagaaggtgctgggtgctgggcacagtggctcacgcttgtaatcccagcactttgggaggccaagacaggcggatcatttgaggttgggagtttgagaccgactagcctggccaacatggtgtaaccccgtttctactaaaaatacaaaaattagctgggcatggtggcgggcacctgtaatcccagctactcagaaggctgaggcacctgaactgcttgatgcagggaggcggacgttgcagtgagccgagatcgcaccactgtactccagcctgggcaatagagcgagactctgtctcaaaaaaaaaaaaaaattttttttttgttaaaaactaagatacaaatacacacattagcccgggccagaatcatcaatatcactgtcttccatctccatgccttgtcccactggagggtcttcatggacagtaacacacatggagctgtcatcttctatgataacaataccttcttctagaatacttgctgaaggacctgccggaggctcttcttgaggaggggtcattcttttcagaaatacactctatgaaatcaaatcaagttgtaagtcattaggcgataggaatttttcagctccattataatcttatgggactgctgtcagatatgtggtctgtagttgaatgaaatgttgttatgtggcacatgaccatatattcatgtactcatattttgatttccgagagtcagattgcttctcaagg

SEQ ID NO: 11513 - DNA, 1008 bp, Homo sapiens
cagagtctgcccttaatatatactcttaaaagatcatttaaaaatgggatggggggggacattctttggagaaaaagggattaaagttcaatgtggaccataattctactacagaaggagcactttgaagtggtcaggaccctgttgcagagaggagcagtaactgtcagattcctgattctctttcagtgccgtttgagagacatgacatactctgcccctattacagtggatattgaatatacccgaggcagccagaggatcatccgcaatgccttacctatcggcaggtgagaaatgaaatccgtattagagccacactgcctggattccagccccatgatgtgatcccatttcctcatctgaaaaatgcaggaaatgctgcctatttcataggtccaatgagtcagcatgtgtaaagcacttagaataatgtccagcacatagtcgtggttgttactatttattaattgtgaaaccttttctaagaagttgaggaaaatgtttccctttcctactataactctgagctgctagggaaccactagatacaatagcctttcagtgaactctcctggacaggtcttcttggtggataggtatattctgagattgagttttcctggaatttaactttttctcatctacaagtatttaagggagaagttacttatttgcctggtacaagtttggaaatgatagcatccacttgcgtttttgcaatctgcccttcctgattagggaaatatattgactctcctttagaaatggacaaaacccacaatattgtgtggtcaataatggtactagactttaaactcagtccacataatttctgttcaagtgtttttccccctctcaaaagtgctaagagcactttgaacaaacatccatttgttcaataaatatataccaactgcctatcacttcttatgtatgatgctgagtacttaggtgagtaaaagatatacaaaatacagttcctattggctaccttcattcacagct

SEQ ID NO: 11514 - DNA, 1058 bp, Homo sapiens
taatactaccacctaataactatttatgtcttcaatcaagaataagtacttttctgacccagtgtaatggctcacccctataatcccagtgctttgggagactgaggcaggagaatcgcctgaggccaagagtttgagaccagcctggacaacatagcaagaccctatgtctaaaaataaaaataaaaaattagctggacacagtggcacacacctgtagtcctagctacttgggaggctgaggtggaaggatcatttgagcccaggagttatgggttacactgagctatgattgtgccactgcactccagcctgggtaagaacctatctcttaaaacaggaaaaagaaaaacttttctgttttctgctaccaaatgaaatatattactttttagaagattataatttaccagcctgggtaacatggcaagaccccgtctctacaaaaaacttaaaaattagccaggtgtggtgatgtacgcctgtagtcccagtaactcagggggctgaggctagaggattgcatgagtccaggaggtggaggctctgtgagccatgttcatgccactgcactccagcctgggtgacaaagcaaaccctgttgccaatatatatattgcaaatatatatattttttgcactttgtaaatagtggtttttggtcagaatttttcttccttaaagatgtgaatctctcaaagtgctattttatacccctcatttcaaaattgactgagggccaggtgtggtgggtcacacctataatcccagcaatttgggaggctaaggcatgagggttgctggagctcaggagtttgagatcaacctgggcaacacagtgagacctcatctctactaaaaataaaaaaaagttagccaagtgttgtggtgtgcacctatgatcccagctacttgggaggctgaggtggaaggatcacttgagcacagtttgaggctgcagtgagctatacttggaacaccactgcattccagcttgggcgagagagtgagacccttactcaaaaaaaatatagatatagatatgtatcctgagtata

SEQ ID NO: 11515 - DNA, 1080 bp, Homo sapiens
atactttgttcttatgtccagattatgttatataatttgtttctaatttttagttgtagaagcaatctgtgttcatgaaacagcacaacatacaccacgcaattaggtttattcccttgtagtagtgctgtttgagtgtatctttagaaatctatgaaattattcctagctctctaataggtcaatatttggccagatgccacaccataggttattcaacaataacagtagtggccattgaacactactgtgtgcaaggtgccatgcttataaaaaataaggaaaatttgataggtagtaaagttgaataacttgaccaagtttacacttttagtaaacagtaagactggactcaaactcaaggttgtctgactcctgatcctgagctttttagagcttattcatggagtatgaaacctgtagtgagagtcctcataatagtctggtgtgtcactgagctgttagcttgcttgatctctaaattgaacaatggtttaactctttttttttaaatggggttttatcgtgttgccctggctggtctcaaactcctggtctcaagccatctgtccacctcagccccccaaagtgttaggattacaggtgtgagccaccatgcccggccaatttaactctttatatttgattttttgctcctgtttctctggaaattaaacatgtaaagaaggtgagatggctgactgttggctaacagttctagaaatacatgtacagctggaaatgcttgttctctctttccccatttcagccttagaaaggggagagaataaagataggggtactgaataagttaagtatgatctaagttggataaaagaacccaggtttatagaagccaacatctattggatccaaacactcttagaggtttgagcttctgaatagattggcgcattccagattcaatttgtagtgcctcacagaccattatattttctaattaagagcaacagaataattagaccttggtactattctgaattcccaccttaaaagattaattctacagaggaactgtttaaaagacacttataacttactgagtgtctttccaaaaga

SEQ ID NO: 11516 - DNA, 1028 bp, Homo sapiens
caaaaagtatttattggatgagtgaccatggaatataaattttgtagattaaaggtttaactctgactttcttttggatttgaacaatgtaaccaagactagaatacctttttagaacagggattctcaactagggatatgctctttggagagctttttcaaaatagccctgctcaggcccaacctcttatctaccgagtgagaatttgggaggtgagctccagacatgtgtattctatgtctctctctctctctctctctctctctctgtgtgtgtgtgtgtgtgtgtgtgtgtgtgtgtgtataaagtatataaattatttagaaacagaatcttgtttcgttgcccatgctggagtgcagtggcatgattatagtcccctgtaacactcctgggcttaagtgatcctcccgccctaggctccttagtagctaggaatacaggtatgtgccaccatgcccagccaatttttaaattttttgtagagacgggctctcactctgttgctcaggctggcctcaagggatcttcccactttgacctcctacagccctaggatcacaggtgtgagccaccacatttggcccaaggtgtattttttttttttttttttttttttttgagacggagtcttgctgtttcgcccaggctggagtgcagtggcgccatctcagctcactgcaagctccgcctcccaggttcatgccattctcctgcctcagcctcccaagtagctgggactacaggcgcccgcaaccacgcccagctaatttttagtatttttagtagagatggggtttcaccgtgttagccaggatggtctcaatctcctgagctcgtgatctgcccatctcggcctcccaaagtgttgggattacaggcgtgagccaccgcacctggccccaatgtgtatttttatagatggtcttcaggaaataaatactcatatatctgatgggagtgcaaaatggcacaatccctatggggaagaaactggcagtgtctaccaaaattacagatacgtttt

SEQ ID NO: 11517 - DNA, 1051 bp, Homo sapiens
cagcgtctattttataacatccctgtgagatatggatgttatttccttttttttttttttgatcctcccacctcagcctcctaaagtgctaggattataggcatgagtgaccatgcccagcctcccattttttaaaaatgggaaactgaggttaagaagtgtctaaatcatacagctggtaaaaaaaaaaaaaaagaaagaaaagaaagtcacacagtggcaaacccaggtattaaactccggtctttgatttaaaagccactacaatacgttttcttcgtaaaaaagatgtcccttccgccttcagagagcttttagtagttgaggcaaactcataaaaagaaaactgacaggacggatgtgctaagcaccaaatgattgctacagatttgtggtttaggtatcccttagaaaagaagaatgttgagggctgaagtggttagggaaaattttatgttgaaagtgggttttaagcttagccttcgagaattgctaaaacttaaatagaaaaggaaaaggactgatgtgtagagggaggctgtaaaaaagcaaagaagctcaatatgagataatttggaaagaaatatagctaaagaggaaaatttgataagaatagtatgaaagaagactcagagcaggttagcagatcttaagtgccaaactgaggactttgacattttaccttataataatgtataacagataacctgtactgaacatttatcacttgccaggcactgccctatgtgtttgtacatgcacgatctcatttaattcttgcagtaaatgaggtccagagacaagtaacttgccaaggccacaattgttcagaagaagagccaagatttgcatacaaacaatttaaattcagaacttctactcttaattaccacactgatttggttttagagtctatggtgggttgaacaaatttcaagcccaggatcactgaccttaaacaagtaatatgcctcacacctttggcagtttttaacattttagttaagaaacgtaatgtgacaatagaaactgacatctcattcctgtccct

SEQ ID NO: 11518 - DNA, 1034 bp, Homo sapiens
gtaaccacagctatatatgactgttgagcacttgaaatgtggttagtccaaattgggatgtcctatcagtgtaaaatactcactagatttcagagacttggcacaaaaaaagtaaaatatctcattatttgtttaatataggttacatatggaaatgataatatttttgatacactgggttaaaatattaaaattaattttacctattctttttcaatgtggctactagaacatttaagagtacatacacttggcttacattgtggcttacattatatttttattagacagtgctgttctacctcattaaaatatactgtaaggttgcttggaaattgaattaagaggacttggatccagctaaattaaacaccttaaggtgtcaggggaggattaacttgagaagcttgatattatctatccttaggttatataggacctttccagtagctagacacctttaagtaggacgtcatgctacctttgtattgcctatctgtagtcattgttctttagatctgtagtgggactaactactttgagctcttggttaaagtactctctgaaatggtttttgactagtagaggaacatcaaataagaatcatctccactggctgtttgttctcttagttctcctcattctttaacttttaatccttccttattgggaagagcgttaagaacttctgtttctactactttattctacagtgtcagttggcatgctgacctattaatatttattttgttaatttggacaacagataagaaaaattctgtaaataaattaccaagaaataatttttaaaaccacttaaagataaaactgcactttattcttctagtactatacctgatctctttttctctatattttcttaaccatgctgtttactgtgggtaaattaggtgggtagcagatttttagaagctttgcatgtgatctaacagaaatgtgaacagtgatttaaaaaaaactaatatttatatagtgctttaaggtataaaaaatgcttccatatacgttatctc

SEQ ID NO: 11519 - DNA, 1353 bp, Homo sapiens
ctaactgaacatgtttaccagtccaaaggttataatattattgctgtgagaaaaaaagaggtgaaaacatttataagaatatcacaagttattgggaaacccgttatacttcagtggattatgaactatccatgatactgaaatcttgatataagatgcacgcccagactttaaaagaactacagagcttccttctcagggctatcacaggctccatccattttaacaggcattttttgaaaagctctatgttaattaaaatgctttatttatatactaatttctcatcccatctttcaaatgtgaaaaggaattaaatatgaaatggctaatttaaactgtcaggattcttttttccaagtcaaccttacattaagagcaggaatcctgtgcttaagaaatggttcccaattatcctgtcttgggttttgttatacattgtacagaagtcaacaaaacaagtatgtaacagaacctgcctaaatagcagccgccctcattaaaaacagagaattaatcagggggtgattgaaggaagcaatgcctcatgttcccccccccttttcttcttttctaatcatagaacaaaatatgttacataaaaggatcggaactattatgcagtactcaattagagggaggtgaataggtctctaacatgctgttttatcaaaagagcagactggtgtttgcatgactgttgtttcattacagaccctgtcattaattccatgtgtcaatactgccctgtagtacacagagcagacaagaaagaagagcccttgaaaacaagggaatgatttttgagtcgttatcaagctaagtggcaagcgggaagctgaaactcgtataggtaaattcgaagggactcttgggagatctgcaagtgggaaacaagaatgcattttaccaactgcttaattatgtcctgtttttcaacaagtacacttgaattgaatgttttgtttgtattgcacaaaaacatgtgctgtgggcaagagtattctcttgctttcaggtcaagtaaagtgttttatacacatacacgtctgacctattctatattgtgcgattgggtatgttagtatctgaaccccaattttgcactgtcatttttgggggaaagagtcatataggaaccagaagccctaaaaagcagaaccttctctaaggtgctgagaagtcatataagcccaggcatcctagagtataccatacttacaggcaaacggtggctcaggaaaatgttaaaatatatctggaaaaaaaaaacagaccagaatattttaaatatggtgtaaattccgtatctcccatccctagctctttaagaaattatttttttggtttcca

SEQ ID NO: 11520 - DNA, 1122 bp, Homo sapiens
caactaatttgaaatgaatcaacatgtacttacatatcactagagactgaggcaaaatcaaaaccgacagatttattccattgaatgaagtgtatgcatatcaaatcagccatttaattgtatgctccaaccactggggcaggtgaaattttggcagcttcaacttgtctaaaacaaaaccaatccaccaaaaaaaaaaaaaaaggttaattattcaaaacagaagagacctgctccttgtcctgagcccatttagaccttgacttttcatacttttaattggcttagtaggtttggcctgtgtgaatgaagtcttttatctccctcttccctctttttctttccatgcccctttcatctttcctattacaaacacacagagaaagctcaagggaaaatactttggtttttaaagacttttctttttaaaaggttgtggatttgggtgggggggaggggtgtgtgtgtgatgctggtgaatacttttttttctctctcttttatctctttttctagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacc

SEQ ID NO: 11521 - DNA, 1042 bp, Homo sapiens
tactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattcaatttggccatctgtgtgtgtttctttatagatacatgggctaaacaatactatttcacagtttatgcttttttaaagtgcttttacatccatggtcccacttctaatagcctttttaaggacaggtagagtacatggagggttactgaaaaggtcatttatccagaagttacctctctggcaaagcaaaaaaatcaggaattacgtcttaaaggcctttcagctgccagaggagatgtcacaaagtttcttgcaacttacttatgggagagatcttcaagaatatcactcttagactctgaactgaaatttgcatacgcttccaacatgttttattagctggctttgaagctcacaaaagaatggcaaagaaagaggctgctagattgaaggcaggcatactgaaagaagaaaaaggccaactgaaaactagatagtgagatgagaagaataaaacttcaagacatagcaaatctgggactgtctacttaccaaaggatactctagttgacccagaaaatgtgtgtacaacagtatggcccgtagactacttcctataatggtgaccctgagtttttttaaaagaagaaattaaatccagaacgctttataaaagggtaggaagaagacaatagatgttagaatttcatccaaaatgtttgagggagaggtgagtgacccaggttttaaccaacagcaaaagaaatgggcaattcataattttagattaagtgaaaagtttagaaaaaatttaagtatttttgttattctacaaatgcatttttaaagtatt

SEQ ID NO: 11522 - DNA, 1075 bp, Homo sapiens
tcagtcaattgtttggctgtgcatttgttacaaagttcagacttcacagctgaaagtgagtcagttctttatctgggtatgtttatcttggaacaaggttcagaaatggaaacttgaaacaccacccctaaaattagtactaaccatcacccactttcccttacaggcagacctggatcttcagaaagttttctaaaaagctccatttatttcaaatgtatataaattagataattttgaattagaacactttatagagaggttttcataaatgtccccgaatttgttgttagtacttattccttttggcctgtcaggtaggggtgacttctcttatgccaattcataagtaatccttccagttcacaaggtttaaacagaagtcagagcccagttaataaacccagactctgccatttggcagctgagtggcctctcagcttcagtttcctcatgtgtaaaatgaggaaagtaatgaatgcacatggtgttttataagagttataataatggtcaattctaagcaaactgaccacacaagtaggctccaactcttctttttggatgagtaatacttgattctcaaagacagtaatttattccaaacacaagatgaaattttctccaaaaaaaaaaaaaaaaggtatagaagtttgctaatagttcacataacactaagctacagaattcagaccacagtagagtgatgtttcatggctagtagtgagaaagactggatttgcttcctaacatgaaatgtggtgtatgaatataaatgtatccataccttgaattaaggaagcacttgtccatttcttagaagtgattcacttataaagtatcacactgatatgccatttaatagtatatgagtttttgaaataatggttcaaggtaaaagttaccaaccttattaaaataaatatgatttatattttataatatggcacatgagtcagaatttatctatttagagataacttaaatacaacacagaagctaagcaggttcttaaaattactggtgtctacaaactgcctgaatttttgtctttgctagttagtttcaccctgca

SEQ ID NO: 11523 - DNA, 1039 bp, Homo sapiens
caggctggagataacaataatacttgtgggattttgaatagtctctttcatttcagggatccccaatcacttaataaacattaattaacacaagccctcacctgtcagcacgggcttggagggtaggttggttttcaggtctcttgcttttctattgtctctgcacaaaatgcttgctcagccgttttcctgtccctaaactggtcatgctgttctgttgagcagtgttgctgtgttggaccaaaaatgtcacagaaggaacccatcttcttaagaggaacaacaaatgctatctcaagagccagctgtagcagtatctgtgctcacagagcacctttttaattaactggcttgatgtaaattaaaacttggaatttgggtcagtagagggtgatttggttttctgtgcagacttgctagttcagtgctggggcatttgcaagttgggtgttttcctgaaacataaaataaaaataacaaaataaaaacaatgaaggactaacctgaagacctagggtcaagggtggagttgatgaactttgaatagaaggaaggcctctaattctgagtctgttagtatttgtgaccttgagccaggcaccaaactcattattaccagacttattatctactgagaggtaaatacaaaatagtaattgactctggagtcaggcacacctgtaagctgcagtttccctatctgtaaaatgggtattataataaacagctctacttgtatagcttattatatgccaggcactattttaagagctttatgtattataatcattatagttacatcagctatgattattattattattgagatggagttttgctcttgttgcccaagctggagtgcaatggtgcaatctcagctcactgcaacctccacctcccaggttcaagatattctcctgcctcagcctcctgagtaactgggattacaggcatgcgccaccatgcccagctaattttgtatttttagtagagaaggggtttcaccatgctggccaggctggtttcgaacttctgacct

SEQ ID NO: 11524 - DNA, 1021 bp, Homo sapiens
ggagttcgagacaagcctggataacatagcaagaccccatctctatacaaaatgtaaagagtcagctgagagtggtggcatgcacctgtcatcccatctactcgggagcctgaggtgggaggatcacttaagcccaggagtttgaggctgcagtgagctatgatcatgccactatattccagcctgggtgacagatcaagaccttgtctcaaaaaaaaaaaaaaaaaaaaaaaaaaaaaaaaaaaaaaaagcagcagcatcgatgtacttattgggaaccacactaaccataatgattctgaggatatttgtgatgttttcctaaggggatagagggaaaatgccctcagtatatcatctataaaccataaaccagggggattaggccaaatcaacgattttgatctgggttctcatggattaaggcagggaggcttctcacttccaccctgtacacacacatcagcagagtttttcttcttgtatctgttttatatatactgggattttgaataagatgtagagtttgaagagcactagcctgggtaatgagcaagtccttcctgctctggcatcccatgaggctctgactacccacggagctgggatcccacagtggatgtgtgctttggctttgaccaatgagacaagcttggaaagtgtcctgctgagtctcagagaagcagctgaatgaggctaggcgagtgaggtagggccaggaggggagggaaagagtgctgcgcttggaacctttgcagctccaggacccaacagggatggaagagagaagacagggcatgaggagaaccaatattggtaataaactgaactggcagaattcagggtccaacaactggatgcttcacagttgaagatgactctcccttcctcctcctgccccgacaattgtttgcaattctgctccctccccaccacccgcccaatgcaaagcttgttcgtgttcctccttcactgctgcatcctcacctcccaggtggcattgctgattggtgggagcaga

SEQ ID NO: 11525 - DNA, 1083 bp, Homo sapiens
gaacaaattggccagcaataagaccaagaagagaattagagtggggatgtataaaggtgatgggactccctcaggttgggcattccataagggccccctggaggaggtgacttactaggaatgagtttggatgctttcgaaggcctgcaaggataagtgtgtttgccatatagtgggcccaggggagggaggctttaggagagatgggccaggacctggcacacagggcttgtctgtcaagggaaggggtttgggtgcaaagccactagatgtttctacgtgtggtgggatttggctcctttttaaaagatcctctttgtagcaattgtgaatgggagtttactcttgattttgctctctgtttgtctattattggtgtataggaatgcttgtgatttttgcacattgattttgtatcctgagactttgctgaacttgcttatcagcttaaggagattttgggctgagactatagggttcagccataaaaaaggatgagttcatgtcctttgcagggacacggatgaagctggaaaccatcatcctcagcaaactaacaaacgaacagaaaaccaaacactgcatgtcctcactcataagtgggagttgaacaatgagaacacatggacacagggaggggaacatcacacactggggcctgttgtggggtggagggctaggggagggatagcattaggagaaatacctaatgtaggtgatgggttgaggggtgcaacaaaccaccatggcatgtgtatacctatgtaacaaacctgcatgttctgcacgtgtatcccagaacttaaagtataataataattaaaagaaaaaatcctcgtagctgctgcctggactcactgcagggtaggagggtccttgacatgaagaagaaaatgggcttgtcggtgcccctgctgtgtcccctcacctcctcaatggcaccttcgcccttcattgcttctagttcccttatattctccctgaccccatgtcaaggcccactctgaggatcattccagcttaagagccaaatgactgcagcagcttactttgcagctcttcgttttggggcaagattggcca

SEQ ID NO: 11526 - DNA, 1056 bp, Homo sapiens
ggtgtttgtcctaatactctccctccccttgcccccgacagcccgacaggccccagtgtctgatgttcccctccctgtgtccatgtgttctcattgttcaactctcacttatgagtaagaacatgtggtgattggttttctgttcctgtgttagtatgctgatgatgatggtttccagcttcatccatgtccctgcaaaggatacaaactcattcttttttatgactgcatagtattctatgatgtatatgtgccagattttctttatccaatctatcattgatgggcatttgggttggttccaagtctttgctattatgaatagtgctgcaataaacattcgtgtgcatgtgtccttatagtagaatgatttataatcctttgggtatataccaagtaatgggattgctgggtcaaatggtatttctgctttacatattttaacttactcgatgatatgtatatgatcaacactcaaatgggcccatgatgagatgcttagggggcattcatgaccaactcaggttgccaggcctctccactgggatttctgattgagtagctctaggtggggacccaggaatctgtgtttttcacaagtactcaggtaacccttatatacaggtgggtttgagaaacactgagtcatgatttctctgttcttgtttatgtttgctgagcaggtacagtgacatttgtgtctgtttgcatgcatgtggccattcgcttgaatttcgccttttctagcccgagtctccttacctgtacaatgggaattgtaataggatctacttcctgccatgtgtgaacattcagtgagatgaagtactcagagcatggtgtctgggatgtggtaagtggtcagtgttaccattgttattggttatggctgttatttagggacacgcaaagtatacaaagagagacttacacccccccgcaagagtgctacctgagtgaagtgacctttacccagttcactgctgagctatgctcaagctaatctcccttcgctggtttgtacaagcagatccggtgcccagaggaaaatggact

SEQ ID NO: 11527 - DNA, 1051 bp, Homo sapiens
gccacatatttcctagggaactctaaaaatgccagggagagaccctcctttcctgcccccctacccaaatcagaagtaaacagcatatggccgggcgcggtggctcacgcctgtaatcccagcactttgggaggccaaggcaggtggatcacctgaggtcaggagttcgagaccagcctggtcaatatggtgaaaccccgtctctactaaaaatacaaaaattagctggacgtagtggcaggcccctgtgaccccagctacttgggaggctgaggcaggagaattgcttgaacccgggaggcagaggttctagtgagctgagatcacgccactgcatgctagcctggataacagagagagactctaactcaaaaaaaaaaaaaaaaaaaaaaaaaggaaaagaagaagaagaagtaaatgacacaaacaaaggagacccagtgaaatgcctggaagtctttagaacttatgaagaaaacagagttgatagcaaccagattctattctaatgatccatgtcccatctgctggaaagaacttgcttccacagcaaaatctctgcatattctcttgagcaaggggagagggtccagaaaaacttgtagtttggggaactggccccacaaatactcgatctctgctcaagagaatgtggtggctgggccatctctgcattacctctcgggaccccctccttggcactgcagcctgtctctaaaatgcatactagagatgggtgtgcccaagactgcctttgaaagcgactccgaaaaatgtagcaccccaaaagatggagtatctgcgaatgacttgctggatttggctctcccgggacttcctctggcttccaggagtgatgtatacccgggttttctaccggtttggggagcatttattaatggtgctctgctgcttgttcgaggcaggtgctttttcactgccacagcctgccctgatggatggcacagcctcttccctggctgaggcggccccaatcagagctctctctcctcactccaggccttactcatcatagtagctactgtgtccc

SEQ ID NO: 11528 - DNA, 1030 bp, Homo sapiens
caacttatttttaaatagcatgttttatgttctaattatttactaataagcatgaagaacagataccacaaacaccaagataatcacctttggtatttgtgtgtgaacctttctggtctgttttctatgcttaaagctataatttacaaattcatattatgctatgcatactgtttgtattgttcttttttcagttggtagtatatcatgacctctttcttgcaataagtattattcacctaaaatatgattttaaaatactgtcttatattccatctctctcctagaaaaatcataatgtatttacccagtccccttttgttggacatttagattgttactgcttttgtgcttttataaatagcatcatgttgaatatttttgaacatgacatttgcccaggcatcgcagattactttctgaagacatttctaggtgtgcaactactggattaaaatgtgtgaaaaacacctttgcttttgatgtttgttgtttcagtcttactcttgaaaattctgtacaatttatactctaataatcagtgtttaagaatactcattttcccacactcttggctttcaaggttgactatcaccacacctacatataatcatgatttgggccccttctttctaatagttgtctttcatttatccatctgtctatccatccgtccgtccatccctttctcaatgtattggctgtaccttccagaatagtgttaaaaaataatggcgatacgtccctatttcttgtgcctgactttagtggaaatatctctagtgtttcaccagtaagtatgatgttgattattagagagatgttcccataatattaatgtgttgtgctcttcattttttaaatattaaagcagattatgaaataccttctgtcatattcaaagataattgctcatctcctttgatcagtatgattgaactatagtattaatttcctaatattaaccactttttattattagaacaaactcttcttagtcaacacttacaatttttaaaacacaccactg

SEQ ID NO: 11529 - DNA, 1047 bp, Homo sapiens
cctggccccccatgacctcttcgttgtctggattgtgcttccccatgcccacccccaggttgccctcatctgttttcaaccatctagtctcgagggtgcttccaggcaaccaagataggctgctgccctttgattctctcctgagcagtctctccattagtttgactgctggtcatgattagtgcagcgcctcacttgggttacaaagtctgttcaagccctagctgacacgtgtatcagcagtgtgaccttggacaagtcactaaaggctctgagccggttaccccccactctcaacccctgccttctaccagagtttcctccctgccctgctcaggccacgactgtgtaaaccaggggtcttccatctcatggctgcacatgagaatccacctttttttaaaaacaagcacccaagaatgattctactgcaggcaacaagcagaccccactccgagaagctgtgctcccacccggcctggctacagtcttttgtcacccggaagactgcagcccagccttgttcactctgtgcccagattatttctcttgcctctgttagagcctttaagtggctcttcattaatcttagaataaaatctagactttttaacatgccttatgagacctttcctgacttggcccccgcctttctctgcagcgcaaattctgaagccaaacagactaggttctagtcctagctctacctattgccggctctgtgaccttgggaaagtaacctaacctctctgtgcctcagtttcatcatctgtaaaatgataacaaataacagcaacaataataataataacagcaactgcagagggatgttgtaaggattagaatggttaatgcatgtaaagcattaacattgaatagtgcttggctcatagtaaatgccatataaagtcttaactctggttttcatcagtattattattatcttgctgcaaccctggatggatgtggacattccgtaagacaacctgctgtgggagaagaggtagggatcccaaccatttggggcagcttgttggaggaagtggc

SEQ ID NO: 11530 - DNA, 1052 bp, Homo sapiens
tgtttcctacttgttacactggggcaagccccatgcaggagccatctccacagagtccatacccaggaaaaatgatctgtatgctggaaggatacaggagggggatgtacctggaaaggtgcaaggcatgtgactggtgtatataactagatttgagcaaagcaaaacttcaacttggacacatcccagagatgagcaaagaggaagatatagcaagaccgagagaggctgggaagctggaaacaggagaacaggtgcaaagaactgatgggaaagccttcagaaccaagcctgtgcactgagcacgtatgcaggagctcccctgttaggcactttgtggtattgctgtgctacagctgtggctgcaggacttgaaggaaatgggcccaaccctgacattgttggcatctttgttcgctgattttttttttctgaatctaatgttgtgtttgtcttcatctaatgtttaaatttgtgacaattctgactatatgtgctgtatgccagacgtagatgaagattcctgaatgtaaatcttccatataattgtacttccacccctgctatttcatttcccctctgttattctcactctttaggggagagaagcaccaaagggttaggagacatctgtgccttctccatgcaccttgcaccagttcccattcagagccagctgccataccccagccaaatccaaacactcccccactttccagcctgcacccctccatctcctgacctcacaaggcctccatctcttggtgagatctgctttggttcttccttggtcgtgagctttacactcaccccctcgttggtagttgctctgccaccctacagccggccccagaaatcaacccctttccttggagggagggacttcaggattctcctgagaaggaattagacaagtaggcaggcaggggcacacgtggtcccctttccatctcaccagatactcagccctgaatattttgccagtgtccacggagtgagaggccctgaagtcctgacctgttcaaagagtccttccctatatagtaccaatg

SEQ ID NO: 11531 - DNA, 1032 bp, Homo sapiens
ttctggaggctggaagccccagatcaagctgctggcagggttgtcttcctccaaggccgctcttcttggcgtgcatggccaccctcttgccccactgtgcacacacaaccctggtgtctctcgtgtcctgatctcctcttcttctaaggacatcagtcagactggattagggccactctaatggcctcattttaacttcattacctcttcaaaggctctctctccaaatacaggcatatgctgagtactgggggttagggctgcaacataggaatttgggggaacacggttcagcccataacaacaggtagtttctctgaaccctggaacaaggcagtttagcatgtgagatgaattcctgagcccatggatgtcctcactcctaggttccatacctactccgcactctttaccacgtctccaacctcaccctcagcaactcttgatatcttttaatctactacctctggatatgcctgtggctcaagcatccaaccatgacctctttgtgggagggtcctatcttctgatctccccaaaactttctgtccctatcactaggaccttcatggtcttctctccatcttccctagtctacacactaggtacttcctaaggccccagcaactggcttttccaatagaatcgaagaatattagcattgggaagaactgaacaggctaatggtagccacctctgacctaccatctgcatttgtaagtaaagttgtattggaacccagccaagctccttcatttgtgtatcatctgtggctgttctcactgcaatgtcagagttgagtagtagcaacagagactgaccttatggcccacaaagcctaacatacttactagttagccttttacagaaaaggtttgctgagccctgaaatagatcatctgatgcaaacccaccccactttacaggtgaagacactgaaggccaaaacgttgatgggccagaggagccctccagtgagttacgggcagatccagggctgggattcagttctgcaaaatcccaaaccaggcc

SEQ ID NO: 11532 - DNA, 2053 bp, Homo sapiens
ggcattcacccacaaacacaggtcttacttgagcctggactttggaatgagacagatctgggttgaaattgaagtctaaggagctgagtgactgtagggccagatatgtaactcctctgagtctctgtttcctcatctataaaacagggacatgaaagcttaccttttggggttcctgagggtttaagcaagatacaggtgtgagctgaggagtcaggatgcctgggttgagtgccagctccatcacctacaagctgtgcgaccttgagcaaccgatacgcaacctcgatgccgcaatttttcttctgtaaaatgagcacaacagtccacagtttatgagattattttgaagatttaagtgagctattatatgtgaaatacttaacaaatgaaaagctgtctataaatgccagtcatgattatgatattaactatagtgtgttgggaaagctgtttgtaaatgtttactgtgcctttggttattgttattatctttgctctcttccaagacaactaatctgactgctggatggagccatagtgtaacccaaaccacaattcccaggggcccacacagcagaacggggctgcatcctctcatatttatccccacaacagccaaacacctcagtctgcaccttccaatggtgggcttcaggaatcttccatatgagcaaggaaaagtgacttttcctctcacacagctccccaggcagatggctgctgccttggagaggagccttggaatttgctctgttgcagattgccaacctgctggtgagacccagatgaatgagaacagaaacacatgcacagagaagtgagaagccactggagccacggcagagctctcacgaggccctgcaagtgacaggccacagggagggctgggatcagagggaccaggctctagaacaattggaaaaggacttggcagcaaggaaagacctgccctgggattggaggattgtgtggctgaaggatggtggtgggggggtgtccagatggcctgattaaatccctggagagaggatctgcaattataaaatcatagcaatgaattacgcattccatgtattaggcaattattatcatcacacaccgtgctaagtggttcaaaagaattatctcttttaaacctcattgcagatgtagacagtgaagactattatcatcttccctgttttgcagagggggagactgaggcttagagagtttttttcacctgcccaagatcccttagcaagtaagtactgggatgtgaattttggtcttaggcaccagcctctcctgcctctgtgagggcaaaggctttggattcagacactcagaccttcgcctcagtttccttgctggtagaattgcataatgatgatgatctcctcccaagagaggatccattgaagtggtgaaaattggctatttagcaccgtgtgtgaaacacaataagcacgtaataaagggtgtagtgtttctatgagtgatcatggttattggggctgctcgggccttttgtggtacaggatcccagagtcatagtatgaggaatccctttggaagcctgtgcttccaagcagcagcagcagcccagtgtttggcagcacatcactaagaactgggccatgcagagtgatcagcaggatggactatggagccagactgctgggttcaaatcctgactcctactcagctgtgtgacaatgagcaagttgattaacccctctgtgccccattttccttatctgtgaaataaatttaaaataatagtgccttcatcatagggttattatgaggattaaacaagttcgtatttgtaaaaagcttacaatatgcctgacaaataggaatgctatgtaagtatttgttaataaagcatgttaaataagattagtgttcccattttacatatgagaaagcaaaatgaaattaaagctgtgccaggttgcctggtgagtgagggcacagccaagggatgaacccgggcagcctggcctccgagcccagatcctcaggggtgggcttaacagagttacactggagtaaaactctcagg

SEQ ID NO: 11533 - DNA, 1051 bp, Homo sapiens
tttggagttttaagactaagaggtggagtagaatgagcatgatttttgaagtttcaggtagcgagagatcttatttgtaagaatctataaaatctatattttttaatatagagtctggattgatgtttgattcttatcttgatgacattgcttggcgttacattttacatttgtttgcaaactactttttaattcaaataatttgatgatttccttacacatattgtaatgaaatctttgctctcttacaggtagagctgagtaaagaagaagtaaaacgcctcattgctgaggcaaaggagaaattgcagtaagtttaggaccagatgaaatctatatcttaaatgatgatgaccatgtggtcttgttattagaaggtagcatttgggtgattctctttttctttctgtgctcatagagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccaggttagtttatccacttctgatggtttgtaattacaagctcaatatgttggatcatgtttgtggtgttccaaagctttactcttagattttattgttcttgacatcagtaagataatctggttgaagacttgggcagacagcatgattcctaaactagtttagaagataaactctaacccactaagatacaaatctaggatctaaaaaaaaaagtactgtgtattttattgcatatatcaggtttaataatctgtaacccacttgtgagtttttgtatgcagttataatgctatggtgtgcttgaacttatatccatataccttttcctcaactgcagtcagtcttctcacaatacagtagtccccccttatccacggttttgctttcttcggtttcagttagccacagtcaactgcagtctgaaaataagtgagtaaagtacagt

SEQ ID NO: 11534 - DNA, 1053 bp, Homo sapiens
aaagccctgtgtggtaggtataatgcccatcttagagatgaaaaaatgggtacagaaaggtacggttactaggaacattagtgccctgtaacatatttatagaggctcctaaaaaaggatgaggtctgtcagtcacaatggtaacacccattactgtgttattccccaggaatctaatgcagattattttgggacttctggagcatggggaattcaccagatgggtttgactacttccctttttcttctgagtatcttctaacatttgagggactaagtattctgccaaacagtttggggaaactacattttctttaagtgccagcctttatgtgggagcatggtttgccctttgattatgcagtacatttatgtttcttttgtttactgtatttcagagggacgcatttatagaaatactgtcaaatagattcttaccacatgttaggtaattttacgaaaagcaaaccaacagagatctctgcatttatgtttcctccctttaggtccaaacactgcagtttcatccatttgaagcacagactctgatttctggctcatatgataagtaagaaagcacagcaagaatgattgctactctgtttttatcctctagaagtcattttaagagtatcacttggtacccaggcagaatgtatccttgaggccacctttatgtttaaattatttgcactacttatttttccttttaactctggtcctttcagtctacaacggaacatgattctgtcataataatataactgtaggaactagcaacttctttggcttttagaggctgtactttgcctttatgggaagaatttccatgtcacatgacagagggcatggatatagggagacatgaagaactggggccactgtggtcaaccacggggtttatagctcatatcagtgctcctttttacagattgggtctacaggtaggagaaacagatagtagaagccaaaaccaactttgcagtctttattttcatttcttatcctcttgaagcatgatatgtttacatttcttgtgattcacgcagaatt

SEQ ID NO: 11535 - DNA, 1027 bp, Homo sapiens
actcttggctccttgcagatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccaggtaagacagactggccgtcttcctcaatgcttgttaactggatagacagacatagaatgtgtcatgtcctgtatgtggggcatcggggtattgtgaacaagtcagccctgagctcctagtatagacaaggtgatgtgactgagacagtgtcacaagtgtggtgatggggaagcataaagggctgtaggagcataccaggaaggctccctggaggaagtgacacctgagctgggacccagttgttaagtaggagtcatccagggtgaagggcatccaaggaaaaggactccaggcagagaccagaggttagttgtcataactgacataactgtcgtaagagagcctgggggcattcgaggaactaaaggaagttgaatgtgtggggctgatcctcaggtggccaagaggggccaggacaggagggctagggctagagcaggctccccacctccaccagttctctgtggtggggactgaaagtgcattgttagatggtggtggcatccctggcctctccccatgagatgcctgtagcactccctccacctcctcagttatgacaactaaccaggtctccagacgtcaccaaatgtcccctggggcgcacaatcaaaccactgggttaaaagagttaaagaacagtcccggga

SEQ ID NO: 11536 - DNA, 1053 bp, Homo sapiens
aggcatgattcagagccatgttccttcactcactgtgaccaagttgggctcttagtttcttctgctataaaaatgaaagtgatagtagaacctgcatctgtggggttgttttaaaaatgaggtaagattgtcacagggcctggcagagagtatgtacccttaaatattagtgtttgattaggggattttaaagcactggtaaagcaccttagcacttccatgacagtcctttataatctttccaggcacttttgtgaactcacgtatcgtgtaaaagcacagtgatgtattaagaaacttcaagaatacctttcaccagctgggcatggtggctcacacctgtaatcccagctctttggaaggctgaggcaggtggatttcttgagctcaggagttcgagaccagcctgggcaatgtagtgagaccctgtctctacaaaaaaatttaaaaattacctgggcatgtggtgtgcagctgtggtcccagctacttgggaggctgaggcaggaggatcacctgagcccggaaggtgaagattgtgttgagctgagatggcaccactgcactccagcctgggcactagagcaactagagcaagacactgtctcaaaaaaaaataaaaataaaaataagaaaaaaagaaagaatagctttcatgaatgatcctgagattgtaatgcttaatttgtagcagctaacatttattaagttcttactatgtactgtatgcattcacacttatttaatcctcacaacagccctatgaggtaggtcttatggattgtccccattgtacagatgaggaaactgaggcttagaaggtgaagtgatgccaaatgaaatagcaaagccaggattgaaccagaataaggtaatcccactttcttaaccaagtttggtgcatattctgttgactctgtcttggaaaacaaatatttatctgaaattcagctatcagctatgatactaagaaatgctgattattataaaacagggtcaatattaccaccagtgactcttcaccaagttaatgtttactgaactgaaatcaaa

SEQ ID NO: 11537 - DNA, 1030 bp, Homo sapiens
catgtagctctacctccttcacttttttttttttttttttttttttgagacggagtctcgctctgtcgcccaggctggagtgcggtggcatgatctcggctcactgcaagctccacctcctgggttcaagctagtctcctgcctcagccccccgagtagctgggattataggcgccatgcctggctaatatttttgtatttttagtagagacggggtttcaccgtgttagccaggatggtctcaatctcctgacctcgtgatccgcccgccttggcctcccaaagtgctgggattacaggcttgagccaccgcgcccagccttttttttcttttttgagtgtattggtcttatagtttgtcttctgtgaattgctagtttatatcctttgcctactttttaaattgtggcaaaatatccataacataaaatttaccattttcagcatatagttgagtagattaagtacagccacactgttgtgcagcagtcacggccatccctctctagaactcttcatcatcccgtactgaaactgtacccatgaaacagtaactcccactctcccctccccctagcccttggtaaccactgccctactttctctctctttgaatttgactcagacctcattaagtcatgagtttcctcatatttataagatgtacctcattaagcggactcatataatattcacccttttgtaactggcttatttcacttaatgtcttcagggttcatccatgttataccatgtatcagaatttcattcatttttaaggctgaataatattctttctatttttttttttaagacaaagtctcattctgtcacccaggctggagcgcagtggtgcgatcttagctcactgccacttccgccttccagattcaagtgattctcctgcctcagccttccgagtagctgggatgacaggcgtgcaccaccacacctggctaattttttgtatttttagtagagacggggttttaccacattggccaggctaatcttgaactcctgacttcaa

SEQ ID NO: 11538 - DNA, 1053 bp, Homo sapiens
aagaaatatgtttctattgcatttgatgaaagaatattcatagtatccagccagataggctaattgaggctacctttagaaacctgagctttgttaaaagttgatttttagtggtgtaatcaacgtagaaacttgtaaggtttaggggtggggtgagggtggtgaaagggattatagtaaggttttcagtctgttttttttttttctcccctacagcagcagtcagaaataactcccaaacaaattacctgccgcacaagaggtagctgttttccattgaaatataacacataagatgtggacttttaagatatgataataatttgcttgttttaaaaagatttttttctggtgacatacaggccagcttgaagtgtgatgtgcttgcaaaggaacttgtattttggaaatagctttaaatagattctcttggtgttcccttgcaccccagcccagctgacttttcttgaaactggcttatttgtacttcaaacaagggctttctttttacctttttgaattgatcctgggaagaacataatgagctgaatctgtcgtgtcctcagcatttccagtgctgccaaattctattgcatattaccacagtcatccttaggaggaaattgttgttttcttaagacttaaaaaataagattagcatattaattcctctgtgtagtaataggaacaaatattttttgagcccatgctgtttgccaggcattgcattatctcatttaagcctcataacaactctacaaagttgatgatactggagttaatgggataataactatcccaattttccgcacactgaggcttgtagagattaaaggcattcccaggtcaggtagtgaataagaagcacagccagagctgatccctgggctgcacaactccagagcccaggtttctcacttatgttctttccattaaaccccattctagccaaagaaaggcctagttattcagaacttgcttattctgtttatttcagaagattttatctcgctttatggaatgttcacttgtggtatccttcttttgacatct

SEQ ID NO: 11539 - DNA, 1097 bp, Homo sapiens
agctgggactacaggcgcccgccaccacgcccggctaattttttgtattttttagtagagacagggtttcaccgtgttagccaggatggtctcgatctcctgacctcgtgatccgcctgcctcagcctctcaaagtgctgggattacaggcatgagccactgtgcccagccagtgattgatttttctaatgttaaaccaacctttctgggataaaccccacttgatcatgatgctttattgtttttatatattattgaatttgatttgctaatatttcctaaaggatattagtatctgtgtttatgaggaatattgttcttacacttttcttctcttgtgatgtctttgtcaggctttgttataaggattatactagcctcataaaataggctggaaaatgttccttcctctgtttactgaaagattttgtttaatattggtattatttcttgcttgtttgctaaaatttgtcttttctttagctctatttctgctaattttttttaaactttgttattggatacaagcatatgtattatgatgagttaactcatcttgtcatgataaattgtccctcttcatctctgctaagactccttgacttgaagtctatttgaatgattcatttttaatctagctaatgtttatttggtcatttctttctgtcattttcggcctttgtatttaaagtgtgactttgtggacagcatataatgggtcttgcttttttaactagcttgacaatcttttagttggaatgcttagtccatttacatttaatgtaagtattgatgtgattagatttaggtctgccattttaccatttgttttctgtttgtcttacatattttcttgttcctctgttcccccttcactggcttctttcaggttaatggaatactttttagtattccattttaatacctttgttggccttttagctttactcttgtgtgtttgtgttggggggggagggtgtgtgtgagagattacgttatgcagttttaccttatcacattctatttagagttaatattatacttcatgtaaaatcctggaatattacaaaagtatagttctgttaccccagcctttg

SEQ ID NO: 11540 - DNA, 1056 bp, Homo sapiens
gaaccctctctcaactagcaatcagtggctgtgggtctccgatgacactgtccgcaaggccagcctgcaggaggtcctgtcctccagcgcctacctgctgttctacgagcgcgtcctttccaggatgcagcaccagagccaggagtgcaagtctgaagaatgactgtgccctcctgcaaggctagagctgatggcactgtctgcactgtccaggaaaaaagtaaaactgtactgttgcgtgtgcaagcggccccactagagccttccagccttctggtgtgttctaagagcaggctccacctgggagccagccccagttcacaccaaaccaggctccctgaacagtcctgttcatgtgtgtaggtggttctgttgtgttaagaaagcattcattatgtccggagtgtctttttactcatctgatacaggtaattaaaagaactcagattcttgaagccaccgttttcatattgtaatgttaggtgttctcagaggggaggtacctttgtctaatcaacgtttccacttagatcttttatttttaataagcaggcccataaaaattgttgacaagaattaatgaaattattaaaggcaacaatttagaagaaaaagtgcctttcactttcgattgcttttgtagcacgtccattgtgaaatattccttccaggctactcaaaggatagcaagagaacaggtaaatgatgcctaaagaacaccttcctttttctatgccttttctaatctttcaattctttctatggagtaaaggctcatctgccaaatctgccccctggggaaactctttcactactttgtcagttataagtgaagagcttacttgttgcttttatcttttgtatattggactgagatgtaattacactgtattataaaactctgtgaatagccagaactgagctggatctttgcaacacctgattcctctgctctgtggaaaactttttcttacacaaggatccactgtggacggttactttcatctgtttatttattgcccatgcagagctcttaaggtttacaggtgggagctt

SEQ ID NO: 11541 - DNA, 1135 bp, Homo sapiens
ctttatttaattaaaatgtctgctgacatcaagaacaactcatgtgccttacaaaaatgcagatggttaacatgcagagaggaaattcgatctttgagaaatgtctgtgttctagcagattgggggctgtttctcctgcaggtgtatgtaattgtatttcaatcatttgttcattcttccgttcatttgcctaagtttattataatgaatcattctataaacaactgttggatgatttacttttttcctgaacagtcttatccttttataggccctactccccacagcagccaaagtgaccttttaaaagcataacttcttctgctgtattttctgaaggttgttaaaaacaaaaacctcagccagagcgctggctcacccctgtaatcccagcactttgggaggctaaggtgggaggattgcttgagcccttgagtttgagagcagcctgggtaacataataagaccctgtctctacaaaaaataaaaataaaaaaattaactgggtatagtggcacgcacctgtagtctcagctactcaggaagctgaggtgggaggatcgcttcagcccagggggtctaggctgcagtgagctgtgattacaccgctgcattccagcctgggaaacagactgagactctgtctcaaataaaacaacataaacctaaaagcataactcaggtccgagcacagtggctcacgcctgtaatcccagcactttgggaggccaagatgggcgaatcacttgaggccaggagttttgagatcagcctgcccaatgtggtggaaccccatctctactaaaaatacctcccaaaaatttgccgggcatggtggcaggtgcctgtagtcccagctcttcaggaggctgaggcaggagaattgcttgaatccaggaggcggaggttgcagtaggctgagatcactccactgcactgcggcctgggcgacagagtgagactgtctcaaaaaaaaaaaaaaaaaagcaaaacaaaaaccaacataagtcaggtcttcaggtctttttgtgcttctccttaaaatgcatcagaggctgtgtgctgttcccaatattagcaacctcagcaccatcccctaagccttcctgccccaagctcttcacagacatggcct

SEQ ID NO: 11542 - DNA, 1050 bp, Homo sapiens
gcgcggtggctcatgcctgtaatcccagcactttgggaggccaagacagccggatcatgaggtcaggagatcgagaccatcctggctaacacggtgaaaccccgtctctactaaaaatacaaaaaaattagccgagcgtgggtggcaggcgcctgtagtcccagctactcgggaggctgaggcaggagaatggcgtgaacccgggaggtggagcttgcagtgagccgagaatcgtgccaccgcactccagcctggccgactgagcgagactctgtttcaaaaaaaaaaatgtatttttaaattaactaattaattaatttttatttatttattttgagacaagctgtcacccaggctggagtgcagcagtgcaatcatagctcacaacagccttgacctcctgggctcaagcgatcctatcacctcagcctcctatgtagctaggaccacagtcatgcgctaccactcccggctaatttttttgatttttttgtaaagacaaggtctcaccttgttgcccaggctgctcttgaacttctgagctcaaatgatactcacgcctcagcctcccaaagtgctgggattattggtgtgagccaccatgcctggccttaatttttttgttttgttttgtagatatggggtcttggctatattgcccaggcttgaactcctgggctccagtgatcctcccacctcagtgtcctttctaaaatcctttctctctctctcttttttttttttttttttttgagacggagtcttgctctgtcgcccaggctggagtgcagtggtgcgatctcggctcactgcaacctcctcttcccggattcaagctattctcatgcctcagcctcctgagtagctgggactaccggcgcgtgccaccatgcccagctagtttttgtatttttagtagagacagggtttcaccattttggccaggctggtctcgatctcttgacctcgtgatctgcctgcctcggcctcccaaagtgctgggattacaggcatgagccaccatgcccagccaatcctttctctttttaa

SEQ ID NO: 11543 - DNA, 1045 bp, Homo sapiens
cagtctatcattgatgggcatttgggttgattccatgtctttgatgttgtgaatagtgccgcagtgaacacacgtgtacatgtatctttataatagaatgatttatatttctttgggattgctgggtcaaatggtatttctgcctctagatctttgaggaatcgccacactgttttccacaatggttgaactaatttacactcccaccaacagtgtaaaagccttcctttttctccactgccttgccagcatctgttatttttttactttttaataatcgccattctgactggtgtgagatgatatctcattgtggtttggatttgcatttctgtaatgatcggtggtgttgagctttttttcatatgattgttggctgcatgtatgtcttctttttgcgaagtgtctgtttattttcctttgcccactttttaatgggattgttttttcttgtaagtttgtttaaattccttgtagactggatattagacctttgtcaggtggataggttgtagaacttttctcccattctgtaggttgcctgttcactctggtgatagtttcttttgctgtgcagaagctctttagtttaattagatcccatttgtcaatttttgcttttgttacaattgcttttggcattttcatcatgaaatctttgtggggcaggtattttatttcagtaggggagtgtggtatctctgccatccactgcatttagaataaaaccccaattcctcgtgggagcccacggagcctgtatgatctgagcctgctccatcttcgacatcctctcttgctagtctccattctgccctcactcgggcttcaaccacaatggcctctcatgcccctagcctgcctcatgtatcccttcagcctgaaatgcccttcctgcctactttgtttacagctggctcctcatccttcaagctctgctcaggtgtcacctccttaaagaagtcttcccggccaggcgcggtggctcacacctgtaatcccagcactttgggaggccgaggcaggcagatcgcctgaggtcagg

SEQ ID NO: 11544 - DNA, 1043 bp, Homo sapiens
ttgaagaggccctcacgcagtccagcagataacacaaatgccccacatccccacaggtctccggggatttaggatgggcaggcagacagaattccagaagttgattctgggagaatcagttcagttttcccagaagtgcctcatgggcaaagcagtttctgccaagctataaaacggctcacgctggcccctcctacagaggaaaaccagtgtctcatcattgtgcaggtgctgccccacaaaacaggtgtgtttgtgcctttggataacctgtcaccaaacctacagttccttaccatgtgcctgcccttttgtgcagctgcatacaggccccagagccaagcagaagaaatgtaacccttgcccaggagtggatgtgaccacgaccatgcttctcttaaatgtaaagcaagcagagcatccaggggtttcctgtgtcctccgcccctccccgctcgcaggagcgggaaagcttccctccctcctttcacccacctgaatttgcagcgggcagacctgagccggcctaaattgggatgcacagatacttctgtgtctgtccccttattcttaaaacaggactaaccacagccccgacacacagcatccgtagagtgattggatgaggttgcattcagggaatgctcgtcacagtgtggaaacacaaaaatgcttcctgcattgatgctgctatggtttttataaataaaacatgttagaataggaatagatcttgttaatactctttttaaaactttttttgatgcccgacacacataaactgtctttggatggtctcaggaatctcagaaccatttataacagacccaaaccctcaaattgcccctgagttttggaggacagcttgatgatgtaagtgacaagcccctgtatcccctagagaagggagaacattcttggctactgttgagttaaagtgaatggtttcttgggacactcctgtgcaagtttatcacttagatttccaggctggtcagatgcctctctccaggcacgagctagcacatttgcaggaataacgc

SEQ ID NO: 11545 - DNA, 1045 bp, Homo sapiens
tgctattgctaacttcatgggtgcattcaacaactacttgtcaactgcctgctttgggtcagacagatcctaacattgttttttcatcattgcaaccccatccactgccatttgcataattctagtgtagaggttgtgacctggtactttgggtgtgatcaggcctgtgtgtgaatcccagctccacttctgctggacgtgtggcctcgctagagtgtcttaagaatgctcagattagacgggcgcagtggctcacctgtagtattagcactttgggaggccaaggcaggtggattgcttgagtccaggagttcgagaccaggctgggcaatgtggtgaaactctgtctctacaaaaaatacaaaagttagccagacatgacggtacatatcggtagtcccagctactcgagaggctgaggcaggaggatcacttgagcccaggaggtcaagtttgtagcctgggcgacagaatgagaccttgtctcacacacacacaaaaaatgcttggagtctcatgggtgacacgcaagcacaatgtctggtgtgctatgagcttagggaaccaaagagcccaggctccccctggacacagtccacctggcctggtgaatatgggctgttagccatctggctgcccttgcagaatgagaggatcgggtggcccctagctgccgtggctgtgcagcagccgtcagtgaagggacaggagaggggcgtgcggtctccatgtcaccacagtccctccccgcgccccgcactctgtagtcattgcctggtgtctcccggtcccccgtgggcattcgagtctgtagcccctgtgctgagtggaagctgccactaaagcaagccttttacaaatgattcttttcacttgatcctcacacccacctccctgtgaagtaggtgtcttatccctattttacagatgtaaaaactgaggcctgaagagagacttcccccaaggttatccagctagtgagtggccgagccaggggtccagccgacggactggtctgtccctttattcaacagatctgtcatga

SEQ ID NO: 11546 - DNA, 1077 bp, Homo sapiens
ggccactagggggcagctggcggccttccctgctgttgtcttcctgcagggtgagaggagcaggagccgagctccacccccacgccagccttgggcccggcctgggatcactgctgggaacgtgagagtgaagggaggacgcctaccccagcttaacttgtagaaatggccccagatcactgatggctgttccctgccccttcccttcaaaacacaacgcataaagcagtaatactaattaatactgaacgctcactgtggactaggcgtgtttacgcatcgccccttctcatctctgccccgacctcagtgtcattgctagtctcatccccgctttacagaccaggaaaccaaaggtcagagagatcgagtaactggtgcaagtccacacagctcatcagcatctgaggccggattcaaatggactccagagcctgctcttagcccctacgtgtgtctgctgggtgcggctctgtgtgcaggctcactgcgattttttagctttctgtgctcaggctcgtttttctggattcggatgtatttgaccggggtggggctcggacctgcatgttttcctccccacgcgattttaatgaacaaccaggccagaggctgctgtgccctcagtgatggcgctggctgacagccagcctccagcctttaggaggtgggcctgggagcctccccaggcttccatagatgtccgcggcagctgtgagatgggtgcaggggacagaggctgagacccccagagcccgtctgctccttgaggccctctctctctcattccctggggacaggatgtcactcctggggcaggggccagctcaacactcttgctccagtgaagcagctgccggtgcgctttggccagagcaacctttcaacccagccacccctgcggccaccatatgggcctggtgtcacactcctggctaccttgtagacagttggcacttgcggctgtcaccccttctcattgcctattgcagtggttctcgctctcagagctgcacctcggaaccacctaaggacccacgaattcctgactccaccccagatattctgagttaatct

SEQ ID NO: 11547 - DNA, 1065 bp, Homo sapiens
caggcatgtgccaccacgcgcggctaattttgtatttttagtagagacggggtttctccatgttggtcaggctggtctcgaactcccgacctctagtgatccacccgcctcggcctctcaaagtgttgggattacaggcatgagccactgcacccggcccatagttttcttttataatcctttttatttctgtagagttgctaatattccatctttaattcctgattttagtaagttaagtcttctctcttttttccctggtctatctaactaaatgttcgtcaatgttgttgacattttccaagaaccaacttttggttttgttgattttctctgttgttttctcttctctattttactcattccccctctactctttatgcacttattgttttaaaatcacactgtcatcataatacaattacagcattttttttcgactgcctcttcagatgagagagatgcaggaaggtctgaagagttacaattatccaagaaatgtgtgctgctctgtggcttatccataggtgctcctctgtggtccgaagtagaaaaaaagttaacatcgtaatgtatttggcttttattttgtacatcatctctaactgttgcccaggagtttgagtgttttttgtttgttgttttgttttgttttgtttttgagacggagtctcgctctgtcacccaggctggaatgcaatggcacaatctcagctcactgcaacctccgcctcccaggttcaagcgattctcctgcctcagcttcccgagtagctgggacaatataggcactcaccacctcgcctggctaatttttgtatttttagtagagatagggtttcaccattttggtcaagttggtctcgaactcctgacctcaggtgatccacccacctcggcctcccgaagtgctgggattacaggcatgagccaccgcgcctggctgagtttgagtgttaatccttactctgcgcttttagttttgctctggggtgtgaattgtagtaagtagtttcccctttcccatgataaacatttttacacacctcccctgtggcaggtagt

SEQ ID NO: 11548 - DNA, 1050 bp, Homo sapiens
ataaataaaggaattcatttggtaagtactatttattatctgttatgtattaggcactgtgccagacacagaggatacaacgtagagttgcttagagcaagatacttgcaggtcctgccctcatcaagcttaaggaatagtggggaaaacaaatactgaactgaagtttaaaatgatggcaaacattacacataactgaataggccctgcaaataagtaacaggagtttaacctggttagggatgaagacaggaagatgggggttgggaagttttataataaaactaaattattaagttattatataatatataattattatataaagttttctaataaaacgaaattattatatacgtgtgacatgttgggaagtagagaagaaaaaatgtgaatatattgagtttatacagatgtatgatatttagctactacttttctactcattagattacatattgtgttttttttacagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactggtaatacagtattatcttgggctactataaatacaaatgccaggaggtttatgggttacagctttatactgaagtcattgtttttactggaaaaatgataaaagtattacttttctctgattaattacagacatgacatataagttgattcatttatttttaatgtagcagtaagcactggcttttgtgtgtgtgctgacttcggggttattaatagaaaaacttgaattccaagtaggttttttcttttggttagttagttaatatgagtaaaattatcataccaagagagtgactgtaaaatatttttttatcatggcctgctgggcagaaatttctaagcagccacttccaagaagctttggaaagaaatatccagggaagtgctgtgtggaagtctgcctccaggcttattccttatgtgt

SEQ ID NO: 11549 - DNA, 1050 bp, Homo sapiens
tatatttatttatttacttatttacatattgcttatttattcccactagtagtaagctctgtgagggaagggattttttttttcctgttctattcactgccgtatacctggtgcctagaactgtgattggcacatttacatatataataaatattggatgagtgaacatatcatttgagaattcattctttcatcaaatgtttattgaatgtaccctatgttttaggttctgtgctgagtacataacattattataaagtctacgattagaaatacttcctatgtacctgaagataccataggtttataatatacaaaggcatgtaattgaatgaaataataattgaagtcaatgaagattgtcctttaggattctaaactaattaattctatttacaattttttgttatgtatgaaatttgtacatttcttatgggagccagcaagattttgacatgttttgtggcctttttattttttacttatagcaaactatggaggagaaaaagggtatatctggatatagttacacccaagaagagctagaaagagtatctgcactgaagagtgaagttgatgaaatgaaaggacgaacattggatgatatgtctgaaatggtgatgatacttttatttaaattttcttttattgtgtagctagaaggcaggtgttttgtgttagttttattttcagtgaaacattcacctgttaatttctgcacattacattctttcatcttttttttttttttctttttgaggcagagtctcactctattgcccaggctagagtgcagtggcatgaatttggctcactgtaacatccacctctggggttcaagtgattctcatgcctcagcctcccaagtagctgggactacaggtgtgtgccaccatgcccggctaatttttgtatttttagtagagacagggtttcaccatgttgggcaggctggtctctacctcccgacctcaagtgatccacctgcctcagcctcccaaagtgctgggattacaggcgtgagccactacacccggtctcatctgtctt

SEQ ID NO: 11550 - DNA, 1060 bp, Homo sapiens
tgctatttggactatactgtagtattttgaatatcactccatctatatttatgtatattttatatgcctacataaataatacatcatgattatagttgtatagggcaattttttaatatatttattcaatgttaaattataaagattttcccgtaatggtttacagtcttgagaactgacgttttgaatgattaaatagtatagtattccatcttgctgaggaatcaggattttctaaagcacttctctgttgtttgggactgaagtaatttgcagttttttgctcttacatttaacactgaaattaatatctttatgcatgtagtatttttctttttttgaattcttttttaggtgttatattttttgttcaaataacaggtgaaaaaactgtattcattggtatctgaaaagaagtcagctcttgcctcagttataaaagagctacgacagttgcgtcaaaaatatcaagtaagtttttgattttatcaagtaatttgattttatgatacttttagtattctatcttattcacatgtgctagttagaaccctggatattttacttgggtaatatagaaaacaaattatcattattacgttattgatacaattcttcaaaagagaattaaaacatgacatacaggccaggtgtggtggcttatgcctgtaatcccagcactttgggaggttgagacaggaggatgatcacttgagcccaggaattcgagaccagcctgtctaacaacaagaccttgtctctacaaaaaataaaaaaattagctgagcttggtggcatgcacctgtagccccagattctcgggatgctgaggtgggaggattgcttgaacccagaaggtcaggattgcagtgagccatgatcatgccactgtactccagcttgggtgacagagtgagaccctgtctcccacccctccccccaaaaatgacttgcaagggtttttgtttaatttatgctgcttatttagccataaataattggaggcagaggagatggagaaaaagcagtttaagctgaaatgcacaaattcagccagagg

SEQ ID NO: 11551 - DNA, 1053 bp, Homo sapiens
agagttaagttacaagactgacaagggcatgcattgtttcagagccatgtttgggacctttgtttttcacttattcaatcattttccctttttatactaggaactgacccaggagtgtgatgaaaagaaatcccagtatgatagctgtgcagcaggcctcgaaagcaatcggtccaaattagaacaggtaagaagagagtttttattttaacaatttagcaaaaactacctgtgtgtacacctgtagtcccagctactctggaggctgaagcaggaggattgcttgagcctaggagtttgaggctacagtgagctatgatcacaccactgcattctagcctgggccacagagcaagactctctctctaaaaaaaatgttttaaatactgcccgtgtacgcacattttcactacatcaatgtcaaaagattcccaaatctttatcatcatctcctaagctccagagatctttatttctttaatttgtacacacttaatttcccatctgtaccactcccagcaaagtacaaggctcattatctgctgcctggcctcccacagtaaactcttacctattctcttgcttctactcttgctctcctaaggtttattcttcatagggaagcctaagaaacctgtttaaaatttttgccacccttcattggcttcctgttgcacttaaaataaaatctaaccaccaaactatggtctacaaggccccacctgccttatgaacttcatgtccatgtgctctactcctcatccatggagcttcagccactctgaccttcttcctgagctttaaacaggccaagcttgttttcactttgggattttgcatgtactcttcccttctgcgtgatatactctgctcctaactcttcgccctcccttctccttttcatcactaggtctcagccttagtgtcactgcctttcagagatctctgatcacctgatgttacccactcttcttcccaacctggcccacccagtccctctatcacattctactgatggatttccttcatagcgcttatccccatctcaaatat

SEQ ID NO: 11552 - DNA, 1038 bp, Homo sapiens
ttgaactcgggaggtagaggttgcagtgagctgagatcctgccattgcactccagcctggggaacaagagcgaaactctgtctcaaaataataataataataataataagtcaggtaggaaaaatgtgcagagtccagcttatggagagctttgtagctaggataaggaaattggattttatttttatttatttatttatttatttattttttgagaagaagtctcactctgtcacccaggctggagtgcagtggtgtgatctcagctcattgcaacctccgcctcccaggttcaagtgattctcctgcctcagcctcccgcatagctgggattacaggcatgcaccaccacgccagctaatttttgtatttttagtagagacagagtttcaccatgttggccaggctggtcttgaactcctgacctcacgtgagccaactgcctgggcctcccaaagtgctactgagaagaccttgaaagctattaagcaaggaaggtgacatgaactgatctgaattttaaaagatcactaactttgagtagaaaatggatggtgtaggggtcgtagaatggaagtaggcaggtcagttgaggaggtcattgtagagagatgttagatgatgatggcttagactaggacaattgaagtagaaatagagagaagtggacagctacatggtgttttttgtggaaatagagtcaataagactttctgcagggttggggggagtcacagaaagggctatcagcaatgactttcagattttttcatgaattgagttagaaaagattaagggagaagcagacttaggtagggcaggtcaaatgaagagttctgctttgtccatgttaagtacccgttagacatccaagaggaattgtcaggtaggagctacatttatgagtctggcattccagagagaggtcagggctggagataaagataaataaagattttggaatcaataacgtataggtctcaccacccctttccactcacacctccatccctctgtgctctcttgcgtttcccccaa

SEQ ID NO: 11553 - DNA, 1774 bp, Homo sapiens
cgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacggtaggtgcagggcgctccgctgcaggggcccggcgcggccgggagagccagggaagatggctgaccgggctccacctcgtgggcttcggctccgcgcccgccgacagctgcgggcggagggtcgggccagcgcgccggccccgcgggagagaaaggggctgcggtcctcgcctcgccttccctggacctcttcgcttctcgggccctcgaccttttcggcgcgcaaggctcggaggcttctctccagcagcagccggccccggtggagggagggacgtggcttctgcagctaggttgagcccggcaagacgttttctcgtcccctgccgatttatgaggagtcgaggtcgttggaaggcctctgaccgttcttgtcctacccaaagttacacatctggcagaagtgatgacatcgctgaaaccactcctaggttcaggagcccgaagtgatttcacgcttagggctagacctcaggccattgattacaaagagtgcatgcttccttgagatatcttcgtggtatgccctctgctaaaaaaatcggatattcttatagctaggtctgtgttttaaagatattgatgcttagaattgtagcagttctttttagaaaaacgaagtgctaaaatgtctctctctttttttttttaacctccctcttgacacattgcttgacgaatttctacattctacagagttaccggctgaagaaggtaatcttaacatgctgtttctgttttttttcctctgttggtgtgctgatggtaagatgacagttaaaacacatgtgtttgtttcttacaggaaaaaccttgctggaacttgtgattgagcagtttgaagacttgctagttaggattttattactggcagcatgtatatcttttgtaagtataaaaaaatttattttctttccccccaaaagctgaaagtattccatagataaatcagaaaacaaatgatgtccattgggtgaaaacatatttggagttgcaagctgtgtctctatgtttaaaaacaatctgggcattttaaaattacaaaacaaaacacttgaagccattggtattcagaaaatagatgcctgacatttacagtgtggttaggagttgtcccagagtgtggcatggtcttagaaattcttgtggtttatcagcttttaatatcaaaaagttcttttctgggaagcctttaatgttttgggttcttcca

SEQ ID NO: 11554 - DNA, 1035 bp, Homo sapiens
gcttacccacttgagtgctatatggttgctaagaaactagtgaaatgcaaagaactacagcagaaaaagggtgttggggtggcaagtatatttctaggtttttaacttttttttaaatgttcggtattaattttttgttgcattttttttcttgggcagtagattgcttgctagttttcctaaaaatggtcaggaataggacacagatgttcctaattctaatagcatgagatgccttttattcttgaattacgttattcttacaaaaaccacgataagtgaaattcacccagtgcagtacttctttctagttaaaacaaaattgacaaaacttcacggtttcagttcttgtacatatatgtatgcaggtcccagggatcagcctcagtctttgtgagaaccataccatagagggctattttgagaacgaaataaacaaagcagtgggcatttatttagttcagatgaggaaaagattaaatttatacccatcttttaagtagatagtggcagcagtaaataaatttgtggaataatttttacataaatcctgctatgatactttattatgccatattagccaagtattgtgtagccattaataattcagtccccaagaaccttttctgtggttttcattgattaaaatggggacttacatagcaaaccattcagcattctgagtcagtcacaatgtacctctgataaaatgtttcttcttgattgattaaaaaattttcccccagaaaatggctgctgttttaccaattaagggaaatgagtagacccgattaactatagtttatcaatacattgtcatggggcaaaataaatgatacatttggagctagtgtaagatttgtatttaactgggtacataatagcgttggcagttaaataatggggtccgataaggtcattgggaacttcttaaaaattaatcagctgactacaagccagaagcaaaatacatttttactgaattctctgtgttacaagttgaagcagtgtgggaaaccatgccactggtgttac

SEQ ID NO: 11555 - DNA, 1607 bp, Homo sapiens
actgtggtacttctcaacctttaggttacatttgaccatttgcatgtgtgtgtctcttttcttcctactagacccccttgagttagtgcttttttttttttttttttttaaatgtagatggagtctcactcttgttgcccgggctggagcgcagtggtgcaatctcggctcactgcaacctccacctcctgggttcaagtgattctcctgcctcagcctcctgagtagctgggattacagatgtccaccaccacgcccggctaatttttgtatttttagtagagatggggtttacctttgttggccaggctggtctcgaactcctgacctcaggttatcacctgcctcagcctcccaaagtgctgggattacaggcatgaaccactgcgcctggcctaagttagtgcttttgatgtcacaaaaacttgggtgagtttgtttcagtagaattttctgaaaatacatgagatctttttactgtagtttctcagaagagaatactcaaagcatttgatactggatttgtagtgattttaattttcttctgtatcttttaatttttgattttaaaaatgggataagaagggcaaattactgattggtttaactagtttattcagagcttttcttaaaataatgacttgaaaggtggatttaatagagtactttttaaaaagattgttttctcatgcctgaaagcattgaatgtttttacatagctttatatctggatcagaagggaacgagttctaattcatgcttttttttccgttttattaatgactgaaagtcctcccccagaaattatcgtaacgtttattggtaattctctgtatcattctcgaaatgtttaatttccatttcctctttatttaaaaaaaaaaaaaaacttgatgtaaatttcttcatttattgagcaattgtttgagggcccaaaggcacagtgcaagtttctgagaatactaggagcaaaatgtgcttatgatctttttaagcacttttttctttcgttttctttttatgatactaagagctcttcctattatcacagtgtatagatatctgagtcacaatatcatgactgtctcccagtttacagcagaacgtgctttttaccttggattaaaatttgctttatttggccgggtgcagtgagtggctcatgcctgtaatcccagcactttgagaggccgaggtgggtggatcatttgaggtcaggagttcgagaccagcctggccaacatggtgaaaccccacctgtactaaaaatacaaaaattagccaggcgtggtggtgggtccctgtaatcccagctactcaggaggctgaggcaggagaatcgcttgaacccgggaggcggatgttgcagtgagccgagattgcgccactgcactccagcctgagtgacaaagtgagactccgtctcaaaaaaaaattttttttttgctttagtatacttatcagaagtataatgcagtacagagtgttgtacagtatttcagtgctgtacagagattaatcttgtggataataattgggagatactctatccctactctatttttaacagtttaatgtagttgagtgttcattagcaagtggttact

SEQ ID NO: 11556 - DNA, 1049 bp, Homo sapiens
cttatgaacaagacatagccagttgtttatataattgcattttctaccgtttatttctagagaaagaaaatagattttgtctatcataatccctttagtgctagccacttttttttttttttttttttgagttttcgctcttgctgcccaggctggagtgcaatggcatgcagtacactcacggctcactgcaacctttgcctccccaggttcaagtgattctcttgcctcagcctcctgagtagctgggattacaggcacctaccaccatgtccagctaattttttgtatttttagtagagatggggtttcgccatgttgggcaggttggtctggaactcttgacctcaggtgatcgcctgccttggcctcccaaagtgctgggattacaggcctgagccaccatgctcggccagtgctagccactttttaaaaaagtgacattaagcctaaaaagacacattctaacgtgccatttctcttctaggttttggcttggtttgaagaaggtgaagaaacaattacagcctttgtagaaccttttgtaattttactcatattagtagccaatgcaattgtgggtgtatggcaggtaagcaaaaattcctgtactgcaaaatttcaataagttatgtaagtgattagggctgtattaatctttctgttatctgtttttcctgatgtgttgagtaaaaatatgtttgcgggaagtttacatgtattttccctttattccataaattaattgttttctgacacagtctcactctgttgcccaggctggagtgcaatggtgttgtctcggctcactgcaacctcttcctcccaggttcaagtggttctcgtgcctcagcctcccaagtagctgggactacaggcacgcaccaccacgcccagctcatttttgtattttttggtaagagacagggtttcaccatgttggccaggctggtcttgagctcctgacctcaagtgatccgccctcctcagcctcccaaagtgctgggattacagacgtgagccaccatgcccggcctattaatttaatt

SEQ ID NO: 11557 - DNA, 1049 bp, Homo sapiens
gtctctttctgttgcccaggctggagtgcagtggcaggatctcgtctcactgcagcctccgcctctcgggttcaagcgattcttctgcctcagcctcctgagcccagactattaagctgtactgcctctcatgagacagaattgattttaaatggcagggggatttggctaaaggtgaaagctgtgttttacagtcttagggacagcagagtctgtaattgcttttcctcattgttttatccccttagcttaattgagggtacttaacgtttcgtttttaatacaaattaataaatgtccttgtgtctgttgccttagatgtgaattgtttagtacaaatgttactggtgggcttcctttctttttaaagattagacctctaacattttattccttgggttagaaataattgcagtgtcaggcaggtctttactactcttctgttttcttttatacaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctggtgagttgagtttgtcatttttcttttattctagatagtatttctgaatgtagtccttttctcaaggctcataattatatttaaaataattgttttcatgtatcaattaacacattttattgccattcatacaaatcctacattctctaaaattattttgaaatgttttagcacctcccttcctgtcattgataaggcttttggtttttgtttttaaacaaggtattttgaattctacttgtttaaatacattgtagaacacaagtgctagagaggtaaaacctaatgttgatttgacagttagttatagtgaacaatttgttagaatactggctaatgacgacacagtttttcctgttttgtttcttggcaccaaagttcatggtcaagggtaatttcttgactctgaaagctatgcttggccaggcttggtagctcacgcctgtaatccc

SEQ ID NO: 11558 - DNA, 1038 bp, Homo sapiens
aggcatgagccaccatgtacctggctaagttttgtattttttttgtagagatgggtcttgccatgttgctcaggcttgtctctcaaactcctgggctcaggcagtcctgcctcagcctcccaagtagctgggattacaggcatgcgccatcatgcccagctaattttgtatttttagtagatgtggggtttctccatgttggtcaggctgatctcgaactcccgacctcaggtggtccgcccgcctcagcctcccaaagtgctgggattacaggagtgagccaccacgcacggcctaaagcagctccttccgtcagtctgtccgtccgtctgtccttccttccttcctccccctttccctcccctcccctcccctcccctcccctccttctgtcctccctcttttccttctttctcgctctctcttttttttttttttttttttaacttggagacaggggcttgctctcttgtccaggctacagtggagtagtgtgatcactgcgacctcgaactccttggcttcaagggggtcctcctgcctcagcctcctgagtagctggtaatacaggcacatgacaccatgcccagcttttttttttttttttttttaaagacggaatcttgaactgtcgcccaggctggagtgcagtggcacgattgcggcccactgcaagcttcgcctcccaggtttacgccattctcctgcctcagcctccccagtagctgtgactgcaggtgcccaccaacactcccagctaattttttgtatttttagtagagacagggtttcactgtgttagccaggatgacctcgtgatcctcccgcctcagcctcccaaagtgctgggattacttacaggtgtgagccaccatgcccggcctttttttttttttttttttaaagtaaagatggggtcttgctttgttgtccaggctggtcttgaacttctgggctcaagcgatcctcctcctcctgccttggccttccaaagtgttgtaattacaggtgtgagccactgtacctggctcaaagcaa

SEQ ID NO: 11559 - DNA, 1054 bp, Homo sapiens
cacccagctgatttttgtagttgtagtagagatggggttttgccatattggccaggctggtctcaaactcctggcctcgtgacccactcacctcggcctcccaaagtgctgggattacaggcgtgagccaccgtgcctggcctattattattttagttaagcccagctgtgtgagacattgggctcttaagtgctgcttgctttcgtcttaaattgtgacctttttaactgagtaatgcagaacagacatctaggtttagaatgtatgtgggcattttattaaatactgttgtcatactactaggcagtgagcaccttaaggacagaactgtcatattgactgttgtaacgttatcgtaagttctctatgaatgaaatttgaaatcagaagtatatgataggctcagctaatgtaaacatagttgctgtgcagaacaaacagttgaagtgtatgtgtgtgttcaatacaattattattataatattatacagacagagtcttgttctgtcacccaggctctagtgcagtggtgtgatctcggctcactgcaacctgtgtacctcccagtttcaagtgattctcctgcttcagtctcccgagtagctgggattacaggcttgggccattatgcctggcttgcttgcttttttgtttgtttgtttgtttgtttgttttgagacgagtctcgctctgttgccaggctggagtgcagtggcatgatcttggctcactgcaacctccgactccctggttcaagcgattctcctgcctcagcctcccgagtagctgagattataggcacgtaccaccacgcccagctaatttttgtattttttagtagagacggggtttcaccgtgttggccaggatggtctcaagcccctgacctcgtgatccatcctcctcggcctcccaaagtgctgggattgattacaggcatgagccaccgcgcccagccacgcctggctaatatttttgtatttttagtagaggcagagtttggccatgttggcccggcaagtcttgaatttctggcctcaagcgatccacctg

SEQ ID NO: 11560 - DNA, 1047 bp, Homo sapiens
tgatgtctaagaaactgttgccaattgaaggtcacaaagactttatatattagccagtatatatgatccaggcgtcgtggctcatacctatatgatcccagcactttgggaggctgaggcaggaaaaaccacttttttttttctttttgagacggagtcttgctctgttgtccaggctggagtgcagcgagtggcatgatctcggctcagtgcaacctccgcctcctgggttcaagcgattctcccgcctcagtctcccgagtagctgggattacaggtgcacaccaccacactcagctaatttttgtatttttagtagaaacggggtttcaccgttttggccaggctggtcttgaactcctgacttcaaatgatccgcctgcctcagcctctcaaagtgctgcgattataggcaagagccaccatgcccagcctaggaaaaaaacacttttaaattagccaggcaaggtggtacaggcctgtagtctcactactcaggaggcagaggtacgaagatgacttgagcccaagagtggaggctgcagtgagctactatgatcctgccactgtcctccaccctaggcaacaaagcaagaccttgcctctttaaaaacagcaacaacagcaaaaactatggtgtgaggtaggagatccagctgctttcttttgcatgtggatatttagttgtctcagcaccatttgttgaaaagatttcttcactaatttgtcctgcaacctttgtgaaaaattaatttacaaatgcaagaatgtatttctagactctattcttactccattgatctctgtctttaggtcagtaccatactgtcttgatagctagctgtcgttttgtattttttgaaattgggaacttgggagtgtaactttgttcaagataattttgggcattctgggttccttacatttacatataaatttttaagagttgcttgtcaatttctgcagaaagcaagctggtattttcagtaagaattgtgttgtatctatagatgagtttgggaaatatggtcgtaatatcaagtcttt

SEQ ID NO: 11561 - DNA, 1050 bp, Homo sapiens
tcattgtggttttgatttgcatctctctactagtgatgttgagcattttttcctatgttgactacttgattgttgtcttttgagaagtgtcttttcataccctttgcccacttttcaacagtgattttgtgtgtgtgtttgtgtgtggatttaagttccttatagattctggatattagtcctttgttgagtgcatagtttgcaattattttctccaattctgtaggttgtcagtttactctgttgatagatttcttctgctgtgcagaaactctttcgtttaactaggtcccaattgtcaagttatttgttgcatttgcttttgaggcttagtcataaattctttgcttagggcagtgttgagaagagtatttcctaggttttcttctaggatatttacagtttgaggccttacatttaagtctttaatttgccttgagttaggaattcttttttcaatttcattttcagattgttctttgctagcgtgtagaaatagttttttacgtattgatcttgtagtttgccatcttgctgaactcattagttagttttaatagtttttatgggttccttaagattttctatatacaagatcatgcatttgcaaatgaaaatgtttttacttctttctagtctggatgccctttatttcttgcctaattgccctggttagaatctccaatacaacgttgaagtaccaagagcagacatccttgtcttactgatcgtaggggaaagcatccagtccttcacagtgaagtgtgacataggtgtgggtctcataggcgggtgccctttatcatgttgaggaagcctagttacagctgtaatatttaggttgtcagtatactctggtgacctttcatggtgtttgtaaacttatatgcaaatcagaaatgatagtttgctgggttactaggaccagcaggtcattgaattgggtaagatataattctaaggcatttgcaactattatatggaacattttggaaaagcataccgtgactgtataacctgggccagataaataggtatttattttattaa

SEQ ID NO: 11562 - DNA, 1070 bp, Homo sapiens
aaccccgtatctacaaaaaatacaaaaattagccaggcctgtaatcccagctactcaggaggctgggtgaaaagatcacttgtgcctaggtcaaggctacagtgagccatgcttgtgcctctgcactccagcctgggggacagagcaagactctgtctccaaaaaaaagttgtaatttgttcgttaccataggtaaatcttaaggttgaattgttgtctgttttgtggaaagcaaattacttattcgatgtcctttttccaggcaagaaaaatagactccagtgctgtaatttttttcactggaggagtgctaatgttgtatcaatctttacagtatccaaatacacaatgaacaaaagttagcccccataagagatgaaaattgtactacctggaatttgcacaattgtttgaaacattttcccgtttttgtgtgataaaagcacaatctagggtggagggttcatactaactggaagtaagtttgtcagaagaattaactttaaatacaatgctaacttggattaaatagtaaacataaagtctaaaggctctcaagatttatctgattatcaattttgaaaagcagctaatgtcatggagacagttatatgagtaacctggctctattttttttggtattgtttctttataaatagcttacttattaaaattctcattagcaacaacaagctggaggccaattaagccataaaatgttggagaaatggttgggttatatgtgtgaaattctcatagtgtgccctaaagacgtagttgccatttaaaaaaaatttttttttttttgaggcggagtctcgctctgttgcccaggctatagtgtagtgctgtgatctcagctcactgcaacctctgcctcctggattcaagctgttctcctgcctcagccacctgagtgtctgggattataggcgtgcgccaccatgcccagcttatttttgtatttttagtagagacggggtttcactgtgttggtcaggctggtctcgaactcctgatctcatgatccgcctgccttggcctcccaaagtgctgggattacaggcatt

SEQ ID NO: 11563 - DNA, 1284 bp, Homo sapiens
tgatttctttggtttttggaccctgtcacatgagtaggggttgtcaagatagcccatggggctagttgccgtttctattacagtgagaaaagtaggggccttgagttgttggagccagaagtggagaatgcttagagttgaactatatgagtttgaaaaattgggaacacagaggggttaagagcactgcttgaagatggtctgcaagccgggctcaaatagaaatctaggtgggtcagtacagagctgcctgacataagtaagtagcacatggagcattgcttgttgtcacagttgtatggctggttgcttgaacagtagccagtggaagacctagtagaatgtgtagagaatctgggtgccctagtcaaaaaccagcgtcggtatttaagttgggatgtggtattcatcttgtgaccagttctctacttctgtcctagggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcagggtaagaggagtaatttagaatattccgtgtcgtggttctttgttcatcctaccaatatgccttcatgccatcaaaacttttgatttgtaatttcatacatttctgtgggctgtatgtatagcctgagcttaatttctaatatttgagaggatctaatcatttaattcctaaaactttcacaaaatacaggatatctgtatggctgatatacttgtattagatgtaagagaattagagaaattatattttcctttaattaaaaaaaaaaaaagcctgggcgcagtggctcacgcctgtaatcccagcactttgagaggccgaggcgggtggatcacctgaggtccgaagtttgagaccaacctgaccaaaatggtgaaac

SEQ ID NO: 11564 - DNA, 1032 bp, Homo sapiens
agtactgcccttagatttctgtggcctcacaagcccggggagcctagacctcagtagaaacactttgcaacggctgctggtgaagaatggccatccattgagtctctagcacctgggtctcctcaaaagactggtccccctgcctgtcacttggctcagcttaagaacttgaagtggaccaggcgcagtggctcacacctgtaatcccaacactttgggaagctgaggcgggagagtcacttgaggcctagagtttaggttgcagcatcactgcacttgagcctgggcaacagagtcagaccccatctcaaaaaaaaattaaggcctgaagtggctaaacttgaaggataactccctttatcttatcctggccaaagtggtagatgattgcttggatgagaagtgatatgcagataagatgttgcaatacacaaagtctgtgtgggtcagtcggtcacgtgggtgccaaggacaggtgggagagaagaagcaagctacagaagcagctcaagaatgggaactgcggaagctgattgtattggaggaaggagtgtgatgctctcagagcagccagggaggagcagaaggagcttagggacgtaagtcaggctctcaaagtctatgtctggttcctgcccccacaaaccaccacccaggaaacatcattcctgagctgtgtggcagcagcagcagctgctccttttatatggcagacagggtgattgcttgttgggcaagagccctcctacactatcttagagtgaataccctctatctgcagtccagggtctgcacagccacatggtcctctaataggtccaccagaccatttgcctgcaaacagcctcatcctcagtgcccactgtctcctagctgtggagcttggattcctatggaattgggttctgctgaacatacctctttttagcatcagacctacctgtctgtcatcaccatggggctgccagtcagtacttttgcagcctctttataggacattgttgtaacttagggttccctggtagaataagg

SEQ ID NO: 11565 - DNA, 1085 bp, Homo sapiens
gaaccctcccacaagtctaaaatcgtagaatttcttcagtcttttgatgagattacagctatggtgagcatgtttgaacatgtacaggtgactcaggctacacaagcacatagtagcctctaattttgaccactgaatttttttgtcatagctccctaatttggaatttgtcatgatttgggtcttttctctagaattcggtgaatcagtggttagcatgttgtgtgctacttgcagggaagatcctagagtcgtttaaaacccagaagggccttccagatcagtcccagaggaacaatctggtgatctagtctcttttttaaatgagacgtgtttttattgtaagttttctgaaaattgaggatgtaatcagtcagttgtttggatcaccctgcttttaagttctttaagagctggctattgatgaagcatttccagtattcttcccctcacctgattttcacccagatacattatgttaaatttactttcttctcttttaaaaaaaaatcttagttttgaaacatactataagtgtactctcctctcccccagaggtaactgaagttggaatttagcaaaaatattaaaaacatgggagtgctgtttttgtgtctgtagacagtattatttttgcatgcttttgaaggcatattttttggccgagtgcagtggctcatgcctgtaaccccaacacttgggaggccgaggcaggtgaatcacttggggtcaggagttcaagaccagcctggccaacatggtgaaaccccgtctgtactaaaaatacaaaaaattgctgggtgtggtggtgggcgcctgtaatcccagctactcgggagattgaggcaggagaatcgcttgaacccaggaggcgtgcagtgagccgagactgcgccactgcactacagcctgggcgacagagcgggactccatctcagaaaaataaaaatttgcatatttttgcaatctgcatctttctacttgaaatttatccatgtggatacaagtgcttcctcttgactgccacataggttgtgtttttgtttttagtaagataatacagataaatttgaagtcccctttgt

SEQ ID NO: 11566 - DNA, 1384 bp, Homo sapiens
ggtctcttaactgctgagctcagccagtctgcccaccttggcttcccaaagtgctgggattacaggcataagccaccgcacctggcctcagtcatctgaatttaagtaataaactaagtaaaattgagctttaattcaaaattgggtataagtattttacagattacctgaagttgttgtcatttatttttctggaggagggcgggttgatgatgctctttaaatagtggccagaagtcatttgggctctctttgtcttcttttcttgattggaaacagtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgtgagtacaatttttttatattactgatttttaaacaaaatgtttgtgagctgaaattttgtaaattcatcccttaaaagcgtgttttttcttctatccccgtatagggtagcaaaagacagagatgccctcttacagttcgatgaactatacatccaatttaccagagtcctttcacagttagttccagttttagcatcctgcccttacttgggcttttctgaatgagcaattaaacatcagggttttcagattgagccctctgtgcaaagggataagaatgattcacgctaggttctgccttccaagagttcataggtgggatttaaatagataattgtcaccaagttataaaatttagtccctgtttccataagagaagggttgcgcagtggctggtcccttttatatataaatcatctctttagccctcatcttcctcaccccgggttcttccccatttcatagattgggaaagtgaggtgaaatcacttccctgggatcccataggaaggcattgtgttttcataatatattcacatgacttcaaattcaaaaagcacacaatggcatagaatggaaagggtttgggccagtcacttccctctggcgttgaggtgctcatgtaccctgtgcccttccggagagattccagcatgctgtgcacacctgcatgttgacccttgtcttgccttcttcctgcttgtcagatccttccatatccggacatgcgtagtgcctcatccttgcagccagcggccttcatgctccactgtaattcgtgggttagtgggtatatgcacttgttgtttttgatgctaccacatggggatatttgcctcgtctgaactctgtgtattctctgctgcaccttgttgcttctttgcaataaacttcctgaa

SEQ ID NO: 11567 - DNA, 2369 bp, Homo sapiens
tggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctca

SEQ ID NO: 11568 - DNA, 1027 bp, Homo sapiens
gccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccac

SEQ ID NO: 11569 - DNA, 1022 bp, Homo sapiens
tcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaattctcagtgtggtggtgactgttctgtgggagggggactgatgggcaccaagggcctccactccgcacccgggcctgcccctctacagggaagcaggggaggctcagtctgggcagggtggccatgtgactagaggggacaggaacctcttggactcgacttcacagtagacaggctgactggcagcaggtccgcccatgtgaagcccaccctggctccctaccctttaaggatgggggaagctgagtgtgtgttaccagtggggtcttaaacacacaaggcctcactcgtcagtgtggtgaagaaagccaagactccgcgctctccattgttagcagcctggaaagatctggagactagcaatggagagatgtttcttaggctgttcagatccaaaacttccacattccccgttgttga

SEQ ID NO: 11570 - DNA, 1029 bp, Homo sapiens
tacaatatattatttgcttcgtcctaagatgtataaaaaagtagtttctaaagtgctaacacatgcttctgaaaaaaaaaaaaaagaagcctagtaggctgggcgcagtggctcacgcctgtaattccagcactttggaaggctgaggtaggtggatcacgaggtcaggagattgagaccattctggccaacatgatgaaaccccgtctctactaaaaatacaaaaaattagctgggcatggtggcgcgtgtctgtaatcccagctacttgggagactgaggcaggagaatcacttgaaccagggagttggaggttgcagtgagcagagatcgcgccactgcactccagcctggcgacagagcaaggctccatctaaaaaaaaacccaaaaaaaacaaaaaacaaaacaacaaaaaaaagcctagtagttaattagagatcagtatttgcttagagttgtttttgtttgagggcatatagtccaagcagtatattcaaaagttcttgggttggttaactatttatttgtggtaaaatatacataatataaaatttactattttaatctttttttttttctttgagatggagtttcgctcttgttgcccaggctggagtgcaatggctcgatctcggctcactgcaaccgctgcctcctgagttcaagcgattctcctgcctcagcctcctgagtagctgggattacaggtgcacccccaccacgcctagctaattttttttttttttttttttttttttttgagatggagtctcactctgttgcccagtccggagtgcagtggcacgatcttggctcactgcaagctccacctcccgggttcacgccattctcctgcctcagcctcctgagtagctgggactacaggcgcctgccaccatgcttggctaatttttttatatttttctagagacggggtttcaccatgttagccaggatggtctcgatctcctgacctcgtgatccgcccgcctcggcctcccaaagtgctgggattaaaggtgtgagcc

SEQ ID NO: 11571 - DNA, 1047 bp, Homo sapiens
aatttggagaaagggaaaactttcccaggcttaaaaacccaaacctgatttccagtgttttacgtcgttctgaagccataccgtccaaacaaatatgtaaaaaagtagctatccctggcagggcgcagtggctcacgcctgtaatcccagcactttgggaggctgaggtgggtggatcacgaggtcaggagattgggaccattctggctaacacggtgaaaccccgtctctactaaaaatccaaaaaaattagccgggcatgttggcgggcacctgtggtcccagctactcgggaggctgaggcaggagaatggcgtgaacccgggaggcagagcttgcagtgagtggagattgcgctactgcactctagcctgggtgacagagcgagactcagtctcaaaaaaaaaaaaagtagctatcccttatttgcattcagccaggtgactgtgcaggcaaaagagaagagagaatatacattaaaataatgtaatgaaacctctgtgtttgaagattgaattacatttcaatttgagttgtagacagtggtcacattttttgtatcagtgaattagtatagcctagggtgaaaagtgcattttaatttcacagcttttgttgtggacatagtatttgtaacaaaaaattagataagaaatctgtacttttctgatatgtaaatctaccaggaattctcacagttcgcattgtatagaacaatgaaaaatgacatttccagctgattataaggtaaataaataatctgttctgaatgatctcttataattgaggtttcaaggcttcttttttttttttttttttatgagatggagtctcgctctgttgcccaggctggagtgcagtggtgtgatagtggctcactgcaaccaccgcctcctggcttcaagcaattctcctgtctcagcctcctgagtagctgggactacaggtgcacgccacgatgcctggcgtatttttagtagaggtggggtttcaccatattggtcaggctgctctcgaactcctgacctcaggtgatccgccctcctt

SEQ ID NO: 11572 - DNA, 1083 bp, Homo sapiens
ctcaaaggtcacgtagttcaatttctcacccagggccagtcttttctaccacatgcagtcactgcttgagcacttgtagtgatggggaactgactacctgaaaacagctcactcaattgtttaacacttccagttgttggaaagttctaaagcatatcaacagctaaccattattaagcacatattgtgtgctgggtattgtgttaagtgcttgtatgtgttttcccttaaatactctctgtaatcccttgaggccaggttagtatctccattttttagagcaggaaacagagatgtacagtttcttgttcaggctcactcaggtggtggtggaacaggaatggaccccatgcagttggcctgcagcctgtgctcccctatgctcctctccattcaggagcctccaagagtttgcagaatggccccctaggcagtggaaggcagcaggcttggctctcccatccccaaggggcctcactatgaagaagctaagtaatggacgataggaatgtattctgtattctgctgaaaagacaaatgtattctgctgaaaagacaatcttgcacacacgaagaacagtgtaaattaaaaccaaaccaaaggctgggtgtggcggctatgcctgtaatcccagcactttgggaggctgaggtgggcagattgcttgagattaggagtttgagcctgggcaacatagtgaaaccctgtctttataaaaaatacaaaaattagccagacatagtggtgcacatctgtagttccagctactcaggaggctgaggtaggaggattgcttgagccagggaggtggaggttgcagtgagctgaaattgcaccactgcactccatcctgggtgacagaacaagaccctgtctcaaagaaaaaaaaaaaagaaaacaaaaccaaaaacaactccccctcccccacaacaaaacctaaaaaccaaactgagataccattttcccctgtcagattggcaaaactcaaaaaaactgaagctgtggggaaacaggcagtccacctacatagctggtgagactgtaaattggtacaaccttggtgaagggcaatttagcaattt

SEQ ID NO: 11573 - DNA, 1059 bp, Homo sapiens
gctcacagttgtcttgaagcaattccttgggcatccaggtacagttctctttcagcacaggtctctccaaacaggtctatttgtctccctccccacgtttctcagtgggcccttcagaaagaaagctgcagctctactggggaggcaagagcttgtcattgaggaggcttgggccagaggcaggaagaccagttaggagtctgtggaaatcgcctgggcaagcaatggtggccttccagcaaggacaggtgcagtgagagtgaccaggagtgcaagaactgtgcttcccacagtgcttatggccgtgagaccatgtggaaatatacaataatgaccctggagcatggagccttcctgagactagcttggtgagcttctacctggaggaaatgaagatagaaggaaaacgcaatgtgacctctttgattaggacatagattcaaacacatgcagatggggagtcttgatcaaggaaattctgttttcttctttgtgaagcctttaataagatgaatatactcttcaactcgagatctgaaaaagcaatgaaaatacttctttttgttgtacttaacacaattttttgtggtttctttttatctaggtacctgattcaagaaaaaaggtaagagtatttatttatttttgtaatagaaagtaggatagtttataatactgtcttatttctgagcccttttaaatgaatacagttacaattagaaggggaccttgttgctaatagcaaatacatttgccaaaaagcaagcagaagtgcaatagggaaactccttagtgggagtcacacttctgggcttcccagctgcctctgttgttgtggttttgtactcttccatggttcagtgacaccactgtcgtgaccagcagtgggtatgattgacttctggacattcaggctatcccttgctcccttcttagtctcttgttaagaaagctgtccagctcccaggatgctgcccgtccagggcagaagccataagcactttggccagtgggtgtccataccgcgtgggaggcgtgccccgtggtataccttcaggg

SEQ ID NO: 11574 - DNA, 1932 bp, Homo sapiens
gtcactctctggcagatgagtcacaggagatgaatgagctgcccatggctgcacagctgggaagtggcagagctgggacagggatctaggtggtctggccccagggaccttatactttaccaccatactgggccagctctactctgtgagcccatgtgacaggcttcacacaccttccttctttgcatcctgtggccacacaggacgtggcagactgggacttccaacttaggtctgtgtgacaccaaaggttgtgctctaaaggacaagcatgtaaactaatagtaggaatttgtttaaaattttcttaaaaagcagattttaaggttagaggatcaggagtatagaaattgggtctaatctccccactaagtgaagactgttatgattgcctggaatcattgtcagtatctgtggagccatcagtgaaagattccagggtagccctgtagtttcattgagtatgctggagttctttaccagtgtgtgtgtggtttgggaatggtatgtggtagaagaggaatcaaggaaatcagcacagcgctactgtttccttctcgggacagttgagtgagctgtcgagacgagggcagctcctgccattgacaccaggactctccaaagctcattgacactgaatccttcggtttttgccaattccacgcacacaccatggaagtggctccagcagaggctggtatggcaggctatgctctttcttggaacccggtgtcattgctgaatcaggggccactatgctcagagtaaggaacccggggttgcccttgtgttaaacaagagctaattgaataacagcctaggaccccctccatgctgaaaccccttggtgcggcatgttatgcagagggcctcacagtgactagcattgcccttctgccattctcgtcacatgacagctcacgtctttgttactgagtcatgtcactttcttctatgagaggttttgactcgcaggtcttcttggtcatgggagcagacacataaggactgcttatttatctctaaaataactgcttaaatacttggtcattttgaattataaacagcatggtgcatgattgagtgcaagttcaaagtggtataaacaactgttaatagatacatgaggctccttcctcaacagtggtttctaagaattgaagtttagagcaaatgacagattcatcctatagtacgaggaggctcagctacctttagaggatggcttgatgccttgttactctgctggtggtggccatgaatgcaaaacgtcctttaatagcactgggataagcagggcttccctggtgctgctgaaaatgtttgtctgtgtctgttttttgttgctcataatcctaccacccagagaaaccactgtgtgtgtgtgtgtgtgtgtgtatgtgtgtgtgagcgtgcttgcgcttgtatagaagttgtgtataaattgggtcaaatgaatattcgggggtgtgtgggggcttaaggatatatatcctgggactgcatgtgaatgtgcatgtgtgggtatggagtgtgtaggagttgtgttttggaggtgaggatatatatgtgtgcttgacagtgtgatggagttttgtgtgtatttgagatataattcatataccataaaactcaccattttaaagtatacaattctgtggtttttagtatagtcacaggttgtgcaaccatcaccactaattccggaacatttccatcaccccaaaaaggagccttgtgttagcagtcactcctcattcttccccagctttgtcccccatcccctggcaaccaccgatctacttttcgtctctatgggtttgcctatttggacattccgtataaatggaattagaactgtggccttttgtgtctggcttccatgacttagcatgtttttaagattcatctgtactgtggcatgtattagta

SEQ ID NO: 11575 - DNA, 1039 bp, Homo sapiens
cgtggcaccagcagtgttcctgatgcagttgaagagttgatgtctttgacaacatacggacactgcctggattacctagatgtcacatcttaattgccaattgatgaaattaggtaaatgaaaagaaagcacttaaatttccccttagagcattttaacatgacatgcaatcaggttttgtctgctaataattatttctccccctccatccctcccaccagtttctttcctgaagtctgtgaggccgctataaacaggtagatgaagttagagcagttatggccctaaatggtccacagttgggtattggcactaccgcagtttcaggtgatgtcggcatttttagaaataggaggagatggaaaaattacgcttcagctgttaaaaatatttttggggcattgagttactttaaaacacgtatattctctaagctgtttttatctgaacttgtagagtctattcattttcttgttcagaacattttgtaatatgtgaaaccttttataattaaaactctgaactgcagattaagtctgacttgcagttttgtaagattctaatggattaacagcattttgttttgcaggattcctgccagctcccaggggctttggttatagaagtgaagtggactaaatacggatccctgctgaatccacaggccaaaatagtcaatgtaactgcaaatctaatttcatcctcctttcctgaggtaggcctaacctagtttaaaggcataggttaagacagaagtctagacacaactcaagtgtggtaggtgacaggtattactttgtgaaaaagattataatttaaaccatgggggttcataaaatatttcagcagtcattcttagaaacactgacgatggttctacttacattagcattctggttcagattggatctttaaaattctcatgaaaattatgatattcacgtgttaatcagacaccctggtaaaattgtttctctcatccaagttaatggccaattagtgctccaggacctatcagattcatgaactgacagtagtt

SEQ ID NO: 11576 - DNA, 1025 bp, Homo sapiens
taaccggattcatacctttatgattttctttttctgcttaactttctactttttttttttaccatgctctgggtccagtctcccatgctgtcttccctgactccaaagagggttaattgagctaacaatgagctggggggcacccagtccaaatgagggtcctcggtccaaatgcccatctgtgtttctggggagaaaggagcttggtcaataggattacatagtactaatctgggaggaaggggcaaattctgcttcgggtgtcagcagttgggagaaagatcaacaggatgagcaaagagaggccggacttttccaaggagtttggagaaacttccgggaacactcaatctcctggcgcaggagagcaagatggtgcttgatggaatattttcccctgctcaaagtttagaaaagagcagggatgtgattaaaatattataaccttatgatattctgaagtgcataaattttacatatcagccacagagagtttagacatccattagagcctctgacagcttgacttatctaaatgtgctatcatttaacaatgtgtcaaaattcctctttctatagatgacagcagtaaataagctatcagccctgttggcggaatcctaactttggaaacttcaccataatagaattgctgccgaggtccaattgcagccgaggtggggagcgtgagcccgcagagcttggcatggctcagccccctgagaggggttggcattaggtgaagacagctctgagaataagacaaacccttggactctcttctaactccagccagtgggtgaccccattccctctgcctctccaagtccgtagaacccacaccctgtggcccttttctgcagaaagagctagaaacaggtgttgagaatttatttaaagaacccagcagccttttctgggtctcccaaaattgtagtttctcaacttgacagagattgcttctcaaaaacgggctctctctttgaatgctagaagaaaaaacaagcaacatctcatccctcact

SEQ ID NO: 11577 - DNA, 1026 bp, Homo sapiens
gggattgggacatctgcataaggctctcagggtgtaggagacgctccgttgaggtcgctgtcatgtcttgggggaggctggggagctgtcactcccagcactgtctctttcctggttgcctgtccttacttgccctcaggttttaggatcccctcatcctatccccctcccgtcccctgtcattctccccctctttattcaagcccctgtggcctccttgctgtgcctcaaacaagccaagcaggtcccagcttcagggttttggcacttactgttccctctctctgagacaatttccaaacacctcccttcagttagtttggtcctttgcttgaataccacctcctcagagaagtcctccttgacttctctttccaaatcagctcccctctcctcactctgcctcacctgatgtgataatatttatttgtgtatttatttgttcatttgtttactgtctgcctccctctctggggagggcagggacatagtaagtgctcaataaatatttgattgatgggtggctgaatccacaggagggatgaggtagggggcagttgcccctcgacttcaccttgaggggcagtcttgggggacccttggctgctacacccctcactggctcttgaaagttgctgggaattgggcaccggcctcaggcctgtggcgaatgagggtttgtttacctttagctccatcagtctcgccttagggtgacctcagttccaacctgggaggcagctcccatctaattagtatatctatttattaattgctggaaggctgcaggccataagcgatgatttggtggcctcagccatagagagctgaaagcatccctacagcctgtgagatggctgtcatccaggacacaagacagccagttaatgtcctcggacccggctgacattcctgacactgattcccaggcccactggatcatcccagcaggcatgagaaagcggcctgggtctctggacagtgatcccagggttgaagggctttctttcccaccatgcgcaggga

SEQ ID NO: 11578 - DNA, 1035 bp, Homo sapiens
cctcagcctcctaagtagctgggattacaagcgtgtgccactacgcctggctgatttttgtattttcagtagagacggggtttcaccacgtcggccaggctggtcttgaattcgtgacctcatgtgatctgcctgcctcggcctcccacagtgctgggattgcaggcgtgagccaccacgcccggccccttgctgttctttttaaaaacctctgaagataccttgccactgtcaactcatggaaatggatttgggccccaaagcctgagaagcatgggtcaggggaaggtgagagaaagctcccggttcccagcgtgtctcccagcctggagaatgagcaccacccggccatccatccccggcccccgctgggtcccggagccgcgtggcgcgccctgtcgtccggcctgcattccgcgagatggaattctcggctggggctgataataagcaggtattgattgctgccgtggtcattatcaagatttatttagtcaatatggcctccccggtcaataaatcgtgtcgttgataaagaaggaaggagatagacttgtagcctttattaaaaaagttttttagattttttttttaaagccaagtccagccctcctttctgtggctgtaccagccacactctacagttcgcgtttttaccttataagctctttctttccatggcagaccttatactcattgctctgactccaagaagcaaggacttggggctggggctagggctggagaatggtccctgacctttgttctttcattgaatcctcccagcatcccttggggcaggctctggtgtcaccctattttgcagctgaggctactgaggcccagggaggttcatttactagcccaaggtcacacaagactcgaacccagacagtctggccagagtctttgctctgaatctgacattcatccatcaaatagcaggtatttcttgagcacgtgctataggccccgcacaatgccagctgctgggtgtggaagggcaagctaaacaaataaatgtgtaatgacaga

SEQ ID NO: 11579 - DNA, 1050 bp, Homo sapiens
ctctctctgcctgcgacactcttcccatacttcttcccatcaactcctcccagatccttggagcttactcaatatcacttccttggggcagctgcctgctccaccttgtatggccccatgaggctgtgcaccccaactttacagcacttaccatagcaggtgtcagacatagctctgtgggttactgatgaacaccggcctccctctgtggattgtcatcaccatgagggtatagagcagcttgtccccagaactgagcagcagagggcagagcacatagtaggccctcaaaaaaaaaaaaaatcagtcaaatgaacaaacagggatggatgtgagtgtgatgtgagtgtaatgtgagtgtatttgtatacttacgtgtgtatgtctgcatctttgtgggtacatatctttgagtgtgtttgtgggtcttttaatttttgtgtctgtgtccttgtatgtgtatcttagtgtgtttctgtgtgtgtgtctttgtatctgtgtttttctgagtatgtctctgaatgtgtgcctgtgtatctgcatccacatgtggggatctgtgtgtgtgtgtcagtgcgtgtctttgtttatttgtgcaccttagtatgtctgtgtatgtgtttgtgtgctcatgctcccaggcagaacttctttcaacatctccttgccatgcaattgtattctgtctagtttggtgtggcatttaatgacttccccaaagctaagcatggccactgcagagttgatctcactgtgatggaggtgacacgggcatgtggggccagtggcaggcactgcctccccaggattgcctgctgtacctgctgaagctcccccacccccaccttcatccctttgaggggaaaaccccagacgggtagctaggtgcaggggcaaagcagggttattgccgaacagactggctctgctcttgccagatacatgaggccgccagaggactgctcagtgcctcagttttctcatctgcaaaatggggatagcaaaaataatcccctcatagcatctccacatggaggaaatgagcgcctg

SEQ ID NO: 11580 - DNA, 1133 bp, Homo sapiens
cttttgaaatctctggatagttttgaactctctgttcttaattaaatatgcaatttttcacggtaaccaggttaattcttttgtgttgtgttgtaatactgttaggaattttcatagttcttattaaacattattcaggcattgtgaattccataattaaaaaaaatgaaaagaacaaagcttgattcactcctttcttttccctggctaatttatcaaatgaattttgcaaatttttctttctgtccccagacagtgtggcaagtgttttaaaggggaaggatttaattgccctgtagggattggctggttatgaaggatttggctgtttgattagtaaacccagttgggaatggtctaatgctccatgatcttaaaaattgtctgattgtaccctctccaaggaggcctctctcttcgttatgtagagcatcaacttcacacaagtgtgattattaggtagtgaggaaagggaagagagaaagatctgactttactttaaattggggatcttgggagatttttacctccatttccctggctggggaggaagggagaacactgaagagacacagagagagagagacagagagagagagagagagacagacagacagagagagagacagagagggagcaattctctcatctcagatacaggagaagctggagggtggctgaaagggtggggcccaaggagacgttttagtgcacccttgcagatagtggtgttacaggaagggggtcccgagcgagaccccaagatctcacgcaagaaagaattcagggagagaccgcagtgcaaagtaaaagcaagtttattaagaaagtaaaatggtgaaagaacagctactccatagacagagtaggacattcctgaaaataagaggaggaacacatccaccctaggtacaatactcatatatatggggagatatgctctgtgacaagggtttgtgataaaggattaattttcttaattactatattttgcaataatcaatattgttatctttaaagcaaaattaggaatccctttgttctccaaatattgggatatctggacactcccaagtctgggtgtgtttagtaaacattattaatttgttcccttaaccgtaaacatctagagg

SEQ ID NO: 11581 - DNA, 1026 bp, Homo sapiens
aattgcccaggtgattctgatccatactcaagtctgagaattccaaagggacaatcaatttgaactccaaacccatgcgagtgcaggattatggttatacattctcaggggaagctaccttttggttttccaaactagaggcaaggcagagacagatcaaggcatgtcttcttccagtgttagtggatagaggtgttctgatccacatactcgctgagtgtgaaggcctcttcagtactaagatgggcacctatctatcccatgccccactcctttattgcagagggcacttaattattggttcacatacttagcagtctgagtgagttccctcttcagttttggcccttgggaatttcttactttttccagaactgacctatatatttaaagggatgctggtataccttatccagtatttctgggtgttttatagtgggagcatttcaggttatattgtcttccatgttactggacactgaagtcctctcaatgtaatgaaaattagtttctcctttagaattctttttagaaggtctggtagcctcctgcttcactggtgacctgacacttttcacttaccctggggtctgagcccactttgtcactcacagggaccaaaggctgaacaaatcctgggagtctctctaccttacctctgcctggagctggagtccagttcagccaacgtttgttaagcacccattgggtgaggggtgaggggagttcactttatacaagtgacaagtatctctgctagaggacaccaccccatggtcagtgtattccagcatgtaaatccccttgctctgctctaggggaacttgactgctctaaggaggagggtcagaatggtgtcagggtgaagagctctggctttaaaatccattggaatcaagttcaactcccagctctgccttttacaagctgtgtgatcttgagtgagcctctgcccctctctgagcatcagcttctccaactgcaaggtgggatgacagagggttgctgttaaggatccagtgagat

SEQ ID NO: 11582 - DNA, 1088 bp, Homo sapiens
ttctatcacagtttctcgactccacactgttgacatttgtggccgtttcatggtaggggctgccctgtgccttttagggtgcttagcagccttactggccactcccttctaagtggcagttgcctcccctgctaagttgtaccaaccaaaaatgtctccagatactgctgactgtccattgggggtcacgagcgacctcagccaagaaccacggtaccaccttaggagagagatgagcagggtgaccagccagagagcagccaccaagcaggtgaccattgaggtcacccagaactggggcagggcaggggaaagagggcatgggtgtgagaggccttccagagaaaggattaaaaggccagggatcagcaggccaaggagaccacgaaggagacagatgttggagcctggggccggggtccaaggtctagggcctgatgggtctatgggaccaaggacagatgggaagggaagaggagtcctttggggtgagtggagcttgaggaccccagagtcaatgcatcttggggtgccatccagggcttaacataaagtgggtctgtggtaatggggtgggtgttgctgagtgaatgaatgagccagatataagtcacttaggcaaaagaggactgaggtttaggagggagttaagaggctgcttcctgtgcagtttagtgagaacctgctgtgtctcggattccatggagaatacagcccagtggaggggacgcccaccgagcaaactcacaggtaatagaagatgacagctggcactgagagctccaagagggaagcacgggagtttgtagtcgtgaaccttggggctggcagggagattgggagaaaaggccaggcaaccagtcaggggctgccatccacagggcagcccgcctttggcccagagaacgtgcttgttcaaggttactttgatgggggaagaacaacaagccagcccttggcacaaagggcagtgagagtagagagcagggccatctcctcgagtaccagggtgggagtagtcagggagggcttccctgaggaggtgaatgctggagctgaggacggaaggatgagtagaagtgtacatg

SEQ ID NO: 11583 - DNA, 1026 bp, Homo sapiens
ccttcctgctctgtggccaagcccacaggcccctcacacagcctgcccacctggtgtgcacctggagtccttgagcccatgtaagtttctcctttgcaggaacttttttgacatctgactggggtgcatccattcttcttcaggatttcctgcctcatctaatcaggcaaagatgtcatgtacatgtcacttacaattcttttctccatgttcccagctaagttcttctgttgcctcagggagttccgggagctgcaggtttcacctggggagggcccagtgctgcagttcccaccgtattctgttcttgctggctctaggaagttgggagtattgggacatgtgccctggcaggcagaatgcccgtcctctaggtgagggagcagagggtgcagggaatggaaaggtctgggatggggcttctaagttacagtgagaaaacaaatgcctgaaattaaaattcaagaggatgaaaagcaaataaatgagatagggcagttagggaaagctttgggtgtaatttatttaaactttttttttttaacttttcattttgagataatttcaaaaagactgacaaaaagttacaaaaacagtacaaagaattccccagattccctgaatgctgacatccagcctaaccacaacacaattacaaagtcagaaaaattaacgtggctgaaacaccattacataatggactgacctgactcaaattttgccaagtgtcccactgatgtcgtttttctggtccagagtccagttctggatcatgtgacgcatggagttgttatttccccatagtctcccttaatctccaacagttcttcagtcttcttttgtctttaatggccttgacacttttgatgaaaactggccatttatcttgaagaatgtccctccatttgagaatgcagggtgtttacttatgattcgattcaggttgtgcattttgggctacaggagtgatgttgtgtccttctccatgcattggatcaggaggcaccactgctgttaactttggtc

SEQ ID NO: 11584 - DNA, 1032 bp, Homo sapiens
atcagttctctgttagataggtgatttggaaatattttctcccagtgtgtggcttgtgttttcattctctgaaagtgcaggtaaagatgctgcagccgtgaatgtctctaactctgccacactccagccatactggccttctttcagtttctcaagaaaatgaacctctttccttctccagggccttgtcctaagctgtgccctctgtctggaatacaccttctctcatatctgctgtaagaaatctttgcttagctccaaagatattctcctatgtttcttttggaagtgctgttgctttagcatttatgtttgggtttgtgatctgtctcaaattaatgtttgtgtatgatgtgagataagggtttgagggtcattttcttttttctttatggatatccatttgttctagcaccatttgctggaaagattttatttatcactttccattgttttgattcctttattcagaaagcaaatgagcatctaggtgtggatctatttcttggcattttattctttttcattgatcaatatgtctatccttatagcattaccgtactttattgattactatatcttcacagtaagttctgaaattggatagattaagtcttccaacttcattcttctgtttcaaagtttctttggatattctgtgtccttttaattttatgtaaattttagaattggcttttcaatttctacaagaaacaaacaagcaaacctgctggtattttgattgacattgcgttgaatctgtagatcaatttggagataataaaatttcttttttttttttttttttttttttgagatagagtcttgctctgtcgcccaggctagagtgcagtggcgtgatcttggctcactgcaagctccacctcccaggttcacgccattctccttcctcaggctccggagtagctgggactataggtgcctgccaccatgcccggctaattttctgtgtttttagtagagatggggtttcaccatgttagccaggatggtctcaatctcctgacctcg

SEQ ID NO: 11585 - DNA, 1065 bp, Homo sapiens
aggttttagatgaatgtttgtggttttggagaatatggtgatattgctaatagtagtcatgaattccactcattgagcaatgtatcagtaagtacaggctacattatgctgcagtaacaaaagacccccaaatttcagtggctaaacttaacaaagcaactttcatactcgcatgacccattcattggctacatgtccatcatatatgggcagtggacttggctcatcagtgtctctttagggacccaggctgatggtgcagccaccagctctgatgtgccattcaccatgctagaagtatggagacctctaagggtcttgtacctatggtaaaatgctccactctggaagtgacacatcacttactcattggccaaaactagcaacttggcctcattcaaccacaagaagccaataaacacaatcttaccttgtgcatgggagagagaaatccagaaatatttgacaaaacagcatgaatgatgaccataagcactcagtaaacaacaaggagttcctctgaccctacaacagacctccaagatgacactgagagctaatggttattgactatttaccacatgccatgtactgtttacctacagagcacttttaaccccacaacaatcctatcaggtagatactctgagtatttccatttcacagatgagaggactgagattccaagaggtgaagttacttgcccaagatcacacagctgaggaagcagtagagccacttggctccaggtatttgaatgcaggccaagcttggctacagaacccatattataataaccccatttacttgatgagaaatctcaggctcagagaagcaaaccaacatgcccaaggtcacacagccaggaagcagcaagtcctagttcctttgccttaccgtatttcccaggtaaaggctgggaaacctccctttgcagtttcagttggtgatgaccagacatccttccccaactctttcctgtgcaagtgactcccaactcttggcctctgatatgaattctgtgctagtgctagtttatatcagttcactagagccaaatgttaa

SEQ ID NO: 11586 - DNA, 1051 bp, Homo sapiens
gccaccatcaccactatctaggtcccaaacatttttattcccccaaaaggaaaccgcatacccctgagcagtgtaggggccaagggaaacttccctttcactctctgaaggttccttgaaaatcgatggatgaaaggcaaattcataggagaaaaggcatacaaatttatttgatcatcgttttactgacatgggagccttcagaatgaagacccaaagatacagggaaaactattcatttttacgcttaagttcagtcaagtgtggacagccatgtagaaacaggattgaacaaaaagatatgatgaaatgctcagacactgagttgggaagcccagtaaggcctatctgtctggattcttcttggcctccgtgcagcctgcctgccttgtctgtgtgaggcaggaccctttctggattggggctcctatgacctacagtcaaacaaggcaggtcagatcatttctttatggccagtttttatatagaaaggtagtgggaagttcaagtaatatttttaggttttatggctggtttggggaaaaaggagttctgagttctttttttctttttctttttcgacttttattttagattcagggggtacatgtgcaggtttgttacctgcttatcttgcctgatgctgaggtttcaggtacaaatcccatcacccaggtaatgagtgtagtacccaacagttggttttttgacccttgcttccctccttcccttccccttccaggggtccccactgtctattgttgctattttgatgtccatgagtacctgatgtttagctcccacatacaggtgagaacatgcggtatttagtcttctgttcctatgttagtttgcttaggaaagggttctgatttctaatgattcaccttggggaagaggattctagtttctgtggccagtctcagagaatgagggaccagagacaggagggcaggagaagtccggagaagaacctttgcttctgaggctgcttttgaggccttcattttggggtaccattttctgagccctaacaggagcaactccccat

SEQ ID NO: 11587 - DNA, 1059 bp, Homo sapiens
cccaggttcaagcaattctcctgcctcagcctcccgagtagctgggattacagccatgcgccaccacacccagcttttttgtttgtttgtttgtttgtttttgttttgttttgttttgttttgtatttttagtagacgcggggtttcaccatattggccaggctggtctggaactcctgaccttgtgatccacccacctcggcctcccaaagtgctgggattacaggtgtgagccaccacacccggccctggctatttatttttaaacaaactttgtatttagagaagttttaagttcacagcaaaattgagcagagcatatagagaatttccatatatgcctcgcccctacacggcacattctctaccaccagcaacacgcccacccaagtgggacatgtgttataactgatgaacccacactgacacctcattatcacccagagtccacagttgacattaggcttcactgttggtggtgtacatgctatgggtttggacaaatgtatgacgacgtggctccaccattgtagtatcatgaagaagagttttcctgccctaaaaatcctcttgtattccacctacttatccctctttcccccaacgttcctggtacccactgatcattttactgcctccatagttttgcctttttcagtatgttgtatagttggaattatactgtgtgtgatatggtttggctgtgtccccacccagtctgtgatacttctgcatggcagccccaggaaatgagaacagatgacagtggggaaaggggttgggatagcttgtgggtggccaatctgtagtgtttgccacaggtagattctgttattatcacattttacagaagagcaagcaaagcgagagagggttagtaacgtgtatttgatccaaggacactaacgtgcgggtgtgagaggttaaattccagcgtggtctagcatgatcatcagagttttggtcccagagtcagaccccgtaggtttaaatctcagcttccccactaataattctgtgtgaccttgatagagttgcttcagctcctggggctcggtt

SEQ ID NO: 11588 - DNA, 1032 bp, Homo sapiens
gcagcagcaggggctcacgacagcaggaaactggcctcatgttggggtgttggtctgctggaagtaatgtttaagctgcaacttggctgaggggtaggcctgagttaggccattgattttcagacttgagcatgcatttaaatcacctgaaatttccttgaaaaaaatcgccaggctctaccctcagagtttctgattcagtaggtctggagcccgtccaagaatttgcatttctaacaagatcccaggtgacactgatcctgctgggccagagactttgggaaccactgaactgggcaaagaattgggaggagagggcattcaggtagcggaaactgcacgtacaaaggtcctggggctggtttgggcttggcagtttccaggaaccaaatgaagggccagagggtggagcaaagcacaaggactgtgggaggaaatgctgtagagaagcaggcagggccctgaccacacaggccttgcagactgggctggagagttcagatttgatctgaaatggaatggggagtccggggaggttttaagcagggaagtatcaacatccagtttacatcttgaaatgccctgtctggctgccagggtggaagtgagatggcagagaattgcatggagccagggaggcccctgcaagcatccaggcaggaattggcagtgaccagaccaggctgatgacagcaggcatggagaggcacgggacgtgtctgaatgagtccacgctcctgctttccaggaagttttcctgatcagtttggttccacccttcaatctgtgaaccctaatttctcacttgaagaagttgtcctatgttgacgtgacattagcagttccttgagggtagggctgtgtgtgtcatatgtgagtcacatgcagcccctagttggatacacaataccttatactagctggccaaaagcacgggacagtttacctgcaatggttaccacatccagttttccaaataccctgcaggaaaggtggagttgtgcccattttgcagagggggaaaactgagat

SEQ ID NO: 11589 - DNA, 1026 bp, Homo sapiens
gaaagggccagtctcgttcaataatcggaatagcaccagccatttattcgccaccaactgccccggatcctgtaccaagcatttgacatgcaccttcctccttcaatctgcccgggtaccttgggaggaggttataattctacctgtttgggagatgcagaaactgaggctcagaggccttgagcaacttgtccaaggtcacacagctaagaatgggtgaggctggaagtcaaattcaggtcagtttctgaagtttatgtgcttcaccccagttgagaactcaatgaatatttgtggaatggctggatgaattactgaatgaatgaatgatatgtgaacatccagtcgggactcagctgggctctgggatagccaagaatgacagggtcaggctgtccctcaggcaggcctggcatttgggcctccaagcctgctgggggtggctcctgcttcatcttcatgggcatagagctgtgcccaggctccagtcccctcagttggaggagccagtttaacatcaccagagaattctgtgcaaggaaatctcagggtctgaggggtctggcaataggcagaagcaacaccggggtctcagaggcagggtgaggttgttgtttacctggctgggagccagattgcttcgagccaggatagcatgggggttaaacgctcaaaccctaaagtcaacagaccttggtttgaatcccagcctcatcacattcttagctttgtgtgaccttgggcaagtgactaaacctctctgggcgtcacttctccatcctgcaggtagggctgatgacagtgcatccctgtccaggtgactgtgagatagaatgaggtcatacacatcagtgctcacatagtgcctggcgcgttctgtttggtggcagtaattattggcctagggcatttggggagtcccaccaccccctgcagatatttgtgactaacaagcttatttagctcaaggagaattccaggtcaaggcaaagaggtatcaagtgacctccttgaagttactgtgag

SEQ ID NO: 11590 - DNA, 1071 bp, Homo sapiens
ttgatagaagttgtggtgggggaggctctgatccatgcagtcattcagggatccaggcgtctaccatcatctggtaggtgggaaaagaggaaaacatgatggccctcctaggaggttctcagggaccaaaactggaagtggtcacatcatttctgcccacattcatttgtccagaactctgttacaaaaccatacccaatttcaaggctatagtctaacattatatgcccaagagtgggtaaaaaaacagaattaagttagcacataaccctgtctgctgccctgtggactccctcacagatagagcacctcactcactgtcagggaataggacagagccctgaatacacagccttgcacacagtggtacattttggacaggtgaatgggaatgaaacccaagaggcctgccaaattcagggagcagcaaagcaggagcaaggagggactgttaacaatttggcagatgttataaagctcctactatgcattcttccctgtgctgagctggctagagaaagagatgaactctgttcagcaaggaggctgagccaccattgggatcccatgcccaaggtccacttaaaaaaaagccagtgtgcagtaggaacaaatgtcccaggtgtaccaatgagagtggttattttttgggcaggcaatcagagaagacttctggaggaagtgaggtcccagctgagattaggaagattgggcaggatggaacatggggaatgaagagtggtggtgagcacaggtcttggcatcaggcagacctgggttcaagaccagtttgaacaccggtgaggtgatctgaggcaagccacttcccctttcttttttttttttttttttctgagacagagtctccctctgtcacccaggctagagtgcagtggcgtgatctcagcttactgcaacctctgcctcccaggctcaaacagtcctcccaccttagcctcccgagtagctgggactacaggcacacaccaccacgcccagctaatttttgtatttttagtaaagatggggtttggccattttggccaggctggtctggaactcctgacctca

SEQ ID NO: 11591 - DNA, 1053 bp, Homo sapiens
gcgcacctgcttacctcggcatggacgcccattgtccaagcccctgccacctaaacaaacaggccacagcagagtaaaacagggaagccgccttgttccagccggacctgaaggccccatgtacaggcattgccccgtttcttccatcagcagatctttgttgggttggactgtgggtcatacttcatggtaggtagaagaattccagcagggtaggggtggaagggagtgcaaaaacatgcagtctggccttgccttgtcgagtttgcagtccagtgggtgttaattaggtgaacctgcaaataaacatgcattagaactgcagtgggtaccgtgaaggaaaggtgtaggcagttcatatcagaggacaggttagtcgaggagggcttcctggaagaagtgacatttgagttgtactatggaaggcaagtaagtgtttactagctgaaaggggtaggtcaggggagggtgttcctggcaaaggttctcgtgcaaagggtctgaggtgggaaggtaagaagaagccaatgtgactggagctcagaaagaagtgagggcttctgcttactctgagctaaccaagtgtctggtgccatgtggagcattttacatgcatccttaccacagccccatgaggttgctacatttatggtgaggcacagagaggtagagtcacttgccaaagtcatacagcaatcccaagaagcaagtatagattagcagactccagggatacctaaccttgaggtccacactcttgatccctctgcttcccagcagagagcaagggccaagcagatactggcagaaaaatctgggggagcgaccaggcacgataactcatgcctataatcccagcattttgggaggccaaagcaggcagatcacctgaggtcaggagttcgagaccagcctgaccaacatggtgaaaccccaactctattaaaaatacagaaatttggccgggcgcagtagctcatgcctgtaatcccagcactttcggaggccaaggtgggtggatcacctgaggtcaggagttcaagaccagcttgg

SEQ ID NO: 11592 - DNA, 1068 bp, Homo sapiens
gagggaatggctcatgccaacacccacaggcagctggcgtgactagcggcagatcgtgtaggtggggcaggagcctgggtctggaatcacagctctctgggcatcctccaagccacgagggcagcgcctgtctcacctgtgtcaaggctgggtgtggggaacagtaggattgaccaagaacaggtgcccttatgcaggggttagaccctccccccttcagggacaggaagaacatggtggccaagggcagatgtggcccctccctctcccttcccatctgcctgacagcttttagtgactacttactgtgtgcaaagtacctactgtgtgcgggtcccaaggaccctgtgatgtacaaaactgtcgactgtagcagggcacggtggctcatgcctgtaatcccagcactttgggaggccaaggtgggagggctgcttgagcccaggagtttgagaccagcctaggcaacatagtgagaccccatctctacaaaaaatacaaaaattaaccaggtgtcgtggtgtgtgcctgtagtcttagcactttgggaggccaagatgaggatagcttgagcctgggaggtctaggctgcggtgagccatgattatgccactgcactccagcctgggtgacagaacaagaccctgtctcaaaaaaaaaaaaaaacattgtcgactctgcatggcccccttccatcgagggcagaggcacctacttgtgctttttggggtttcttgtggagatcggctgtgggggttccaccatggcctcatgtgacaggggcaccctttgttgccactgccctgcagacatgcccagcgggacatggccacatgcagagacggtgcctgtggaggggtgtgtggcagagagaaccccatttgtaggttcgcatctccaccttgcattccctttcatgggttccttacaaggtggatgccatgctgccacctggttggcagatgaggaaatccaggttcagagaggttgagtcaggcatcaggagccacacagccaatacgtgtccccctttgtaatgtgagccctgggagagcagtgttcgtctgt

SEQ ID NO: 11593 - DNA, 1011 bp, Homo sapiens
tgatttttgtatttttagtagaaatggggtttcaccatgttagccaggcacttggtgttaagagtcaccggtggctgcgttcctggatctcaaggtggctttactttgcgtttccctgatgactcatggaggttaagcaccttttcatatgttgattggtcatcggaatttggtcgtttgtgaagtacatgtttttattgtctgtctagccttttttaaattgatttgtaaaagtcgttatatattttggacaatttctttgcgttttaaaagtcatttcctacctttatggcctggcttttcatgaaaagcagttttgttttttttttttcttgagatggagtctcactctgttgcccaggctggagtgcagtggcgcaatctcggctcactgcaacctctgcctcctgggttcaagtgattctcctgcctcagcctcccgagtagctgggattacaggcgcatgctaccacgcctggctaattttttgtatttttagtagagatgggttttcgccatgttggccaggctggtcttgaactcctgacctcgtgatccacctgcctcagcctcccaaagtactgggattacaggcgtgagctacctcacctggcctcaatttttgtatttttagtagagatggggtttcaccatgttggccaggctggtcttgaactcctgacctcaggtgatctgtccgcctcggcctcccaaagtgctgggattacaggtgcgagccaccacgcctggccaggaggtcacttactttcattctaagtaaatcactgggccttccaggcagagggaacagcatgggcagagaccctgagtggggaatgtgtttagcatgttttgaagaaaggacaagatgaagaggccggtgtggtgggagcagagagagggagatggggagcggggaagtacatgtgggtggaggacactgggaacgggaggacttagtgttttattccaagcacaatcagaagctgttgggaaaacgcaagcacagat

SEQ ID NO: 11594 - DNA, 1048 bp, Homo sapiens
gcacctcagcctcccaaaatgctgggattacaggcatgagccaccatgcccggctgagcctgttaattttcatcacttcaatgattaatcaagtctcgggatttggggatgacaaactgatggagctatgtggagcagaactgtgaagagtgatttgcttgcactcactacagaagcacatatcacgtgatccagtattcctggcaattcacatttctgcaatcatgccttttcatttctcttcccttgatcttgcttaatgtatgatggtatattattcactaaatactcttgatttcactttcaaaagcatgaaaattaattcaaatcagaactaacttgcatccccccaaattcatcctcttcaagtttttgtatagaccaatcctcatttaaaaaaaaaaaaaaaagctgatgtaatatcaaaaataggaccatggctaattaaaccaatgtttttttttctaaccacagttactcagaattcgtagaggctcatctatttgtagacactccaggaatcccaaaagagtaaatgcaataaaaaacattattttttaaaaaatgaaaagtgtttgggggagagggcttccaggaagggattatttatataccttgtatgcaaagtaacaactttcccatagctttgaaaaaagtggagggtggggagctgcaaaattgtagagaacacagcaacattatttaaagaacttttaaatgagccattccctccaaacgagcacactcctggttgttaagttgctcgttttgttttaccttgtgggatagaataatgatgcagtaacattattcacaaggcaaagctggttgccagctgaaatagacacagaagaaagaattctttatttttcattggaaatgcttgggctctgcagagccagaaatttaaagaaactcagccttttgtttttcctctttctcccttttttgtttttattcaccctctttttgggggtgagtttggtgggcagcctgttgtttcagggccacagatttatggaaagccaaagatctgaattatgcatga

SEQ ID NO: 11595 - DNA, 1029 bp, Homo sapiens
atcccagctactcaggaggctgaggcaggagaatcacttgaacctgggagacagaggttgcaatgagctgagattgtgccactgcactccaacctgggtgacagagcgagactctatctcaaaaaaaaaaaaaagaatatgcatagaaaataccagatgattagctgggtgtggtggtgtgtgcctgtagtcccagctacttgggaggctaaggtgaaataattgcttgatcttggaaggttgaggctgcagtaagctgtgatcatgccactgcactccagcctgagtgacagagcaagaccctgtctcaaaacaaacaaacaaaaataccagaagaaacatactctaaagtgttaataacttcctctgttgagataaccatttaattttctttatgtttttctgtttaaaaaatataacattgtattttttaacaggggagatagaaatattctacacatcttgatttgggtagtgattacatgggtatatacaattctcaaaactctttgaactgagcacttaagatctgcattctattgtatgttttttattattattattattattattattattatttgagacagagttttgctcttgttgcccaggctggagtgaaatggcaccatctctgctcactgcaacctccacctcccaggttcaagcaattctcctgcctcagcctcccaagtagctgggattacaggtgcacaccaccacgcctaatttttttgtatttttagtagagatgggattttgccattttggccaggctggtcttgaactgttgacctcaggtgatacgcctgccttggcatcccaaactgctgggattacaggtgtgggccactgcgtggggcctattgtatgttaattatatctcaataaaaaataaacacacaagcaatatacttttgtacttcctattgtctaatagcatttagaatatataagtaggggctgggtgcggtggcttgtgcctgtaatcccagcactttgggaggccgaggtgggtggatcacgagg

SEQ ID NO: 11596 - DNA, 1047 bp, Homo sapiens
tgtctctgctgaccttgttttcttctcaggccttggagaccctggacaatggcaagccctatgtcatctcctacctggtggatttggacatggtcctcaaatgtctccggtatgggctcagctttcctgttctttgttctggcaggggaaaaggggaggcaacgttgttaggaggtaaaaattaaattacaaaaattcaaaaggggcagagcgcggtatctcatgcctataatcccagcactttgggaggctgagccaggtggattacgtgaggtcaagagtttgagaccagcctggtcaacatgatgaaaccccatctctactaaaaatacaaaaattagctgggcatggtggcgcacacctgtaataccagctactcaggaggctaaggtagaagaatctcttgatccctggaagtggaggtcacagtgagccaagatcacgccactgcactccagcctaggtgacagagtgagactctgtctcaaaaacaaaaacaaaaaatgaataaattacaaaaattcaaaaggatcacaggagtcagagaaggctactctatttagactccagctcatgggaaaatccttcaatatcacaaattgtgattagtcataaatgctttcttttgttcttgagtcacttttggtactttctgtgttatttggaacttgtccattttatcgaggttatctaatttgttggtgtacaattgttcacagtattctcttataatcctttttatctctgtaagatctgtagtgttgtcttcattttcagttttacttatttgggtcttctctctgtttcttagcctagctaaaggtttgtccattttgtaaatgttttcaaagaaccaaacttttggttttgttgattttattatttttctattcaagaaaatattgtcttttgtctatctccgtttcagtctttatttccttccttttactagctttgggtttggtttaatcaaaaatgtttgattgattgattgattgattattattattattttttgagatggagtctcgctctgttgcccaggct

SEQ ID NO: 11597 - DNA, 1022 bp, Homo sapiens
cccagtactttgggaggccaaagtttggaatacattatttcgttaaatatgtggttctcagtggaatgggcagggattttacctcttgggagacatttggtaacatctggagacatttttggttatcacagttggtagcgggtgcttctggcacctagtgggtagacggcaggaatgctgctgaacatcctaaaaggccaaggcaaccccacaacagagaactatctggctcaaaatgtcagtggtgctgaggttgagaaacccaacaaatgtgtagtatttaccactgaaaccaatgtgcctagactttgtttcatgggaagatactcagttattaattcagttttttttacttgttacaggtctattcaggttttctttttcttcttgagtgagttttggtaatttctttctagaaatttgtccattttatctagtgctttaatttgttggcataaagtcgttcatggttttcccttttaatactttgatttctgtaaagtcaattgtgatgttccctctttcctttctaatattaataatttgtgtcctgccctttttgtattggtcaattcagctaaaggtttgttaactttgttgatcttttcaaataatcaacttttggttttcattgattttctctatttttctgtattctgttttatagctctctgctcaaatctttattattttcttctttctgcttgctttgagtatagtctgctctttttctacattttaaaggtagaaggttaggttagtgattgtgatcttttctaaggtaggcatttacagctataaatttctgtttcagcaccacttcaacttcatctcattatttttggcaaattgtgtttgcattttcattgagataaaatattttctaatatctcatgttaaatcttctttgacctcctggttatttataagtgtgttgtttaggccaggtgcagtggctcacgcctgtaatcctcgcactttgggaggccaaggcaggcggatcacgaggtcaggagttcgag

SEQ ID NO: 11598 - DNA, 1033 bp, Homo sapiens
tttcattatgtgattctactgtcttctggcttgcattgtttctgatgaaaagtcagccattatttatattgctgtccatgatttgtcattttttcccttcgtacttacattattttctctttctctttcagtgtttttttttgtgtgtgtgtgtttgtgtgtgtgtgtgagacagggtcttgctctgttgcctaggctggagtgcagtggcatgatctcagcttactgcaacctcaatctcctgggctcaagcaaccctcctacctcagcctacccagtagctgggaccacaggcacaggcatgcaccactacaccaggctaaattttgtattttttgtagagacggagttttgccatgttgcccaggctggtcttgaactcctgacttcaagtgatcctcaccctgcagcctcccaaagtgctgggattacaggcgtgagcaactgcacctggtcttgtctttcagtgttttgactgtggtatgtctaggtgtggttctttttgtgtttatcttatttagagtttgttgagcttcttggaggccataggttattactgttcatcaagttggggaaggttttgcctattatttcttcaaatattcccacctcccccatcttcacccctctttggctctcccattacacatatgttggaacgcttgacattattctacaggtctcatttttctttaatcttttttctgtctattctttggatttgatcatttctttctatgtattttcatgttcactaattattctgtcacctgaaaatctgttgagcacctctttttttttttttttttttccaaaacggagtcttgctctgtcacccaggctggagtgcagtggtgcgatcgcagctcactgcaacctccgcctcctgggttcaagcaattctcctgccccagcctcctgagtagctgggattacagcacctgccactgtgcctggctaatttttgtatttttagtagagacggggtttcactgtgttggccgggctggtctcgagctcctgacctcatgat

SEQ ID NO: 11599 - DNA, 1032 bp, Homo sapiens
agctggcatgtcatttgggacagatacaatgccaggaggtgaactaggtgccgagatgacaaacagcatccttggatgctgtggttatgtgggtttgtcaggcctggaccccaccctccaccttcgcgctgccagttggttgctttgagatggagtctcgctctgttgcccagggtggagtgcagtggtacaatcttggctcactgcaacctccacctcctgggttcaagtgattctcctgcctcagcctcggcagtagctgggattacaggagcccgctaacacgcccagctcatttttgtattttaagtagagatggggtttgaccatgttggccaggctggtctcaaactactgatctcaagcgatctgcccgcctcggccttcccaagtgctgggattacaggcgtgagccaccgcacccagctgctctggcatatcttaagatgggaagatttagtcagaattagggctagtgagtggatgagggagagttgatattcagagtcttttggtagctgtaggactaggtaagaagtcaggcctaaattagaatatgtttgttttttctgcccacctgtgtgggaggctgggtgcccatggacttaggcactgcccctgtcttcccactgctgggtcttcactgagcagtgtctcccttgttggtctcagtttcttcctctataatgggatgaaggtacatgtttaggggcaacacctgggagctgtctcccaacagtacagccatttctccgtggaaattactccctttcaaaagtaagcttgtcctgttgattagaaggtgggggttgggggcaggttctgtgtgctataaagagggactgttttctaaaatagacaagtacaagtttttaggaacgtgggtgcaatgattaaatcaccatctgtcttgacatgctatttccttgctgtattcccagctatttgaccaaaacctcaatgtcctgtaagtagttctttgccagttttctatagaatacatttcctgtccctagagcaacactgattatc

SEQ ID NO: 11600 - DNA, 1089 bp, Homo sapiens
atatgaattgggttaagtctatgtatcagtttgaggagaactggtatctttattacgttgtgtcttccaatttgtaaacatagcaaatctctatttatttacatctttgatttctttcatcagtgtcttgtggttttcatttaataggtcctgtacatattttgttaaatttacatctaaatatttcattttttgagtgattttaaattgtatttttattttgattaaattgttcattgctagtatacagaaatataattgatttttatatgttgctactgtatcctgcaagggggaagattcagtctttcaccattaagtaaaacattaactataggctttttgtagatgttcttattacattgaggtagttttcactctctacctagttttctgggagtttttatcatgaatggatgtaaagcttagccaaatgcttttttctgcaccaattgatatgatcatgggatttttcttatttagcctgctaacatggtgaattcaatgtttgattttcaaacataaaccaatcctgcatccctggaaaaaacaaaacttggtcatggtgtataattctttttttcacattgctgaattttatttgctaatatttggttaaattttttttgcatctatattcatgaaggatattggtctgtagttttctttttttgtactgtctttctctggttttggtatcagggtgatgctggcctcataaaatgaatcggatagggttccctttccttctcttttatttttctagaagagattgtgtagaattagtgttaatttatttttaaaggtttgttataattctccagtgaaaccatctgggcctgattatttttcttgggagatgtgaagttataaattcaattttcttttttctttcttttttttttgagatggagttttcccaggctggagtgcaatggcatgatgtcggctcaccgcaacctccacctcctgggttcaagcgattctcctgcctcagcctcccaagtagctgggattacaggcacgtgccaccatgcctggctaattttgtatttttagtagagacagggtttctccatgttggtcagg

SEQ ID NO: 11601 - DNA, 1027 bp, Homo sapiens
tgccaactcctttgtaggtaggtttgtttatttttgtcagatttcttgttcagggtttactgcgaaaggcctcctgggatgatgagcatgacaggggctgatgtagtatgcagagggtctccttcacctaactgaaaggaaccctgaaggagaaggccttagtatgtctgcagccttgtttattctggacagggttgtgtatatctttgattagtgtgaacaggtactaatggggtgccctgcatgttgctggcactcactaaattgttaaatgagtcagtgggtgaatgaataaatattagtttgtgagagcttgcctcccttgtgggcttgtttccactctatttcttaaacaggggccccttgggaaggggaattagccccaaaagtccctggaacacccacttgctcagctctatacgccctcaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcaggtatggacaagtccaggacggctgggggggcagagagggaggaagctagaaatcgtttccctacttggaacaggaatacccagcatctttccttctgagccactctcaaggagtgtaagtaaacaggttcatggtctctaaaggaatctgctgcccacagtaggcttaacctgagcagattttgggaccatggaatctaagctcagctgtacaggtgcctgaagggaagggaacccctcttccttcacattccacccctctctgacattaaactgtgagaactttgagctctccttgcagggaacactgggcagagggggtgctatgtcccctaggggacagcatagtcagttcttctgtcttcatttcagtttatgtaccaaaactgttaggttttggtgttagctcaaatgcactgatgccaccactaatccaagggcacctcccaaccacagcgac

SEQ ID NO: 11602 - DNA, 1106 bp, Homo sapiens
gtctattaggtccacatggtccagagctgagttcaagtcctgaatatccttgctaattttctgtctcattgatctaacatggacagtgggatgttaaagtctcccactattattgtgtgggagtctaagcctctttgtaggcctctaagaacttactttatgagtctgggtgctcctgtattgggtgcatatatatttaggatagtgagctcttcttgttgcattgatccctttactattatgtaatgcccttgtcttttttgatctttgctggtttaaagtctgttgtatcagagactaggattgcaacccctgcttttttttgcattccatttgcttcataaacattcttctatctctttattttgagcctatgtgtgtctttgcacgtgaggtgtgtctttgcatgtgagatgggtctcctgaatacagcacactgataggtcttgactctatccaatttgccagtctgtgtcttttaatttgggcatttagcccatttacttttaaggttaatattgttatgtgtgaatttgatcctgtcattatgatgctagctggttgttttgcctgttagttgatgcagttttttcctagtgtcgatggtctttacaatttggtatgtttttgcagtggttggtcctggtttttcctttccatatttagtgcctcctttaggagatcttgtaaggcaggcctggtggtgacaacatctctcagcatttgcttgtgtgtaaaggattttatttctcctttgcttatgaagcttagtttggctggatatggaattctgggttgaaaattcttttctttaagaatgttgaatattggcctccactgtcttctggcttgtagggtttctgcagagagatctgctgttagtctgatgggcttccctttgtgggtaacccgccctttctgtctggctgcccttaacattttttccttcatttcaaccttggtgaatgtgatgattatgtgtcttggcgttcctcttcttgaggagtatctttgtggtggtctctgtatttcctgaatttgaatgttggcctgtcttgctaggttggggaagttctcctggataatatcctgaagagtgttttcca

SEQ ID NO: 11603 - DNA, 1077 bp, Homo sapiens
aatgaagtgtgttattttttctgataagagtgctaccatctttcattcttgtgtgccatttctagttggggtgaatttgttttcggagttcctttcccagctgtttgcctgaaaaaccatgaaatgtgttccacatgaactatgaaatgattagatgctaatgtggcaaagaaagtgtgaattctcttgtagaaacagggacatttggttcggtacagtaagttgttaatgcgtgactctgtgctttcaaattctgtggttcaaaagtacttttcactcctactgtgtatttaccttgagaaggtgaatcccctaacaatttggtcaatgtatcagtattctcaacccgtctatcaatttttttttctttctccctcttttttctttttttgggcaaaataccttttttgctttttatccccttaaaataaccattgtccctcacatgtgcactcttccaaatttcagaaaagcaagaggaaagggcacgaatatacaaatattaagtattctctagcggaccagacgagtggagatcagagccctctcccgccttgtactccaacgccaccctgtgcagagtaagtagtgctgaaggaaattctttttacctggtcatggtggtttaaaaaggtttaaaaaacaaaaacaaaaacaaaacacaagtttgtagcacatgcctttcactggtgcacgttcctgttgccctactgttagtgtatctgtgactggtgatatctattgattgtgttaatgctatctcaaccacgttttaattttcctaagctggccaggcacggtggctaacgcctgtaatcccagtgctttgggaggccgaggttcatggattactttgaagtcaggagttcgagaccagcctggccaacatggtgaaaccctgtctctactaaaaatacaaaaattagccgggcatggtggcgcatgcctgtaatcccagctactcaggaggctgaggcaggagaatcgcttgaacccaggaaacggatgttgcagtgagccgagatcatgccactgcactccagcctgggcgatagagtgagcctctgtctaaaaata

SEQ ID NO: 11604 - DNA, 1244 bp, Homo sapiens
atatgttccttaaaaactcttaacttatttcttccccagatgtggactttcaccctctccctaaaaagatcaagaacagacgcaagaaagtttatgtgaagacagaatttggatttggaaggcttgcaatgtggttgactaccttttgataagcaaaatttgaaaccatttaaagaccactgtattttaactcaacaatacctgcttcccaattactcatttcctcagataagaagaaatcatctctacaatgtagacaacattatattttatagaatttgtttgaaattgaggaagcagttaaattgtgcgctgtattttgcagattatggggattcaaattctagtaataggcttttttatttttatttttatacccttaaccagtttaattttttttttcctcattgttggggatgatgagaagaaatgatttgggaaaattaagtaacaacgacctagaaaagtgagaacaatctcatttaccatcatgtatccagtagtggataattcattttgatggcttctatttttggccaaatgagaattaagccagtgcctgagactgtcagaagttgacctttgcactggcattaaagagtcatagaaaaagaatcatggatatttatgaattaaggtaagaggtgtggcttttttttttttcttttttccagccgttgaccaattatagttcggctgttgactgagaagtttgtggtgggaaaacgtttgccatattttctttgcatttgaataattgtcttgtacttagaaaaaaggcgtctatgaatgaccagtgtttttggtcgccaaatgttgctgacaaacttatcccaaaactttagtggcttaaaaaaacctgcccccaactgttagtcaatctgagctgggctcagctgggctgttcttctgccagcctgcaggtggccactcatgtggtcagcaggtcggcggagagactgggatggctgggcttctctctctgcctgcagtcctgagtctctccttcttcgtgtagtctctttcagtggcctggctggcagggtagctagacctctcacatgcagctcagagctcccaagagctcaaaagcagaaatggccaggccttctgaaaacttaagtccagaattgtcacagtgtcccttctacttccctctattgatgatgatgatgatgatgatgatgatgatgatgatgatgatgatggttttttctaatcagaagaaagctggggtatgccct

SEQ ID NO: 11605 - DNA, 1020 bp, Homo sapiens
tggggcaggggtcagagttagaagtacattattttcagtgaatgtgtttgtttgttgctttcaggtattattttgattattttgatttcaaataaaattgtgtttctccttgttgagattggcaggccagttttgtgtctatgttattttaaattatgcatatacacacagacaggaaaggtacaagtggttgcaaattaaaggagtagaaagaatacaaggttaaacccttcccccacatctgttccctaattttcttgctagagacactgtctacttccagtctcgtatgtgtcctgttgcctatttaagtgaatctgcttaaatacaaatggtagcatactgaacatatattttggacacttgtcttttaaattttttaattatggaaaaattcaaacatgcacaggagtagagaggatagtatgataaatccctctgtacttcccatttggtctcaagaattatcagtatatggcttttgctttttcaactatatgaaacactttggatcttgttccaattcagttcatttaaacttgcctcatttattttcacagttgcttagtattctataataaagatgttccataattcatttacccagtcccctttagatggacatttatattgcttcccttcttatgtcactacaaacaatgctgcaataaatatacttttatatccatctttgggcatatgtttgaataaatctgtgagaaattcctggaaatagaattgctgagtcaaagagatgtgtatttaaaatattgatataagtactgccaaatagcctattgatggaattttattaattttcactctcactaagagtatccaagatggctcacttcttcatatgcttaccaacacaatgtgttatcgcatttctaatctttaaaatacactctcctagttttgtttctaaatagacatgaaatctatttagtaagttgtaaaatcctacctatctaggggatagaagtcagcatagaatagaaaatatcaaagaacatcact

SEQ ID NO: 11606 - DNA, 1031 bp, Homo sapiens
ataattaaggatacagtagggggaacaagtgcgtaaatttacattttaacttgtcttttcttcaaataggtattaatatccttgtgaagtccaaggccttccagtatttcatgtgtaagtgtgaaatatctccactctaggccactttccccctgagtcctttgctgttctagaagcgggagaggcaagagattggtcctagagtcctgtgtttgactttttattgtggggaattcccagcatgtataaaagtgaagagaacattaccacacgcatccccgtgcccatcacccatctgtatcttcactccggctcatcatcctctctagacctagattttttggaagcaaattccagaaccacagagttgactggtcgatatgtctcttgagtttgttttaatctataggcttctcttcctcacctcatttaggtgaggaagcaggatttgggttttgtatgttcctctgttgccttttcctggaatttggtagttctgtctagagccatgctgtgcagtgtggaagccactggccacatgtggcaatttacatttaagctaattaaaatgaaaaattcagcttagctgtcacatttcaagtgattaatagccacaaatggctaatgactaccaattggattgtgcagataagaaaatttgtattgtcacagaaaattcccttggacagtactaacctagaggcttgatccaatttggtctttccaaggagctctggttccttttagtaggaaatggtgttagagacacaattcgaggtgctgggtgctcattgcttgggttggtcattgtttctaggcctttccatggacagaactagggttttgttttttttaaagataaactgttgtgcgttcatgctaatacttcacattcaggcctacagcaattttaagattaagaatctagatgtgtaagactgatttcatcaatcttacacgtctagattctcaatccttttttttttgagacagagtctcattctgtcgcccaggctagcgtaatctgtgct

SEQ ID NO: 11607 - DNA, 1031 bp, Homo sapiens
ggccggactctgttgggcgtgggctgcgcagccacggacacctacccaccctcctcccctgcctctgcccctccctccctatccctggccaggtggtgatgacgatcattgtcgcctttatcctcgaggccttcgtcttccgaatgaactacagccgcaagaaccaggactcggaaggtctgtgcagggatgatgccttgggcatttgatatctgccgcctacccagctctgtctgtctgtctgggtggctgtccagccagccatcaggctgtcatttttctgctgtctggctgtccagcttatctatctggcttgtctttctagatcttgtatttgcattgattttcaaatatttaatgtcagaaaacgtaatctaactttaaaataagacagagcatgtcatagttggagaaaaatcaagaagtagagaaaggcttatgtggcagcagcagcccctgccctgcctttccctcccgtcctccagaggcttctccttcttggctatttcttctgttagtcatctccacgtttctcaataataggttcacactacggttcttgatttaaatggtgtaaatattgcttatggcacaggcgaatcgtattcctgctgcaactggatggtgctggctttagtgactgcctcactcttcccagattgcacagctttctgtgtgctgaccctcccttcttcccaaattctccatcaaaactgtctgcacttgatctcttgagcccaggaggtcaagactgcagtgagccatgatcacaccactgcactccagcctgggcagcggagtgagaccctgtctcttaaaagaaacagaaaaccctgtgcccacacttgttacctctcatcctcagatctctgtgctatcagaccatctgaccattttctctgtgcttagaggccccttcctgaaaccctctggccctgtaacagctgccagctagacctgcgctcctgacatcacagcagagggaggggaagggaaaggagggccaacgaggagagcaggacaccaatgca

SEQ ID NO: 11608 - DNA, 1050 bp, Homo sapiens
ccagcaggcgagcctggactcatgcaggtggcatctcggtgggaagtgcagagggccgcatgaagtctgggtgaaactgccacggcattctcttgcccagtggaatcagaagggttattgctgttttgttccctgctatgtcctcagtgcttaaaaaggaacataataggtgctcaaaaaaaaaacattcatggattgactaactgaacacacatatagattggggtccccagtagcagaggtggtgccatcagttataggctttgcaggctaaaggctctcagggcaacttccaggggcctggggtccctatccggggcagagctgggcagggagaggagcctccagggagaggacagcatgagcaaggactcaggtggccacaccagcagcctccgctctggggcagcctgggtggggggctctcagggaagagagcaccccagctgcccgcccttgcctcgcccaccccctaccccacagctcatctacatgcactggatgaacacggtggtgaattactgcggccccttcgagtatgaagtcggctactgcgagaggctgaagagcttcctggaggccaacctagagtggatgcaggaagagatggagtcaaacccagactcaccttactggcaccaggtgagtcctgctgccacgcttggtgggagggggcttccagctggccagccatcctgtctcctgttgttctggccagccttgtggcatgtccagctgcccagccgcctctgtttccatcatcatctccatccctcctagccgacctgccactcatccatctgcccagtctccatctgtccacttgctggaactccagccatccatcctagcctacctacagttaaataatgaccaaaaacaaatagtcagttgttagcatggtgttttgcttgtgtacatatggtgttttgcttgcatacaagggaggttgcttggtagattgattacattggatgcaagtaaagacagtatgagaaagaggggaaggggaaaaccagaaaatcccagaaagtctggacacagtgaatt

SEQ ID NO: 11609 - DNA, 1047 bp, Homo sapiens
ttcctcctcccaagtctgttctcttattgtcaacctcagcacaacaggctggcgccaatggcattacagagaaagcaatctgtgtggctagtgggcagattaccatgcaagccccaggagaaatggaggagctttgtagccacctcgctgtcagccagtattaacatgtccccttccccctgccccgccgtagattcaggacatttgcccctgtgtgccaccaaaccaggactttccccttggcttggcatccctggctctctcctggtacccagcaagacgtctgttccagggcagtgtagcatctttcaagctccgttactatggcgatggccatgatgttacaatcccacttgcctgaataatcaagtgggaaggggaagcagagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccctgtagccatctccagggtgacggaacccagtgtattacctgctggaaccaaggaaactaacaatgtaggttactagtgaataccccaatggtttctccaattatgcccatgccaccaaaacaataaaacaaaattctctaacactgcaaagagtgagccatgcctgttaacactgtaaagaatgtaacatgtgggggacacacaggggcagatgggatggtttagtttaggattttattagtgcatgccctaccctctgggggaacgtcccatctgaggttttcttctcggtggggggatttaacttctgtcctagggaaaacagtgtctgatgaggagtgtttccaacacaggctacatgaattcccctataccagtgcgaaagcagccaggagt

SEQ ID NO: 11610 - DNA, 1085 bp, Homo sapiens
aaaacagtgtgcagactgctggtgtggtgtgacacatggttagcaggaagcagaaggacagagactggcaagaaggaaatacagtttcctagtttatgtacttctttttctgaacgtgccttacttttctgatctgaattccctttatctttctttcacttaccatctgtgtatttctgaaagacgttgccatccttctcatctttcctgaattggctggttcctgtcacatagaatttaaccttaagaatctagtcccccagtctagacattcaaacatgtctcatctgttgtgtctctgtagctaagcaagtggccttactccagcaaatggcctgagtcgttctcagggtgtcacactgagcccggtattttgagggcagtgagctccagggtatgtgttctggtatagggttcctcattgagaagggtgagctgaccgctgcttggagagcctgggggccagtggccgtgctttggctggggtgatctcaggatctgcccttgcttgcacgtcgctgggcttaaggacattcatcttgtgtttctgtttactggaggatcagtggtcaacccagaggtacagcaggccaggttcagaaagcacgtctctcccgtttggctctttatcccacatgcgcactctctgggtgccaccctgcaggtagagagccaagttctccaaccaaggaattggggtgacagaatggcctttggactgtgcaatatatgtatttactgtagattaagaatttgggtgcagtactactagtaaacaaagcactcctgaatcagagtacttctctataagaaattccacctgaggccagctgtggtggctcacacctgtaatcccaacacttttggaggccgacgtgggtggatcacttgaggccaggagttcaagaccagctgggggaaaaccccatctctactaaaaactaaaaaaacaaactagccggacatggtggtgcacgcctataatcccagctacttgggaggctgaggcagaagaattgcttgaacctgggagacggaggttgcagtgagccgaaattgtgccactgaactctagcctgggcaac

SEQ ID NO: 11611 - DNA, 1066 bp, Homo sapiens
cacatttagttatcccaaatactcaatccaaaaaataaaaaaggcaacaaaagaggagaaaagggagcaaagaacagatgggataaatttaaaaaattagcaaaatggtagattaaacccaaccttatgaataatcacagtaaatataaatgatttaaacaccccaattaaaagcaagaccaactacatgctgtctatggaaaacccactttaaacatataaagacacaagcgaaaagatgggagaagttctgcatgctaacactaatcgaaaactggcgtggccatgcaaagtggatttcaaagcaaagactatagtaaccagggataccgagggactttgcctgtgataaagaatcaactcatcaagaggacatacaatcctaaatgattttgcacctaaaaatgatgttgaagaactgtgcacgtgatatcagccccccgacaagtgaggatctgatcaagtgcgacactttataattgaagtaggggaaatcgaaaaagatgaagacacaacaggctttcaggagagaaagatttgaccatttaattgatggagccctggatttttttttttttttttcccaaaaagactcttctcaggatagctctgtgctactcaaccttgtggtgaaggatattttattgcataaagttctgttggaaaaatgatgccagcaaagccaatacttgattaataatgaaaaatgtgtttatagataaactccatgtgtgcttagagtgagctgtggttaaatagcttccacgcttggcagcacccagggtgagtgtgatggtgtacgtcagttactcattgagctcatagttattttatgcacttacaaatgcagccgctcatcctgcacttttccagctaaattccagcccaacttcatgacgtaccaagtcatgacataacaagtggctttggaccaagttgtttaaccgctcggtgcttctgtttcttttctgtgagaggagtaaaatggtgcgcctcccaagatggaagtgaatgcccagtgagaggagacacacgagtctctgaagactcagaagctctatgcaaa

SEQ ID NO: 11612 - DNA, 1049 bp, Homo sapiens
tttagaaactaggcttgataagtggccccacatgtggcacggcaaaagaatcaagtcagtttgtagttttaatcccgcattttagttttcaggttgagctatacagaggctccaagctcctctcctaggatctccacacagggacctggcagctgcttggttttgaggagaggcgatgtggagagctctttgggatggtggatggtgctcagagtttgcttgcagtgtgaacatttatatcttcagccacagttaggctcaccggaaaccagaagggtgttgtggagaagaaacctctgttttctgcataatttcaaaaatattaagaaaaaaattctacaaagttccaaaaagcaaaacttgaatttgcagcaagccaagtactatgttgaatcataatgaagcgatgtgtaggcattgtattcgctcttataagtaatctagagatggtttttaatggaggatgtgtgtaggttatatgcaaataccacaccattttatatgtaaagggagacttgagcatctgtagattttggaattgcagggggtcttggaaccaatcccctgtggatactgagggctgactgtatacactcagtaaagctgacttttcctctggagcaagctgcctcattatgtacgcactgccagggaggtgttccatgcatagtgtcaaagggctctctggtcagtttgcagtccaaatctgactatgttaagtccattttattagtaagccaatgttacatttttttttaaaacgctctgtctctgtggatgaaaagaacagactagtgacttagagttggaggtggggcatccaaattggcatttaaccagtgtgagtcctagagtagtgccagctgtgtgcccactgctggtacattaggggccagccatcatatgtaagaatactccctgagtcagggttgctcggtcagcagcttagaatataggggtttaaaatctgttgttttaataaaaattgcacatctagaaaaaaggaatgaggaagctagactaagtgtggtagagggaagtcttacatt

SEQ ID NO: 11613 - DNA, 1033 bp, Homo sapiens
gttccccccaataggaaaaagttaaacccttttttcaccttccatattttgttatgtttagaaaggtcttcctcctttgaatatgttttatagtttatgtttaactctttgcgctctctgtaatttgtgtaatatatgtgattgatagagctccaagttgagaaaattattatagagtattttgcctctaactgctgttacaaatgggacattttctttgattctatttatttttaaactagattttagcatataaatttatatttgactctgtgttactgaattctctgggactgtcccttctcactgataagaagtctacccacttctttccgattttttttaacctttcattttttccttttgtctaattgtgtctggtttttaaaaagcgatgtgaagtaatggtggtgccagtgcctcactgtttctaaagaccacatctggaatggctgtgacgtttcatcccgttgctttcggcttccatggacgtgactgcctggtttttcgttgattccccttgtctgtggcatcttgctgtggagtctgttcctgatgtttcactcggatatgtagttttctttgatcatgctctcagggttaggctttggtaatagaatgctggcttcatggagaatttggaagctttcctccttttcctaggctgtggaacagttaacttagccctggaggcagctggtccttaacaggtctggccaaagtcacttgttctttttttgcagggattgttgccccttgctggcttcctcaggctgctatttgttattttatctacttggattttctgtctcctggggattcgttttgataattcttattttcccagaaagccatttactcatctaagttttcagatttggagattttaaaaattcaagaaatagaaataatttctgaatagattatagtgactaaagaaactattaaaaaaaaaaaaaaacaggctgggtgcaatggcacatgcctgtaatcccggcactttaggaggctgaggtgggtagatcccttggcc

SEQ ID NO: 11614 - DNA, 1023 bp, Homo sapiens
catttggggctgggtgtggtggctcatgcctataatcccagcacttttggaggctgaggcggtagatcacttgaggtcaggagttcaagaccagcctggccaacatggcgaaaccccgtctctactaaaaatacaaaaattagccgggcgtggtggtgggtgcctgtagttccagctactcgggaggctgaggcatgagaattgcttgaacccgggaggcagaggttgcagtgagccgaggtcatgccactgtactctagcctgggtgacagagggagattccatcttaaaaaaaaaaaaaaagaaagaaagaaaaagaaaacgcagttggctttattctctactagaaggagttacaactctatctttcagaaagcccttactgaagatgaaacaaagaaaaataaagaattggagtccaacacgtgcagcttcaagttgaaagagaaacagttgtgttgggattaaaagccttactttaaaaagtctcttgcccgggtttggattcaaaattctctgcagtatgtttgttctggaacttgttccctttgccttaactgctcctctagatattacagagttgaaaactctgaaggggttggcactgcatgatatcctgacagagatacacttgtttgtgcatagaggtaacttacattatcccccagctgagaagctgtggagaaggtagcctgctttggggttaaggatggttaggacaggaggcttcattcttgaagcaaagaaactaatgaattgtaaatcagacccttcttgttagcagttctgtcttgccactgtttaaaattttgttccagagctgggtacggtggctcaagcctgtaatcctagcactttgggaggccaaagcaggcagatcacctgaggtcaggagttgaagaccagcctgggcaacatggtgaaaccccgtctctactaaaaatacaaaaaattagcctggcatggtggcgcacgcctgtaatcccagctacgtgggaggctgaggtgggagaatcatttgaa

SEQ ID NO: 11615 - DNA, 1051 bp, Homo sapiens
ttaaactatgccactgggtggcagaggctgtataaaacgcacttgttttcatgcaggagcggggcaagtaaggttgagcctgactgtaaacctagaactgcggaaggactgggacttttgtacaaatttcacatttattttacagcaatcatgctgcatttgtgttagtgttctttataataaaaaacaaagcagcctcctggctggctgtgttacaagtgactcttccttagacagctagaaagatgctgactttgtcaaacttgcatttatatgaaaaccttctgtctctaatatcacagaataaactttctttagatgctgttctttataaaatgtcaaattcttaaactgtcaaatggaaaaagtcactattccctttgttcatggaggactcacccccttaaggacagcggcaaagtatgaagctaaatatctgatggccaaccaggcctcaaaccacccagaggctcagcatctgctgtacctggaacttcaagataaccatgaaatgtaaacgttggccaatccattcccagctcttctgctgtactacttgttttatgtgtttattttttgaggcaagatcatgctctgtcagtcacccaggctggaataccgtgacacgatcgtggctcgctacagcctccatgtcccaggctcgagcagttctcccacctcagcctcctgagtagccggaaccacagaaccacaggtaaatgccaccacatcctcagccccctgagtagctggggctaccatgcacaccagcaccacactaagtttttttggctatttatttatttattttttaaataaagattgggtcttatctcactctgttgcccaggctgatcttgaactcctgggctcaagcagtcctcccacctcagcctcccaaagtgctgggattacaggcatgtgccgtcacacccagccctgcttgttttaaaaggggacttttttttttcttaatggaaaaaaatgaaacagagagccaaaagcttttaactgttgtttttttcttttcttcaatgaaagcctctcattt

SEQ ID NO: 11616 - DNA, 1039 bp, Homo sapiens
ataaaaggctggataatattctgttgtgtgtataaaccacattctgatcatcttttcatccatcagtggacagtcgggttgcttctgcttcttggctattgtgaatactgctgcattgaacatgggtgtgcaaatatttaaacaactttttaaaaaataactttgtttctggccgggtgcagtggctcacagctgtaatcccagcactttgggagggcgagatgggtggatcacttgaggtcaggagttttgccaacatggtgaaacctggtctctactaaaaatacaaaaacaaaacaaaacaaaacataactgggcgtggtggcacgtacctgtaatcctagctactcaggaggctgaggcaggagaattgcttgaacccaggaggctgaggttgtagtgagccgagatcatgccactgcactccacgcctaggcaacagagtgagactccgtctcaaaaaaaaaaaaaaaacccactttttaaaaaaataagagctcatggtacctatttgcatccagtacatcattgaagcttgtagaaagctgcttagttaaagtgaggttgggtcacttcgaagtagtcctccagttttctaagcaagtaaattttggaggtagaaagaaaatgttctcctttatcctagaggctcgactgtggtatggtgggcccgggtcattgatttgctttgtccttaattggttgctcctacctgacagaagtgaaatgggtgttctgatggggggtggtgggtggtgacttgagaaggtccgggagcctgaagtgggatgaatgaagagcacagaggctcgttgggaggcgaggataagggggtgcagaggccagatcccacaggccaggagaggctggaactaagggcttgggcttgacaccagttacagcaggggcctaacacattctattaggttgatgcaaaagtaattgcggtttttgccattaatgtgttaattgccattaaatgttaatttgcaccaaatacctgtctggaccctcggtgtcctccttgtaaatggtgtgg

SEQ ID NO: 11617 - DNA, 1050 bp, Homo sapiens
attttggggggtattttggtactgtgatggggtcatcaaattattaatctgaaaatagcaacccagaatgtaaaaaagaaaaaactggggggaaaaagaccaggtctacagtgatagagcaaagcatcaaagaatctttaagggaggtttaaaaaaaaaaaaaaaaaaaaagattggttgcctctgcctttgtgatcctgagtccagaatggtacacaatgtgattttatggtgatgtcactcacctagacaaccagaggctggcattgaggctaacctccaacacagtgcatctcagatgcctcagtaggcatcagtatgtcactctggtccctttaaagagcaatcctggaagaagcaggagggagggtggctttgctgttgttgggacatggcaatctagaccggtagcagcgctcgctgacagcttgggaggaaacctgagatctgtgttttttaaattgatcgttcttcatgggggtaagaaaagctggtctggagttgctgaatgttgcattaattgtgctgtttgcttgtagttgaataaaaatagaaacctgaatgaaggaactgagtccccggatgttttgttctattgggtataggtttcataagtgtgagaagtcaagtctcagggtgagtcgtctccgtgaccagcaagtaacagctgggacttgttctaggggccatatggagggtctgtgcctctacatgtgccattaacccacagcaggagcaaacagttcagatttgaggtttctaaaaaaaaaatcataaaatgtgaggccgagtcttattgcccaaaaagcacctttgcttcaagtggtccttttgacccaagaaggatgttctaaagaagatggctgaaaaccttcccccttggtgaagtctggcgcggacaccgtaacaatgcctaagaagtagcctgcacttcccgttctgatgtgttatccacagaggctcagtaccaaagaggtgcgcagggtaggagggtgagaaggtcacggtctcatgccatctgatgtaccgaaagaaaggaaaggaggtgtt

SEQ ID NO: 11618 - DNA, 1044 bp, Homo sapiens
ccctgtgtttaagtcgggatttttacagagggagctgtctccagacagctccatcaggaaccaagcaaaggccagatagcctgacagataggctagtggtattgtgtatatgggcgggacgtgtgtgtcattattatttgagttatgctgttgtttaggggtaaataacagtaaataattaataataataataataataataaaggagctgacgttcttagccttgtgtggttcttttaatgaggaactaaatgtaataccacctagatatacaacatcagttagcaatgctgtggcttaaagtaatgttgcgcggagccgcgatgcctaaaggagggagaaagggaggccacaaaggctgggcgaggcagtataggagccctgaggagatcgacgtacagctgcaggctgagaagcagaaggccagggaagaagaggagcaaaaagaaggtggagatggggctgcaggtgaccccaaaaaggagaagaaatctctagactcagatgagagtgaggatgaagaagatgactaccagcaaaaccgcaaaggcgttgaagggctcttcaacatcgagaaccccaaccaggtggcacagacaaccaaaaaggtcacacaactgtatctggatgggccaaaggagctttcgaggagagaacgagaagagattgagaagcagaaggcaaaagagcgttacatgaaaatgcacttggccgggaagacagagcaagccaaggctgacctggcccgctggccatcatccggaaacagcgggaggaggctgcccggaagaaggaagaggaaaggaaagcaaaagatgatgccacattgtcaggaaaacgaatgcagtcgctctccctgtataagtaaccgcgacccatgggaggagatgccggggacctgggccgcgctgccaggacctctgctgtgtctcgcccaccctgtgccctggcgccgccgcaacagcccctcgtggccaggagccccccatggcctggggcctcctcttcattttggcacagaaattgtttgggggatgtgggggg

SEQ ID NO: 11619 - DNA, 1035 bp, Homo sapiens
tcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaataattggacatgtgcctggaggagctctgattttattcagtcccttggagaagagactggaactcttcgagagttgcgtttcagtaccgttcttgtggctctgagcggacagggctactccagctgcccaggcctgagaaccagtcctgtgactcacacccattcacacagtttggaaccttaagggacccctaaaactgagcccctctgaacagctcaagtcacaaggggaagctgaagaggggtaacagcagaggctcctggcttcggccagttgttggtgtccccaggccagagggtttgtttccttttgctcctaaacaagcccggtgggacagcctgggatcgtgaccctggcgtgtgagagagcaggacgttgtggagtcagagctgttttcatccactaaaagaggccgtgtccctcctccaaaaaggtggaaggttatgggtgttcctttaagccttctcaggtatcaggaaacattttaaatttagcagaaaagcatgctaatgagctctacccactggtgcagaaaacccaagctgaaaatgctatgtaaaataagactggtttactggagccagtcaccccatgagttctccaagccctggggccacaggggacttccaggtgaggtcactgctgagatgatggaggagacacaaaacaagaggacatggtcagagacaacacatctctgtgcgtattcaaaggatttcattttctttaaaaagcacattatagtcggaaagcctgcccaccaagtgaaagcctccatacccaagaagctaaaggttaatggtgattttacaaaggtggaaaaggagaccttgttttgcccaaatcacaggggcaaagccatatgtcaaatcgtgtcctatgaccaag

SEQ ID NO: 11620 - DNA, 1053 bp, Homo sapiens
tgggggctcagaaggttcagtgggttcacaggggagcagaggctcctgagggcttactcagacaggaagcagccccccaaaacatacttccccttctcctcccacagaaacagaacagataaagttcagaattctaggcccaaaagggtgcaacacccttcaaccagtttcagtgaagagcttgctggcctgggaagtaaagaaggggtttccaaatacagcagtttataaaacagtcctggtgagctatgaagtgaaagagggggagtcacagagctgctcccagttcacctgcttgtgctaagaaacaataaaatacaaattgcttccccaccccaaccctcagtacaaagcaaacttcacaccagagccaccatcagtgacaggcccagtggcggtggatgaggaagagaatacaaaagggaacgtctttaaaatctcttcaaaatcattttgtatagagaagtaaaagcaactcaggcgatatgaattcaaacctcagtgtagaaatctatcaaagtcggtacagtgtccaggcacgccgtcccggagacggaggaagtgactagaaaacattattgctggagaggcttttctcagtagaacaagagcaggtataaaaggggagggcgggtctaaaaggcaggggcagtcgccaggcctagggcactggaagggtaggaggagcacagagaaccttccatggcccctttggttctctgcctttggatggatggatttatgctggcattgtctggagggagccgggtgtcccccaataatcacagaacaaagacaattaggtcgggggaggaataaggataaaaagagaccccaacagaccctgcctgcccttccctgccccccggctgcactgctgaaatatgaggaagagatggctccagtgtggggtgctggccaggccagttcgtggggacgtacatgggctggggtggagcccccagcctctacccctggggaggatggagagtgggcagcctagggagagctacaggagggaggagggggcccagaggctctggcaggggtgaa

SEQ ID NO: 11621 - DNA, 1035 bp, Homo sapiens
acagactttatattctagtgggggagacagacaaaataataatataacgacgaaggtgcaatgttatgtgctatgagaaaacgcagtcggaggatggcgaggaaggggaacggaattttagatagggcggtctgggatcagaacctccagatgcccgtccatggactccaacgaagggagcgattccaggtaccagggcaccctgcacaaacctctcttgagcttccgcctcgcccaggtggggacggtagggagaccggagggcacacgcatgcgcacgaaggaaacggtaaagcctgaagggaggtgcagagcgcatgctctctcttgcccgagatgccgaggattttgacaaggactccgtcgtcccggatgatagtgctcaggttaatgccagtgggagggcggcgcccaatagtaacttcctttggaggttgtagtaccgcccccagagccaattttccacttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcaggtactggggccggggtcgacgggtcgagcctcagccccactcgggcgagacagggagggactgtgaccttggcccgaggccttgcgggagggaaagtgagacccgggcccgccccataccggcgctgaacgtttgtggcttctccgcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaaggtacgcccttgtacatctcttcaagcgtccgttctcttttcgttatgtgtgccttagtgcaagttcttcattctctgaaggcatgggtgccaggcgtgtacagcttgtttatcctcacaaacagaaaatgtattttctt

SEQ ID NO: 11622 - DNA, 1031 bp, Homo sapiens
cctttcaaactcagatctcttatttaataacctggtcccagatccattcctctgtcgaagaggaagtcatccttcagtggctattcattgtggggttaagagcgcagactatgaattcagtctttttgggtcccagtttgccagaccttgagtgagtgccccgagtttacttacttgtaaaggtaggtggaggtaatataattaaataaacttaaaaaactaattaaaaacaaaacaaatgaactaaggtcttaggatatctggcgtctattttgcgccaaatacacataatgtctattgttgtgtgttggactataggattgtcctttaacagggaaggttttatttctgtaatcaagtctgtcaatattatgaccatgttgataatagctacctttaattgagggcttaccatgtgccaagtactaggtgaagtttttacctctgttttcactgtgccagtcactgacttgtctaccagggtgaaattgttcatatttaaagaaggaataaactgagcaggtaggatgttaggagttggcagaggctagagtcccggtgttcttcattttatttcgaagtttgtactaatctctgctctcttttgtatttcagtcacattagcagtaataggaaggtgttttcagcgacagtggggatgttgtggcagagagggaaatatttgaagtccctaaatgtggaggtccagtttaaaacttgtcaagattaaaaaaactgtttagagtgagaccgggcgcggtggctcatgcctgtaatccgaacactttgggaggctgaggtgggaggatagcttgagcccaggagtttcacaccagcttgggcaagatagtaagaccctcgtctccataagaaaaaaaaaaaattagccgagtgtggtggcacacacctgtaaccctacctacttggaagggtaaggtgggaggatcgcttaagctcaaggaagttgaggctgcggtgagctatatcacgatactgcataccatccagcctgggtaacagagacccccatc

SEQ ID NO: 11623 - DNA, 1072 bp, Homo sapiens
gagaggcctaaaactttgacagtccctaatcagttcttcaagcagtgaaccttctggtggcattttgtttcagcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagaggtgagattgagacatttactcagttagatcccaatctcttcactccttgccctgctacatatgagtgtccatgtttcagtgttgttgccacagagtcacatcagtatgttgttggtgataccattacgatgcagctgatgaagagggagaaaggggtgttggtggctttgcccaaatccaaatggatgaatgtagaccatcccattcatctaggaggtgagttctttaaattttggggacaaataatcctgggtacattctttaaggtgattgaatatatctaagcatcagaaagtgaagcctttgggcagggcacatctggcatgttcatattagtcataggattccagtaggttagggtggggtttgtagagagtagattaattattggtttcaagtttgtttaatctatacatcctaatttttcattttacaaggttttattacatagtgtctttcactgtgcccaatcttagaggttctgtggtcagccagtcttggtgcctgtcgtcaagaaactcagtagtccgatagaagagacagactggtagactggccattaggataaagagtgtgataagtgctcacaatgaatgccagagatgtattccctgtgtttcatgcagaaatgagcatttgattaaaatagcatttcagtctctggggaaaagatagatttctcaataaatggtattgaaacaattgattctccctaaggaaaaaataaaattagattcctatttcataccattcatgaaattaattccagatagattgaagaagtaaatgtaaaaaatccaaaagttttaacctt

SEQ ID NO: 11624 - DNA, 1787 bp, Homo sapiens
gcagatcacttgagctcaggagttcaagaccaggctggacaacatggtgaaacctcatctctttaaaaattcaaaaaattagctaggtgtggtggcacgtgcctgtggtcccggctactcgggaggctgaggtgggaggatcgcttgagcctgggaggcagaggatgcagtgaacagagatcgtaccactacactccagcctgggtgacagagtgagaccccatctcaaaaaaaaaaaaaaaaaattgaattctgtaaatgggtttacaagggttatctttcctttgcagacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcaggtaaacaggtgaaatttaatgaattcacccatcagttagaccttatgcaaagctttggtgtctgagtttacaaccccggcccactcagcatggtgtggacttcaggggcataaccttactttggtagtcctgaggtacatcaaattcttttattcatctttcccacttgctatactgactgctttaccctgccagcttctaagcacctcaaggagctctttaggcaggatagttgaaaatggagtcttccctttgacccacctatttttgtttctagtttttgtttgagatactcccctgtatgcctaaacatctttgtacatgtctctttattgtagcatcgttttaatagctcaaaaaaaaaaaacagtttagaaagcctaccaataagaaaatgactaaattatagtatttatactgtaaaatgtttcacaccagaaggccgggcgtggtggcttatgcctgtaatcccagcactttgggaggccaaggcgggtggatcacgaggtcaggaattcaagaccagcctgaccaacacagtgaaaccctatctctactgaaaatacaaaaattagcagggcatggtggcaggcgcctgtagtcccagctacttgggaggctgaggcaacagaattgcttgaacctgggaggcggaggtctcagtgagacaaggttgcgtcactgcattccagcctgggcgacagagcgagactttgtctcaaaaaaaaaaaaaaaaaatcacacctgttaaagaagggaatgtaattcttctattcacgtactaatgggaagataaaagtaatttgtagaacaagaataaatgttcgtgggttttaaaaaaacaccaccaccaccacaaaactaaagcatttcattatgggtgtgtgtgtgtgtgtgtgtgtatgtatatatatatatgtaaatgtatagaaaaacttctgttagaaggcaggggaggaaataaaaaaatattaaatgtatagaaaagaattgaaggccaggcacggtggctcacacctgtaatctcagcactttgggaggccaaggtgggcagattcccttgagctcaggagttcaagaccaaccaaattttgtctctacaaaaaatacgaaatttagccaggtgtggtagtgtgtacctgtagtcccagctacttgggaggctgaggtggggagatggcttgagcctaggaggcaaaggttgcagtgagcccagattgggccactgcactctagcctgggcaacacagccagaccctctcaaaaaaaaaaagaaaaatactgagacagatgtgttccaaattggtagtagtgttacattctaaggaatgagactggatt

SEQ ID NO: 11625 - DNA, 1069 bp, Homo sapiens
agacactctggatacggttttgcctatcctgcatgcaatgcttccgccaagactaccatccatggactcacagagtgccttatccaccgtcatggtattccacacagcattacctctgaccacggcactcactttgcagctaaagaagtgtggtagtgggctcatgctcatggaattcactggtcttaccatgttcctcattatcccgaagcagctggattgatagaacagtggaatggccttttgaagtcacaattacagtgccaactaggtgacaatagtttgcaggcctggggcaaagttctccagaagaccacgtatgctctgaatcagtgtccaatatatggtactgtttccctcatagccaggattaatgggtccaggggtggaagtggaagtggcaccaatcaccgacacccctagtgacccactagcaaaatttttgcttcttgttcccgcaacattatgttctgctagcctagaggtcttagttccagagggaggaacactgccaccaggagacacaacaatgattccattaaagtggaagttaagattgtcacctggatactttgggctcctcctgcctctaagtcaacgggctaagaagaaagttacagtattggctggggcgactgactcagactatcaagatgaaatcagtctactgctccacaatggaggtaaggaagagtatgcgtgaaatacaggagatcccagagggcatctcttagtattcccgtgccctgtgattaaggtcaatgggaaactacaacaacccaatccaggcaggactgcaaatggcccagaccctacaggaatgaaggtttgggtcactccaccaggtaaaaaaaaccacaacccactgaggtgcttgctgaaggcaaagggaatacagtttgggtagtagaagaaggtagtcataatacaactaccaccacgtgactggtggcagaaacaagaactgtaattgcattgaatattgaatatcctccttattttgttaagaatatgtttgtgcctgtatacacttgtactaagaaaatgtcttcattttatttcctttctt

SEQ ID NO: 11626 - DNA, 1050 bp, Homo sapiens
ccctgctggaaaaagctgggtgcaggaaacagggacacttgcacgcggggaatctggctggggctgtaggtctcaaaccggacatctgaggcgtgagatgaattcatatcaaagccgaccctggagggacgaggaagagccagtcatctaaaaagctccagctgtgggacctcgaagagcgcttcgtaaagggcttcttctctgcccggcaccccaaggaagctggggagaggtctttgctgtggatgaggcagggggcgaggaggaggaggttcagagaccttttgctcatgccctctctgcctgcgctgcctccgtcatgctcccctcggggccatctcctggtttccttcgggtcagagaaattgcacacagagcagaaggatctgatctgactgttggctcatctgcactgccggcccccgagcctcgtcccatttcagtgacaaggcaagtgtgaaaaatggagcatgatggaggcgtcaccagacctcccaggctctcgactggagccgcagctctcaatgcagctggaattgccaggggcagtgagtgcttgtccagctcactgctctttggaaggggcattcatctccctgagcgcttgtgtgtgcatgcatgtgtgtgtgtgtttgtgcgcgcgtgtgtgtgtgcatgcacgtttgtgtgtgtgtgtgtgcgcgcgcgcacacacacaaggctgggagctgtgcggcaggcaccctggcttcgggaacccaaactagccagcttccctttctgggcctgctggcctaattcccagccgcagctgccattctgggcccccctccctgaggccatctccctgcagatttggcagcggggaaaggaggggccgagagaaggggagagaaccagagacaggactgagcgctaatctgatgtagatgatccggcagccttctccagcttggttcccctctgccatcagctctccaggtgactttccctgtgccctgcactctccccttctgctttcatctccttaagaaagtgcccagaaagttaaacccacacacaaacacacac

SEQ ID NO: 11627 - DNA, 1050 bp, Homo sapiens
tggtgagtccatatccacgagcaaaataatgatgatgataataataataataatatcagatacattgttttgagcacttactaggtgagcactgtgcctagtgtgttggcggattgcctcatttaagcctcagagcagctctaagaggtaggtgcttttatcatccccattttacagatgagaaaactgacttgggctgggcgcagcggctcacgcctgtaatcccagcactttgggaggccgaggtaggtggatcacttgaggtcaggagtttgagaccaccctggccaacatggtgaaaccccatctctactaaaatacaaaaattagctaggcatggtggcgggtgcctgtaatcccagctactcaagaggctgaggcaggagaatcgcttgaacccaggaggcagaggttgcagtgagccaaggtcgcgccatggcactccagcctgggtgacagagtaagactccaactcaaaaaagaaagaaagaaagaaaactggagtgcagaggtcacatgctcgaggtaacagcttgttggtggtagaggtaggattcacacttggatagcctgactcaagagcctcttgtgctcctaatgacaactctgtatacgtggcactgtccggtagaactttctacagtgatggaaatattctaaattccgtgctgtccgatacagtagccactagccacatgtggctattgaccacttgaaatgtggctagtgcaactaaggaactgaattatggattttatgttattcttactcaaatttacatagccacatgtggctagcggctagtgaattggccagctttctacaagtagctaaatagttcaaagagaggagaggactaatgaggatgttatagaggtaaacatttgtaggttgcatttattgaatgccacatgctaaacactttaatatcttgtctcactgaatgcacactaaggccctgtgaggtgggtactggtattaacccattttacagatgaggagactgtggctcaaacagcagagtgacctgcctgaggaagtagatctgag

SEQ ID NO: 11628 - DNA, 1001 bp, Homo sapiens
ccaaggttgggagagggccagggccaagagaggttttctgctcttctgatactgacccgaggtaagtaactttttacttttatcctctctcattccttgtcagtttgtgaaatgtgaaaggtgattcccctaggacttggacatcttaggcagattgccttgccctgcaggatgctccagccttgtggacagagtggcatggcttcactgctttgcaggcacctccttcattgtcatttattcattcagcaaactgtatgagtggcgactatgtgccaggtcccgtgctaggcactggaggtgcagtggtgactttttttttctgctgttggtttatctgagtgaatgttcaagtaagtaggtgaggtggagttttgtgagtctgtgggaaggaaggaaattagcatcacacctttcttttatgagcctgtttttgtttacagctttggaactttttgaatgaaaattataaaaaaaacacacaacaactaaagctggaattttattcgtaaggacaatgaagaatgactttccaaagcagatatcctgtttgttttagactctgggcttttctgaatgagagaaaacattctttgaacttcatcttgtatggagttcctggccatcccccttgttttaggaggtttctctgaagccctccctcttggggaaccaggcagctgcaacacagcactttcttctggtaatgagttagacttgttctccgtacagtcagggggaaaaagtcattttaatgtgcttttagaaagttccgctctgaggtttacaggggctgttggcctgattagtgtttagtttctttcattttactcttccatagtaatggctgtatgattcctgcctttgttggagctctgtttggagccaggtgcagagtgggtggccccttttatggagagggttattagcattgccctggaaatgcctctggctgttctggggtctttgcttttcttttgtgtcttgcctctgatgtgctt

SEQ ID NO: 11629 - DNA, 1050 bp, Homo sapiens
cagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctggtatctgatgttcatttattcccatgttcttgtgtgtcacagttcagcca

SEQ ID NO: 11630 - DNA, 1016 bp, Homo sapiens
tcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgaga

SEQ ID NO: 11631 - DNA, 1214 bp, Homo sapiens
ggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacacggaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactga

SEQ ID NO: 11632 - DNA, 1041 bp, Homo sapiens
ctcgtgaattaagaatgatttcagagtttcagaaatgcgtttcctgcacaaaaggcaaccatcctaagctttttcgttgataggaggatgggtgggaagaaaaatgttgcccagtccctgccctgggtgatctccctttttctgttctctgccaagccagtccctgacttgacgtcttttctcttgctgctgttttccctgcaggagtgtgcactcacctagttaggcctatcttggcctgcccatcactcctggcgtgcagtctcctaaccctgtggcagcagcaacattccctggatggatcgaaggctgccatggtgtctgctgagctgctatagcaggcagcccagggctgttcaggtgcacctcaggttgccgattgcagctctagtaatttggggatggaaatttggggggagtaggccttggtccaccctgtgcgaaagggaattcccatttcctaaaagagttttaatttgattctagatatttggatgcccccgtttcccaatactgtttgggttgagactgtccttaccagacctgaacgtatctttagacattcttgttagttttattgaaacagtgtgaaaaagcttcttttcttctgaaccagttttcatttggggctctgaaagtacagatgctcagcacctggtcttggtaacctcatgccctctcctgccatccaagtgagttagggtattctgtgcctggccctaagcaggattctcagtgggcactcagatcctatctgggggcttgggattgttgctcattgtccaaacccacctctgcagcttcttagagtctggcaacctctttgttactcttcttaacgtctcgttcattctatccagcagattatttgagtaccctctaagagtccaaagccaatgttagcctttttagcagttacagaataatcagtagttgtcaagtttgtcgtcttaataaagagacaacttgtaaaacacgaaaacaactaactcaggcaataaaagatcaagtatcaaaatgagctgtggagaagatgctatc

SEQ ID NO: 11633 - DNA, 1026 bp, Homo sapiens
accactatctgattctgtctctattggaaaacttggatacttttaaaatgaaatttgaacgttcatatttacagtcacaaattctcaagagtctggtttagatgctctgtggcacctgaagcaattattggcctttgctcacaaacacaactcacttatttctcccttttctcctgcttcttcatcgtttcttccacccagggctggttcccaggtgggatgacggaaaggtgaggaagcccttagagcatttgccaatgggagccattcatttgactttaaagtactgagaatttagaggcgttcttttaaatgcattatttaaaaagaaaggtaacacattaaggactttgctgcatcttttgattggctttcttctaggaagtagtgaccgaggtttccactttcctccaagaggaagagacagaagttttggcaaataggtcaatgctgggaacagatgcctgcctggctgagtgctgggaaagaaaggcagttggagggatgtgtgggtgcctgggagggcgtgggtggtgcccaggaggctatgggaatcagaatcacacttgcacaagagaagacccttatgggacaagtaaaatcagcatagtttcttgggcggggcaaaggtgtcctgatgaggatgctaggggtcaaatatgtgtctgggttctgccccaatcgggaatgagacacagtactgaagtggaacgggggtagcatctccacccaccttcacagcctctggggaaaagaaagctttccttgcagcccaactccaggggcctaaatattgagcaccaacacaagacaggtccttgagcttctcggagcgagtcggggaagcagataatttcagatgcaaagtgccttgaataaacagaacgaaagatagagagccagagggggagaaacggcttggtgtggtcagggcaggcatccatgagacctaaacgaagagggggcattccagacaaaaggaacagtgatcacagaggccccgagtcaggaaccagctaagggtct

SEQ ID NO: 11634 - DNA, 1046 bp, Homo sapiens
tcctcacctcaagtgatccacctgcctcggcctcccaaagtgccggaattacaggtgtgagccaccgcacccagccatatatttttaaatggtcttactgagatgcaattcacatgccataccgttcacacatttgaagtgcagaattcatagttttcactatattcacagataagtgcaggcttcaccacagtcgattttagaacatttccgtcatctcaaaaagaaaccctgcacccttctgtcatcccccggcccctggcaacagtggtctactttctgtctctgcagatgtgcctcttctgagcatttcatataatcaatatgtggccttttgcgtctggctccttccccttagcctgatgttttcaagcttcatccatgtcgtagcctgtgtcagtacctcgtctctttttatggccaaatcatattctgctgtgttgacagacgacgttttgttcatctctttatctgtgtgacgaacgagtggttctttttgttgttgttgttgttgttgaagactgtgtgcacagaatcaatgtttctttgaaaaaataaataaatttaaaaagccctaggtcaagagattgagaccatcatggccaacttggtgaaaccccgtctctactaaaaaatccaaaaattagctgggcatggtggtgtgcgcctgtagtcccagctactcgggaggctgaggcagaagaattgcttgaactggggaggtggaggttgcagtgagccaagattggtgcccctacactccagcctggcaacagagggagactccatctcaaaaaaaaaaaaaaaaaaagtccctgcactgatgctgtgttggggctggcttagtcccctcctgcaatgctggctggtcacattcttactgttagatgttggaggtcagggtcccttgagggaggcaggcaggatgtaccaggtgggatgttgagagcaaactgttcaggttcaggagaggacactggtgctggaggaggaggtctccctgtgcccctgtacctcgtgggccccgcatcctcctgcttgcacag

SEQ ID NO: 11635 - DNA, 1034 bp, Homo sapiens
gggctaaattaagtgtttttcttcattttctttctggggaacaaagaggaaattcccttccttgtatagaaacgtgaggaatgggacaaaattgtccccctccaaaattggtatctacacagagaatccatctgttttcccaaaataagtccttctattccctttaccagagctgtgtagttgaaaaaaaaattttcagcctagaattttaatgctcatactcattaacatggtttgaaaaattgtattcttccctaattcattgtaaaactatccctgatacaaaggtcataatctctgacagtgctgcttttaaaaaggggtgtcatttgagatttttggttttctttaccaagaaaacatattttgaactttctaaatagcatgtaaaattttataatgttacattgtctgtgaagagataataggaattttttacacagttacttgtcagtcataccatggtggaaagaggagcaggagaaaaagaagtttttgtccatgaggaactttcactgtagtccaggaggcaacatcagacatgaattagaagggggataaaagctaagagagctgttggtttagtagctacattagtaggaagctaaacttgtaaaactgcacttctgttaaccctggaatgaagagaagtttatcctgggagtactttctgcagttgaggtatttttttccccaaaaaatgtaacgtgcaaactaaattttttagaacaaagtttttccagttttaagagtgcatactctaaagaactgtggatgaatcctttacttaaaagaacattaactttattattattaattttttttgagatggagtctcgctctgtcacccaggctggagtgcagtggcgcaatcttggctcactgcaaactccgcctcctgggttcaagcgattctcctgcctcagcctcccgactagctgggactacaggcacgtgccaccatgcccaactaatctttttttttttttttttttttttttttgagatggagtcccgctctgttgcccaggctg

SEQ ID NO: 11636 - DNA, 1081 bp, Homo sapiens
agccattttccatctagaaaaatacttaattggagggattatattactgctcaagttttatagacattgtttctcatgttcaggcatcctttctcctgaactttgacctgtttgtatcattttattttctattatgtttatttccaaaagcaagaaatttgttagtctgtagttttgttcacaaatgatttactgtaactatgattcagattcaagtttcaaaaaagtatcccgtaccttaactttcaaatgaataaatgaatgcaataaattaactactctttagagattcaacatcaaatacttagctaacagttattttcactaagatggaaagtcattcagagacccatcatattggtaggcctccttgctctctttgatctttagtttagtcttctgaaatacttaaggaaaaaaaatgttagcttgcaggaacaatgcagcgagcagaaacgaccacatcttagtgccctctttaagcttctctagtggcaaggctttgattgtgattaggctgtgtagtttacagattactgtattagtgggtcctgtattttcttggattcaccttgagagatcagttgcctttctctttccctgtcagtctgttatgctttttgtctcctgctctttaaatggaggaaattgttcatgtaggaaaagaccaggaagtgtgattctgctttctgctctgtgtggttcaagctctgttttgttaattacatgtttataccaaggggtggaaaggttttaattcattaacacaagagtgtgtttttcttaaagtcctatattagaacttctgtgaatccagactgccttggcaatgaatattttgattttcatggcttttgaaacatgaaaatacctctggaaatagtctggtgccactggggacttcactaagaactaaaattaaattttagtagaaggcagaaagaaaactcatgctttcataatggtttatatcttgctgtcatcaaatgcttttctttcttcagcatgtttgctgtgactgcaagaaggatttttgctccgtttgttcagtcttacaagaaaatctccgtagatgttctac

SEQ ID NO: 11637 - DNA, 1050 bp, Homo sapiens
ggaattagattgtctaagtacgctgtggtaggactgagatctttcaaatcagatgcccctgatgcttgggctgacccatcagagctttagcttttttctgtctgcatcttacaggctccagttaaactagccatttgcaggtactttgataatgacacagtgctgtcccatatccttaatggctttggcattccattatgggaccttcctgagagagttaatactctggttagattttataactttacacacacacaggaatttgtgttttgagctaactttatggaaggtaggttcttcatgcaattttgtagggcccaactttttggaagggtcagcagcattctgaatccaaagatgtgcattatgctggctttctggtcatcatggggagcatcaatgacaaggttttctctagtgataaatacagattgattcctgacctaatcagatacgttgtataagtgtaggtacaaagtgaaatcacttcagcaaacacagaagatgatgatgacgacgatgatgaggatgatgatgatgaagaagaaaacgcagaggatcgggtgaggccacctataaaatttggtttccctgacatgtcagcctgacaggaagggacagtgccctgtggacattcgctagattagtacaggatgtttcttctggtttgaatgtaggacagtatactgaaacacttctaggactgctgagatggctgggagaatattcagggccagtgatgagtttagagtggggagggtctggacttatgggaccagggctaatggatgctctgtggtttcagaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctgtaggtttatcttttcattttttccctgtagtatttttcctta

SEQ ID NO: 11638 - DNA, 1057 bp, Homo sapiens
tatatatagcctggtaggtgagttaaaacaaattctggaaagcactctaaggctgtgctgtttgatgggatacattagctacatacagctacttaaatttaattaaaataaaatgtaaaattcagctccttaacccagtacctacatttgaaggggctagaagtgacagcactgaatggtgcagatacagaatatccctatcattggctgggcgctgtgggtcacacctgtaatcccagcattttgggatgctgaggcaggtggatcacctgaggtcaggagttcaagaccagcctggccaacaggatgaaacccccgtctctattaaaaatacaaaaattggacaagcgtggtggtgcacacctgtaatcccagcaactcgggaggctgaggcaggagaattgcttgaacccaggaggcagagtttgcaatgagctgattgcaccactgcactcaagcctgggtgacagagggggattctgtctcaaaaaaaaaaaaagaatatcttgaataactctatcatcttctgtgggacagccctgaagggaggcttagcatagtgggcaaccctgtgggctctggattcctgtaagctctgagttcgaatcctatcattatttcctagctataaaatttggccaagcaagttaacctgtctttgagcctcagccataaaggtggggaattacagccccttatggagatttggcaaggattcaaaggtactgcaaatgtgaggggctttgcacaaagtcatagtaatattataaaaaatctggagtgaagccaggcgcagtggctcatgcctataatcccagcaatttgggaggccaaggcggacagatcacctgtgctcaggagttcgagaccagcttgggcaacatgataaaaccctatctctactaaaaatacaaaaattagctgggtgtggtggcgtgcgcctgtagtcccagctactcaggaggctgaggcacaagaaccgcttgaacccaggaggcagaggttgcagtgagccaagatcattcactgcactccagcctgggtgacatcccgagac

SEQ ID NO: 11639 - DNA, 1050 bp, Homo sapiens
cccgcaactctgctgcccgcggtgcagcgccttgcccttcctgagccccccggcccgggcggtggggacagtcagggcctagggagtgccccggagaggccctgggggcggacgggaggcatggaccagccccctcccatcacccggcgcttcagctcttcgtccacgtggggcgccgggtcgcagccccctcttccgccgccctcccactggctctctgctccacgcacccccttcgctgcagaaagttggtctgtggcctctgaggcaagttccaggcgtgttcatctgtgggggtggttcaaagagaacagcccagcccccacctctgcagggtctccccagatctcaccccgccccctcccatctgcttttggtagctcagctcccaccccgtgctctggcggggcagcactatcctgcagctctgttttgggaggtgtacttaagagctgttcaccttgaacctctaggttgtgcttggggattagggacccctatttcctgtctttgggggctctgacgctgctgcaggctgattttggcgtggagagcatctgtcagttcggacagctgagtagcctcacccagtgataggggaaactcccagctctatccttctggcccggagccttacacggggtggagtgagggcgggtgtaaggcgggggtcccctgagagaatggcattgctgctgggtgtggggagcggtcctggcagcagttgttcctgctaagaggttcagagaggccccagctacctaccgtgttgactagagacgcctcaggaaaccttggggttgaccaagagggactcggtgactatttttgaagacagggctgttccctctccagtcacgggattgtttttcggggggttggctttgcctgaaattacattgcacactatcaccccagtcctctcatttggagcagtgacattgtccctgtccatgtacctcttgtctgcagttcagttggcctcctacagtgtgcagaggggagaggaggttgccaagggtgtctctgatgggtctttctagacacgtg

SEQ ID NO: 11640 - DNA, 1045 bp, Homo sapiens
gaaaatctgtgtataagtggacatgcagttgaaacccgtgtcgtttaagggtcagttgcatttgataattgtactatggatatttgagagaatatagctgttcttactatatacacactgtactatttaggagaaaagaggtgtgttgcctgcaactgactcccaaatggtttagcactggagtgggcaaatctttttggtaaaaggccaaatagtaaaaattttgagctttatgggccatatggtctctgtcacaactacttgttttgctgttagagtcccagcacagccacagggaatatttgaatgggtgggtgtggctgtgttccaataaaactttatttatggatactgcaatgccaatttatataattttcacacaccacgaaagattcttgtgattttttttcaaccctgcaaaacccatttctgtcttactgagcatacaaaattaggtagccagacttggcctgcggcggtggtttacgaatgcctgcttgatagagaaaaagaacacacaggcaggcacacatacatgggggataaagcaaatacagcatgatggaacagctagtgaatctggtgaagaatagaggcgagttctttgtattgtttttgtaattctgcaagcttgaaattattattattactattattattattttgagacagagtttcactcttgttgcccaagctggagtgcaatggcgcgatctcggctcaccacaacctgtgcctcccgggttcaagcgattctcctgattcagcctcctgaatagctgggattacaggcatgtgccatcacgcctggctaattttgtgttgttagtagagacagggtttctccatgttagtcaggctggtttcaaacttctgacttcaggtgatccatctgccttggcctcccaaagtgctgggattacaggcatgagccactgcgcctgaaattattattattattattcatttatttatttatttgagacggagtctcactctggagtgcagtggcataatctcagctcaccgcaacctccacctcctg

SEQ ID NO: 11641 - DNA, 1043 bp, Homo sapiens
ctctccaggcattgccagctgtcctcagttgagaagtgctgggttagaaggttgacccgtgagttagggtcttagaccaaggacccctgtcattctgagatgtgtctgctgacttgttttctggttttgagagttccgtgttaccaaagaataacagaccatgattggtcgactgcttatgctttcaggtgcctttttgtctgtctcttggtcatctgtaggttattcctttatttctattttttaaaattattttcattcattcattcattcattcagagatgaagtctcgctctgttgcccaggctggggtgcagtggtgcaatctcggctcactgcaacctctgcctcccgggttcaagcaattcttcctgtctcagcctcccgagtagctgggattacaggtgcccgccaccacgcccagctaatttttgtacttttactagagacagggtttcaccatgttggccaggctggtctcaaattcctgaccttaagtgatcatcctgcctcggcctcccaaagtgctgagattacaggtgtgagccaccatgcctggccttactttttttgagatagtgtcttgctctgtcacccaggctggagtgcagtggcgcaatcacggctcaccacagccttgatctcctgggctcaagcgatcctcccaccttagcctcatgaatactaggactacatgcatgtaccaccatgcttggttgttgttttttgttattgttgttgttgtttttgagatggagttttgctctgtcacccaggctggaatgcagtggtgctatcttggctcactgaacctctgcctcccgggttcaagtgattctcctgcctcagcctcccaagtagctgggattataggggcctgccaccacacccagctgatttttatattttcagtagagacagggttttgccattttggccaggctggtctcgaactcctgacttcaggtgatctgcccacttcagtttcccaaagtgctgggattacaggcatgagccaccacacccagcccctggttgttttc

SEQ ID NO: 11642 - DNA, 1035 bp, Homo sapiens
gggctgtctgcatgcgcagtggcctgcgagctgggaggggcgcgtgcgcagtttgtttcctggagttgcacacatgctcacttgaggcatccttccctttgccagtggaatgtccccggaaagtcatgtacgagttaaacactgtcattttgcctcctagtgcacgtgcttgagcccacttgctcagctcctgagatcttaccaggaggctgctgatcaccagcttcatgtttttcctatctatagggagattgcctttccctggcactgggtgtggccaattattatttaagagagacagttaacaaccacctgaccattacctgatggtcacctgacattcctggttggagggggccctgtttatatctgattagctacctactctaactctctaacatcacagacggtagggcccataggtaattttttgtattaaatacatgtaacaaagtttacagatgctttaagggggcagagggagtttatatcttaacactgcaggcaaccttaaatagaacattaagtctcccattcttttgtttttttttgggacagagtctcgctctgtcgctcaggctggagtgcaatggcacgatctcagctcactgcaacctccacctcctgggttcaagcaattctcctacctcagcctcccaagcagctgggactacaggtgtgtgccaccacaccctggtaatttttgtatttttagtagagatggagtttcaccatattggccaaactggtctcgaactcctggcctcaagtgatccatctgtctcagcctccccaagtgctgggattacaggcgggagccaccacgcctggccaagtctcccgttcttaaagtccttccgttaacatcccaccagaaatttcacatcacatgggaagagtttagaagacagacaggttgccctgggctgagtggtcagggaaggagggggagactcagctggagcttgaagcgcaggtgggactcagggagaaagatgaggaggttcagaggcatttgcagggccggggaagacg

SEQ ID NO: 11643 - DNA, 1045 bp, Homo sapiens
tgaaaccctgtctctactaaaaatacaaaaattagccggacgtggtggtgtgcgcatgtagtcccagctactcaggaggctgaggcaagagaatcgcttgaacccaggaggtggagcttgcagtgagccaagatcatgccactgcactctagcctgagtgacagaatgagactctgtcccaaaaaaaaaaaaaaaaaaaaattcccagaccctcggccccagaccttcccaaaggaggctcagggattaggtatctggctgttggtgacacaggtggtctatgaaccagttctgagaaactgtcccgcgtggacagggggtagatcccatcagttctcaaaggaggccaggatgtctcgcctcctgaactccacaggctggtagaagcggggcttgagggacagcaggttgggagcttgaggactaagtgggccagtcctgtcctaccacagtggggggaacagtccacagaaaacttgctcatgaccacactgggagccgactgttcttcccatcccaagtctctgacactgggggctttgggtgaaaccttaaggagatggtcagatgggtggtccagggtatacttttaacaactgagaagccattttttctgccccctgggcacatgtgcccagctctgcaaagacagtggccaagttgaagacaagtcttccatgtggggtggagatgggaggggtgggtgccaggctgcagcctgtgtcctcctgataggcccagccccctcggtggcctccgtgttcctgggggaaggaaggaaggagctggaggatacagtggtgcctatctcgggagcccagggaggcagggacacaggagtggcaggcttggggcgcccgcgtggaacagtgccaggtctacgtttacccactaccagatagactttttcatttcaagcataacttgagtctgcactggggagacactcgtggtgggggtggctgtgatgagggcacttgcgagtcccgacaacagacactggctcctgcacccacatcaccaccatgtcccaggggcagcctgg

SEQ ID NO: 11644 - DNA, 1085 bp, Homo sapiens
agagttcatgccctgccttccagagcaaggctgactccttccaaaccactgccttccaggacacagggacaactctcgcgtggggcgagtctcatgccagctcctccctggcatcaggctgactagctgccactggcctgttcatcactttttttttgttttatttatttttttgagacagagtctcagtctgtccccaggctggagtgcagtggtgcgatctcagctcactgcaagctccacctcctgggctcaagtgattctcttgcctcagcctcctgagtagctgggattacaggcacacgccaccacacctggctaatttttatatttttggttagtagaggtggggtttcaccatgttgtccaggctggtcttgaactcctgacctcaagtgatccacctgcctcggcttcccaaagtgctggggttacagtcatgagccaccacgcctggcctctgtttatcactttaaatcctaaagcactgggtgactaggaggacaaagcccttggccatcctctcgtgcacaagattgtagttcttggtcataatcctgcctggaaggtctttgatttctgacagcctgaggcagaaagaaaatcccagcctaaaccaagatgttacagtcttcttttttctctgcctcctctggaattaggaatgaccctcaaggttccctgaacatatttggctacccctaagattagagaaaaagttagtaccatcctgacactcctcctcaatctcccccacttccattccttatgctgcagttctagagcagtttggctctgagcttcccagcagccagagtgagaagggaaaatagccctgttccattgcatgttttcccccagtggtctgacatctctgtctctccttagctgtcagatgccctgaagcgcctcaaggatggaggcctgtctgcaggctgtggctccggctcctcctctgtcacccccaatagcggtgggacacccttctcccaggacacagcttattccagctgccgcctggacacacccaactcctatggacagggcaccccgctcacaccgcgcctgggcacccctttctcaca

SEQ ID NO: 11645 - DNA, 1043 bp, Homo sapiens
cacctcaccctcgtcctcggcctccgacaaggaggaggaacaggagagcaccgaggaggaagaggaggcggaggaggaggaggaggaggaagtccccaggagccagctctcctcctcctcaacctcatccacatcagataaggtgcctagcaggccaggaagcctcagggggccgggccaggcgacgagggccagacccttcggctcacctgtccccactcttccttctcccccaggatgacgacgatgacgacagtgatgaccgggacgagtctgagaacgatgacgaggacacagccctgtcagaggcgagtgagaaggacgaaggggactcggatgaaggtgagcagggaggccgtggctgcctggccctcccggagtccctctttccccggggcagagcctgagcaattgtcagaaatacttctgagccaaaatgttgtgcttttgagacgttaccttgttaaaacacacacacagggtggcgtacggttccatcttcagggagtgccgtgaacataatggcatgtccatagaaatagaaagcaggtctgtggtccttagggctggggagcccggtgttcaggggggcttgctcagcctacatggcttccttttcaactgataaaaatacttagggaccagatcgaggtggtggttgtgcaacattacaaatgtactaaatgctgctggaattatcactttgtaacgagcagttggccggacgcagtggcttacacctgtaatcccagcactttgagaggcctaggcgagtggatcacctgaggttaggagttcgagaccagcctggccaacatggtgaaaccccgtctctactaaaaatgcaaaaaatagccaggcgtggtggtgggcacctgtaatcccagctacttgggaggctgaggcaggagaattgcttgaatccaggaggcagaggttgcagtgagctgagatcatgccactgcactccagcctgggtgacagagtgacactccacctcaaaaaaaataataaataaaattttttttacaaagtgagcagtt

SEQ ID NO: 11646 - DNA, 1042 bp, Homo sapiens
ccttgaggggtttagctggagaaggacaggtcccgtgctcagactcagggctgtgagcctgccaggtatggagcacaaaataaggcactgagagacgtttggattgaatagtaaatgtctcgtgttcgctcacctctctgcagaacatgacctggaagtggagccggagccccctatgatgctccccttgccgctgcaaccaccattgccgcccccacgaccaccccggccacccagcccaccgccggagcctgagaccacagatgcctcacacccatctgtccctccggagccccttgccgaggaccaccccccgcatactccaggcctctgtggcagcctggccaagtcgcagagcacagagacggtgccagccacaccaggcggggagcccccgctatcagggggcagcagtggcctgtccctgagctctccgcaagtgcccggcagccccttctcctacccagccccgtcccctagcttgagcagtgggggcctccctcggacacctggccgggacttcagcttcacacccaccttctccgagcccagcgggcccttgctcctgcccgtctgcccactccccactggccgacgcgatgaacgctccgggcccctggcctccccggtgctcctggagacgggcctgcccctccctctgccccttcccctgcccttgcccttggcattgcccgccgtcttgcgggcccaggctcgtgcgcccaccccgctgccacccctgctgcccgcccccctggcctcttgccctcccccaatgaagaggaagccgggccggccccggcgatccccaccatctatgctctccttggatgggcccttggtccgaccaccagcaggggccgcccttggaagggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaag

SEQ ID NO: 11647 - DNA, 1033 bp, Homo sapiens
gtgggaccgccgaggacacggccagctccgctgagccccgcacaccgtccactgcagggcatgagcatcccagcacagccccacgcctccacccgggcaggctcggagcggcgttcggagcagcgccgcctgctgtcctccttcactggcagctgtgacagtgacctgctcaagttcaaccagctcaaggtgaggccgggcttcacccagatcgccggggtggcggcaggacctgagaccggggctcacctctccccctcttccctcccacagttccggaagaaaaagctcaagttctgcaagagccacattcacgactggggcttgttcgccatggagcccatcgcggctgacgagatggtcatcgagtacgtgggccagaatatccgtcaggtaggcaccgcccggcaggatgggcaccggggtgggcatggggccggcccagccagactgacccccttttgtggccaggtgatcgcagacatgcgggagaagcgttatgaggacgagggcatcgggagcagctacatgttccgggtggaccatgacaccatcatcgacgccaccaagtgcggcaacttcgcgcgcttcatcaaccacagctgcaacgtgagtgcccagcggggggtggcccctgcccctgctcctgcccctggccctgcttctgtgccaggagggcctggaagccccggcacgggaatcagctcggcctccttcccaagctcaggttggccaagggttatagggagaggaggacatgtgaggtcttttaccaggagctctactcctctgagcctcagtttctcatctgtcaaatgggcatagtgagacttctgtggcatttagaggactcaaagaagtggttggttcagttcattggtaatttcggagttatttctctgcgttagccttttctccgtgccttcattggtcaggctcagtcctgctcgggccgagctgtccactagaactttctgcaagggggaggtgcactgcgtgcatctgtgctgtgggttagccacatgtgtggtgg

SEQ ID NO: 11648 - DNA, 1046 bp, Homo sapiens
ttttttttttttaggacagggtctctcgctctgctgcccaggctggagtgcagtggtgcaatcatagctcactgcagcctcaaactccagggcttgagcagtcctcctgccttggcctcccaggtagctgggactacaggtgtgcaccaccacacctggctaatttttttttttttcattttttgtagagacagggtcttgctatgttgcctaggccggtctagaactcctgggctcaagtgagcctccagcctcagcccctcaaaacattcagattattaagcatgagccaccacgcctggctgtgattgctttttgacaaagatgacacagaaaaggcctaatgtacatgttactctgcatttccgcccacttcgaagggaattccttgtcggcacatttgtatcttcattcctttgaatgatcccaccatgttccattggtcggttcaccatcttttacttagccagcctcccatgttcgacatttaggttgtttccagtgtttggccgtaacaaacagtggtgtagcgagtgtccttgcctgtgggagaatttctgccatgttgctagatgtgtcattactgagttaaaggcagtgcacatttacccttcatagatcttgtcaaggtgtcctccaagaagcttgtgccagtgcaccttctctcaagtagcacctgtgagtgcgtctgtttctagctttcccaactatgttacagtctttggcaataacatagatattctttgacaatctggtaggaaatgactttttttttttttttttttttgagatggagtctcgctctatagccaggctggagtgcagcggcatgatctcagctcactgcagcctccgcctcccaggttcaagcgattctcctgcctcagcctcccaagtagctgggactacaggtgcctgccaccatgcccagctaatgtttgtatttttagtagagatgggttttcactatgttggccaggatggtctctatctcttgacctcatgatccgcctgccttggcctcccaaggtgctgggattacaggt

SEQ ID NO: 11649 - DNA, 1032 bp, Homo sapiens
gaagtcactttttttttttttttaagagacagggtctctgttgcccagtctggagtgcaatggcaggatcatagctcactgcagcctcgacctcctgggctcaagcaatccttctatctctgcctcctgagtagctgagactgcaggcatgcatacctggctaatttatttattatttttatttattcatttatttttttgagacagagtctcactctgttgccagactggagtgcagtggtgcaatcttggctcactgcaacctccacctcccgggttcaagcaattcttctgcctcagcctcccaagtagataggactacaggcgcgcgccaccacgtccagctaatttttgtatttttaatagagacggggtttcaccatgttagccaggatggtcttgagttcttgacatcatgatccgcccgcctcggcctcccaaagtgctgggattaccggcgtgagccaccacgcccagccacacacctggcttatttatttatttaatagagacagggtctggctgtgttgctcaggctggtctcaaactcctggccccaagccatcctcctgcctgagcctcccaaagtgctgggattacaggcgtgagccaccatgcctggccagaagtcactgttttattcagttcagttagtgtattcacaaagttgtgcacctgtcaccactgtaattccagaacattttcatcaccctaaaaaaggaactcatacccattagcagtcacttcccattcccctcgcctgccccggtaaccaccagtccactttttgtctgtttggatttgtgtatcttccgatgttactcttttactgcatatcttttataaatctgcctctcatccctgcatgcaccccccatccccaccccagttctcgcccctggaggcaaccagtgttgccaggttttgtttatccttctaaagggagacttcgctcgcaaacatgcatgtaaatacacgcatgcacatacagagcatgcacacacacacacatcctttgcttaccactggtgg

SEQ ID NO: 11650 - DNA, 1064 bp, Homo sapiens
ctccacctcccgcgttcaagcgattctcctgcctcagcctccagagtagctgggattacaggcatgcacccccacacccggctaactttttatttttagtagcgacagggtttctccatgttggtcaggctggtcttgaactcccaacctcaggtgatccgcccgcctcggcctcccaaagtgctgggattataggcgtgagccactgcgcctaggctgagaaagctattttttttttttaagaaaactgggaaagtacatatttgaagagagtatttcttaacattttatttgtgaagcttatctatgtctgaatccaacagcccacttgactcatttgtggtattgcctggcccctcatggggcttttgagttcatagtcaccgctgtgatggacacagttaaaaagggattggaggggcctccaggaatgcttcttggaggagttgctgtcttgacctggtattagaaaggaggcaggctggccgggtgcagtggctcatggctgtaatcctagcactttgggaggtcgaggtgggtgaatcgcttgagctcaggagctcgagaccagcctgagcaacgtggtgaaaccctgtctttacaaaaaattttaaaattagctggatgtggtagtacatgcctgtggtcccagctacttgggaggctgaggcgaagatcacttgagcccaggagtttgagaccagcctgggcaacatggtgaaatcccatctctacaaaaaatacaaaaattaggccgggcacagtgggtcacacctgtaatcccagcactttgggaggctgaggtgggcagatcacctgaggtcaggagttcgagaccagcctgcccagcatggcaaaacactgtttctactaaaaatacaaaaaattagctgggtgtggtggcgagcacctgtaatcccagctactcgggaagctgaggcaggagaattgcttgaacccaggaggcggaggttttagtgagccgagatcatgccactgcactccagcctgggcaatgagagtgaaacgtgtaaaaaaaaaaaaaaaaaaatatatatatatat

SEQ ID NO: 11651 - DNA, 1047 bp, Homo sapiens
ggaggcctcacaatcatggtggaaggtgaaagacacatctcacatggccgcagacaagagaagagagcttgtgcagggaaactcccctttttaaaaatcatcagatctcatgagacttattcactatcactagaacagcacaggaaaggcctgccccccatgattcaattacctccaccgggtccctcccacaacacatgggaattcaagatgagatttgggtggggacacccaaatcatatcatcatctcaccccagttaaaccatatcatcatctcactccagttaatgcagctcttggctgggcacagtggcttgtgtctgtaatcccggcactttgggaggccaaggtaagcagacaatttaagttcaggagttccagagcagcctggtgaacatagtgaaaccctgtctttactaaaaatacaaaatttagctgggcatggtggcgggcccctgtaatcccagctactctggaggatgaggcaggagaattgcttgaactgagaggaggttcataaaataaaaataaaggctgtgtttgtatcgctgggaaattttcttttattgctgctttggttatttcctctcttgtttacttctttctttctgtaactatctagatggatcctccatgtcacaacttctcttttccttttggcagttttctgggagaaaccctcagtttgtttatttattttgagatggagttcgctcttgttgcccaggctggagtgcaatggcgtgatctcggctcaccaaaacctctgcctcttgggttcaagtgattctcctgcctcagcttcctgagtagctgggattacaggcatgcgccaccatgcctggctaattttgcatttttagtagagacggggtttcaccatgttggccaggctggtctgaaactcccgacctcaggtgatctgcccacctcagcctcccaaagtgctgggattacaggcatgagctaccgtgcctggcctgtgtatttttggagacagagtcttgctctgttgcccaggctggagggcagtggtgcaaactctg

SEQ ID NO: 11652 - DNA, 1027 bp, Homo sapiens
gtgtctgcctccaaggggctgttgtggggatggagtgagataggtaaattgcttattccagtgcttggccagagttaggtgtccctgcacctggaggctggcccccttacaacctcatcgggaggcccgcccccatctcgggagggctttgggtgcctcctaagaagacttttggtgccacagctgttggaggtgcagtctgtccttctggcaagttggagggttttctggccggtcctgaaacattatatgagggagatgtcattgttgagggcagacatcccagacaccgttctgacatgtggattcggctctgggcagagattcctcttttccaagtcacagaaaatgcctggccctcaaagattaaagcgctttttcactctctctccctttcccactatgaatattaggtatttgctgcaggtaacttttttgtctgcgcaacagaacttctttggactggcagcagcggccttgagcagcttggccctgcagaaagctcatgatgggatctctgctgagttaagcttattgcattaggaactggactagcgggggctgtcttaggtctgctctggaggcatcgcgggagaagtttcctaggagactccataaacagcgtaataaaagagcaggaatatcttgccccctctcacctcacctttttaagagagctgtgagccccaagcatatccaggtttaaatgttatgcttttacctgaagttaaaatattagatacttagccctggatggcacccccctcaccgccgcggtccctggaataaacgattagtcaacttgttctttgttatgttcctgaaacacccctatttcctctcttgaaggtttccctgatgatctgttcccgtagctcctcctcccatcccccttacccggcacattggtcagtctctgctgattctctggtcttgccagtttgagctggcactgagcctgtaaagatgttctgctttttaaaaaacaaatggtgttgaggctgcagccctgtgcgccctccagtct

SEQ ID NO: 11653 - DNA, 1033 bp, Homo sapiens
ttttaatataaacttctacatatacagggagagaatggatgagtcacggggggcatggactggaaaggtctcacctaagtaagctctgctaaatgaaaactaaatcagtctcccctttgcactcttgtttggataacctaaaggcttattaaacaacaccaaataattttagtaatggcattttttttttcatttctctcaaaaatattttggcagctggccgttgctcagttaactttcttgattgcaaaatgcaccatcagtttggtgcaagaagcttatcttgctctcttggctctctcactttcgctgcttttccctgtgcctaaggtctcctgctgcctaaggtcggccacctaaggtctaccaccacaggccctcggatgggatctgtccagtcatttctcatgaagatgccctttgtctgtctgtgtgaggctggtttgtccagtgctgagtttagttggcagtgtagaactttggtatggatgacagacaaatgactcaaaaccagttgtctgggctgtagtctgtggcacagaaagaaactagaggaaggtgagtttctgaccccagctctcctagtgagaactgctacctggctttcagggaaggaaggttgagatcggaggcaacgcggggcgtggtggctcatgcctgtagtcccagcactttgggaggccgaggtgggggattgcttgagcccaggagttcaagatcagcctgggcaatgtagcaagatccccatctctaaaaaagaaaaagaaagaaagaaaaaaagggattgggggcagggcagaaagaagacttaacctcagagcctgtctggcttccatcctggtggggttcatgccttccctgccggctgtctgggtcctcccctcctgcccgagctgagaaaggccagctgggtctcctcttctgtgtgactgtttctggcctaggttctttctaacttcaacttcctgtctgtcctctggcctcttcgttctagctgtctaactctccgtggtacactctgctttttgttgtt

SEQ ID NO: 11654 - DNA, 1048 bp, Homo sapiens
gaacggtgatcccagttgggagttctggtctctgtgttgctgctgaagtctgactgtgtttgacgtaaacacccaaagaaaagggaaacatttcagctcacggagaggaagaagaggggaccctcaaactaaactttgaggtttctagcctgtaaggctaaatttccctgcgtcttgccgctcccctcattgtgtgtgattaaagctgttggtatgacaccctctgccctccagctttgtctgctgtaccccctgccttcagactcccttttttggttggttatttttgtttgtttgttttctgagacggtcttgctctttcacttaggctggagtgcattggtgccatcatggctcactgcaacctcaaacacctgggctcaagcgaccttcctgcctcagtctccccagtagctaggactacagacgcatgccaccatgccctgttcacacattgagggcttttcactgcctcgatcaggctgagttctgctcactggggccaccacaggccaggcagaaggaactgtgtgggctttgtcgagctggctttccctatccactaggcctttgcttaaacgccacttcctccagaaagcctcccctcactgctctggtcaggttggctatccaccttgtgcccacagccatctgcccttcaggacgctgagcacagaggcatgacgtgtgctcccacccaaggcgtgctgcatgaggggaacctccccgcctcagctgtcccccaccctcagccgtcccccgccccagccgtcccccgccctcagctgtccccctcctcagccgtccccccaccctcagccgtcccccacctcagccgcccccccgccctcagccgtcccccacctcagccgtccccctgccctcagccgtccccctcctcagccgtccccccaccctcagccgtccccctcctcagccgtcccccgtcctcagccgtcccccacctcagccgcccccccgccctcagccgtcccccacctcagccgtccccctcctcagccgtcccccgccctcagtcctcggctct

SEQ ID NO: 11655 - DNA, 1030 bp, Homo sapiens
gtctgctcctgggacctggtgtttctaacagaagttcagtctgtgcagacaggaaacccaagccatcaggcccagcagaggggtggcatctgaagagtcagggagcaggtctaggaagactcaggcatgggccttctctctccagcccgagtgtcatggatccggtagcttctccgggagatgagtgtgctagggcaggcttgtgttgggctggtctttctctgagaagccacactgcctctctgactgaggcgttcgttattgacagattcctctcctttcacctggactcctttatttccctgaaatctccttttcctagggaaggagaaggaaagggtacctgggaatgtggtctgccctaggggaggggtgcagcagacaggctggggctccctcaggggtctggatcatggtgctgactctcaccctctctctgctcagatctggagaagcgcaagaatcctgtgtgccactttgtgacacccctggacggctctgtggacgtagacgagcaccgccggccggaggtacttggcagtgaccaagggtggctgagagtggaaacataccagcacctcaccgggagtggctcaccgcgggctggtcctgtaggagaggctgccgagggtagtgcagcgcctgccctgcgccatccatgccctgggggccaggcctgggagctggtggcctctggcaaccccaggctgcagagcctcccccttctcagagggactggcccagggactgagggggttaatatctttctgttaatttttaaagtgtgtgtctatgtgtgattatacatgcacaggaagtgtctagaggaatatatagaagtgtctttattaagagacttcaggaacctctggggagtaggattagggctgccagatgagggggagatgctttcttcactgcatactcttctgtgtggctttaattttgtctaggcatgtctcactgttaacgataaagggggaatttagaaggtaagctaatgaaagacagttttgagacaggtataatc

SEQ ID NO: 11656 - DNA, 1938 bp, Homo sapiens
ctccttatctctggagctcgaaggctgtcatgcaaggcatccacactggcatcacgcgaaggttggatgagaggcccctggagggcacattccacctgaaacttcctggaattggctgttcatttttgccctttgaatgtggcagaggctgtggggaaggggcatttatgggggggcttgggaattgctgcagcgttcccctgcttcttcctctgtggagcattctgctctcaccctgtcctcctggacagagcctcaggaccgtgcccccaaggcctttggctaccttaggtcttgaaatgacagcgcattgttagctagagggtctgctatagcatggaagaagtgggacgtactttctgagtgatgtggtagccactgtggggtttcccgctggattgcctaaggcctgattatagtgccggatactcagtacaccagttgagctttgctaatcaagcagagccccctcttcactctgctctctgtccctgtcctaggccatcaccacggaagggaagtactggaagagccgcatcgagattgtgatccgggagtatcacaagtggagaacctacttcaagaaaagggtatctggctggagtgttcaggcagcccgcctagggagggagtgggcagagtccctggttcagggccctggccgaggcggtaggctccacagccgccccacctgaacgtggagcgtcaagcagtaaatctggggcccagcgtgccagactagcctgggcaatggcctgcctcggtcaggttgtctttgctctcagtttccccatctgtgcactgggtggaagtctcctttgtgcaggcatcggcctggggatggtgtgagcaggacccctacctgcctccctgagagttctgtatattctagagcccttgggccctcctagggccattggtgaccgccgtgtcctgtccctttgcccacagctacagcagcacaaggatgaggacctctccagcctggtccaggtgggtgagcctgggagctctgaggacccccactttgacatgagacagcagggacttcggtggcccaccagggagccctgcaaaaggcggcaggccatgggccctccctggagtctcaggaatggctcaagaagcagtccagctctctctcctgggtgggctggagggagccgctctccaaatgcctccaccctgctgcctcacttccactgagcacccctttgacgaatttccccaggtgacaggcgtgggaattcttcgtcccactgttactctttgatgcttcctcccctgtgttggtgttgtgttaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaataggtaacccaaaccagggccttgggctttgaacagccagccgcttccttctctgccaggccccctctgggccagggttccttcagggccatctctgagctgctgcacgtcacggttgggggcaggcagtaaggaagggaaggatggctggcctcatttgacatccaggccgcacgtaccgagtgggtggggtctgcagagtgggcccactgggcagctgccattcccgtagtgccatggtgggaggacagcagcagggtctagtctgagtcattggcacatttcagataccgttctcttcacggggtacgtgtgccgtgcctaagccgaggcggccgggccgtgactcatgctaaagaaaatcagaagcactcccgggtgtgaccgctcaccttggtggcattcagtcttccagttaacctctcagggaagagcccaaagattgaaaattagaacagtgttcgg

SEQ ID NO: 11657 - DNA, 1100 bp, Homo sapiens
acctgcacaggtagaggaagctgggggatgggtgggggaaggggctggcaggcacagggctgctcatcaaaggtttgctgccagagcaaggctaatggcatagccacacagtcaccagcaaagcgccaagcagtgctagaccagcactaatgtgcagaggcacgattccatccctcttttacagcatccttcagcacccatggggtgggagactcttggtccaggtgtgcttctgcctgagtgccaggtaacctatgtgcagctagctctgctccgactaattaacacagaattagctagacagagaagaaaaacatggattactaataaaaataacttctgtatatttctttcacgttttactaagcaatccaaaaagttgcttacaggtgcttggggctacagagctgagtgaggtaccattctttgtccttacggagccctcatgcttatgcccatgaccagttagacactggtaacctggcaccatcttcaaacgggctccgggaagaattgctactgcagagactgggatctgaaccattgattcctcgtagcttttcttatttaggaagaggtggcctgatgaccagttgacacgtgaaattgtcctcggggattcccgagcagctgcaatccaggctgcctctgctcagtaatagaagatggcagagactttggggagactctgctggactccagaaacaagatattcccaggctgctagccagctgtgtgagggccgttgccttatctgagctctgagttatttagtttttaatggaaacaagacccccgcagacacgcagggaaacacaaatccctatcagatcagcagccatggacgtggagacgtggcctttgtccctctgtcccagcgcccggcctgtgtagttggacttggcagtgtgcagcgctagaaaggaattgtctgaccccagcattgcttcctggctcctttcttcctttttcaggagagcatcctgccgaccacagccctccccactgtgagccttcctgacagcctcatcgcgccccctaccgccccatccctggctcacatggatgagcagggctgtgaacacacctcccggactgag

SEQ ID NO: 11658 - DNA, 1066 bp, Homo sapiens
ccaactctgccggcccaccgtggcatcgggaggccatgctcaggtctgaagcaggtttggggcctgctgacagcaatagcccgcctttgggaaccccttgctgtgaactctctcactcagtgacctcagtcaccaacctcctctgccctcggggcagcccacacaaaagggaagtgctggccgtgctggtcctgccctgctggtggcctgccgggcctggcgccggtgagcggaatcgatgggatgagggtgacagggcctgctcctgtcctgaggcccagccttgtccctcctgccacgtcctgtccacatgcatgcctctgcctgatgccctgctccactctctggtctgcccgtggggcagttggaaggcgtctttctttctcccctcaactctgacagcacccagcccttgtggatggacttgggcttctattcaggcttatgcatggcaggctgccagggggaagtgccttcttcagaggtcctccaggacacatgtgtgcagaaacggtggatgtggaacacacaggaccagaatggaagcgtgtgatgcacggtggctgctctggctgagaggccctgctgggcatgtttcatctgtccccttttagctccacctgacattgcaggatccatggggactcagcccagggccttctcggatgtcacctcaccgctgtggcccttctgccgttcttctccacttggctccagctgcagctgttgacagatcaagcatgtcctgtgggagcttagaaccctgaagttctagtgtctgaaagatcagactccacgtcctgctgtcagccttgtcatcttgtctgatgtctttcagctgggagccccaaaccaggacagttctcggaccaaagatgcccccacactcaaaagtctgtcccgtcttgtgtttggagaaggaaacaatgttggcaggcagcactctgtggtggtcagccctcagagctgtttctaggcatctctcagatcagacagcaaagaatctacccagatctgggctgggtggaggtgtggctgggctgggggccattctgagcctgcagtg

SEQ ID NO: 11659 - DNA, 1191 bp, Homo sapiens
acgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaaaaaaaaaaaa

SEQ ID NO: 11660 - DNA, 1021 bp, Homo sapiens
gctgtacagagtggggtgaaatgttaaacagggtgcagtgcccaagggctaagaaccaggtccagcgcaagcctgagaccacaggaggcactcacagctcacaaaggcgtctcgcctgattggccagggcaggatctgccgcctcttctcggtgcacagacagtcatgccaaccctgggcagggtggcatctgcccctgctttccccactgagtggggagacagggcagtgtgctcaggccctcaatcctcacgcaggtaggcctcctgctccgactcagcccgctcctccccttcctcctgtgttttctgacggagctcttctatctgtgcttctgccagcttggtttctgctttccgggagagctggtgcacctcttccacctgcagtttcaccagctgaatgtgattcctggcggttatagaggcctgatctgcgcctgccaaaagatgggacaatcgggttgagcagccgtgcagggcgcggaaggctcatgtggacgttggcctgggggtgctgtggctgtcatctgaacccctcttggggtcactttccttgacctccctgtcttctctctctgcaaagaaacttccacctctatgttcaggtctggatttaactgacactctgtcaaaaacagcatttttcttcagctgtcagcggccaacatcacaattattaaatgcaactctcacaatcatctttatagctacagagcttttagtacagacctttgattaatttttttaactacacatcttccatttctttttgacaaagagatcatgaataaaattgtcaaagatccctttcatcaccttgactaatctttaaaggtaaaggaatgcatagaaaaatatttttttactataaatttatgtaacagcataaaaggtattaaatatgttttataattttttcacttaaacatgttttgaaggccgggcgcagtggctcacgcctctaatctcagaactttgggaagccaaggcaggcagatcacctgagggtcagaagttcg

SEQ ID NO: 11661 - DNA, 1085 bp, Homo sapiens
gtttctctatttcacagatgtgggaaattgagacccataaaggtattcattccaacctgtccctccttcttcatctcctcactcccacccaaacaccagccactgaaacttctctattctccaaacatgttttgtttctgttcccttgcttatgctcttaggaagaactctttaaacatttataaaactatgatcttcaattctcagcccaataacaaattagctaacacctaaaattgaatgtttgccatcaaccaagcattgttctgtgaacatttaaaactcaaaacatttggaggctgaagcagaaggattgcttgagcccaggagatcaaggccagccagggcaaaatagtgagaccctcgtctctcaaaaaaccagaagtgaaaaatagaaaactccttcaggtgggtacaactaaattagtcccttggtattggtatccatgggagattggttccaggacctcccacagataccaaaaccctaggatgcttaagtccctgtcattaaatggcatagtatttgcatgtagcctaggaacatctgcctgtatactttaaatcatctcttgatttcttatcttgcgtaacagtgtaaatgtgctatgcctgtaggtgcaatctagggatgtggaacacatggatattgacggcaaactgtatatatatattttttttccaagacggagtttcactcttgttgcccaagctggagtgcaagtggcacgatctcgacttactgcaacctccgcctcccgggttcaagcaattctacagcctcagcctcctgagtagctgggattacaggcgcacaccaccacgcccggctaattttttgtgtttttagtagagagggggtttcgtcatgttggccaggctggtctcaaactcctgacctcagataatccacctgcctaagcctcccaaagttctgggattacaggtgtgagccaccgcgccggcctggtctgtatattcctattttataaattagagaattgaggaacagaaagattaagtgatcacccaaggacagctgcctagtcattgtgaaagagcaccaagtcagaaattgtttctac

SEQ ID NO: 11662 - DNA, 1083 bp, Homo sapiens
tggtcaggtgcttagcaggactgctagaatcctgatttagtaaccttggaagatggtcaggtttttattaggaatgctagagtcccactttaacaactttgggagaagtaactccaggagacaaatggttaggttcttgtatggttgggaattcagcttggtcagctaactcaggagcaggcagctttctgctgtttgattccagtcagcttgttaagggaggcaggaaggtagaggagggaatgcccagacatatgaagcctttggggtcttggttaccatgtctcttgcctgccaggattgagtttcttccctatactgaatggtattttaaattaaaaaaatgtttttttgaaaaattaagctttgaaggtgttaccacagcttggatcccgaattcttggctctcacataaatagaaattagcaccaggtcaaacaaaaattttcttaggccaggtttagtaggcttgtggctcaaggaatcgcaagggagcagtcttgaaggtatttagtacacttgtccaaaatagttttccattttaaaagtaagatgtttagaatataggcagaattattgctaatgataattgataactctagagtttaaagaataaaatccttgattgtatttttctatgtttaattttattatttgaaattaatttgcatttaggcatttgttcagaaagctaacgatgaaaatcggcggacttaccagaatcttgtcattgagaaggatggttcaaatgaaggtaagttttcctgaatttttttttgaatgacttttttttttttttttaatggagtctccctttgtcgcccaggctggagtgcagtggcgcaatctcaggtcactggaaccaccagctcccaggttcaggcgtctcctgcctcagcctcctgagtagctgggattacaggtgtgtgccaccacgcccggctaatttttgtatttttaatagagatggagtttcaccatgttggccaggctggtctcaagctcctgacctcaagtgagtgatccacctgcctcggcctcccaaagtgctgggattacaggcgtgagccactgcgcccagcc

SEQ ID NO: 11663 - DNA, 1056 bp, Homo sapiens
attttttccttaacagctttatagctcctgagttaggtgattgaatcaatgttggagactaacaaggtgcaagtctgactgggtgatgggatgttttttgattggttcttaaaatatgacttgcttttgtttgtaaagggcaaggggataaaaaagactttccccatgggctgggcgcgatggctcacgcctataatcccagcactttgggaggccgaggcgggctgatcactggaggttgggagttcgagaccagcctggtcaacatggtgaatccgtgtctctaccaaaaataaaaaagtagccgggcatggtggcacgttcctgtagacccagctactcaggaggctgaggcaggggaatttctttaacccagaaggtggaggttgcagtgagccgagatcacgccactgcactccagcctgggtgacagagtgagactccgtcccaaaaaaaagaaaaaaaaaaattacttttcccggagaaaattgtcttctgataatattaaatcagaagaagtacagtgaatgtacagtagaaccttattttatccaatcattaagaatctagcttcttgggagctaaatgatgagaacacgtggatgcatggagggaaacacacaccggggcctttcagaaggtggagggtgaaagtatcaggaaaaataactaatgattaataggcttaatagctgggtgatgaaataatctgtacaacaaacccccttgacaaaagtttacctacacttataccactgaacttaaaagttaaccaaaaaaagagtctaactcctaatcttagctctaaaggcaacatgttatctggtttattagtgggctttgtaatgtagcattggtgaagaagatgttgctactgcagctcaaattgtggtaaaagattgccccttaaaattgcttgtctcgatccctttaaggttggccaaagttggtatagaacattagatccataaagtcataacttgccgtgatgcccttaatggctgcattgcttgtttgaattcctagtatcacccccagttaagttttccttagaat

SEQ ID NO: 11664 - DNA, 1019 bp, Homo sapiens
gttaattcttattttatctgaaataattctgattctatttttctctcatacttttattttatatcgttaacaactttaacacttttgttttagaaagattatcagaacacagaggaagtatgtcagctaaggactttggtaaataacttgcgagagttgatcacgttgcataggaagtacaactgcaaattagccctctctgattttgagaaggtaaagtccagggtcataagaattattttgtatatcaagttatgggtagagtctgtatttattccatctttcttttggcatccaggaaaatacaaccaccatagtgttccgaatgtttgataaagtgctggccccagagcttattccctccatcttagagaagtttataagagtttacatgagagaacatgacttgcaagaggaggaacttctcttgctgtacatagaggtaacttttcctttacatctagtcttatttcttggatctatgcagtgtagcactgtagtaaatatttaactctttaaggaatgtcatatgctttctcagtaggactcatgcagcatattgaattggttaaaaatgtgggttaattctgctactaaccatcttgagcaaaggggggatacatgaggactgtgaacccggaaaatctgagacagttctcagttaatttagggagtttattttgccaaagttgaggatacacccatgacacagcctcaggaagtcctgacgacatgtacccaaggtggtccgggcacagcttggttttatatattttagggagagacacgaggcatcagtcagcatatgtaagaagtacattggttcgatctggaaaggtgggacaacttgaagcaaaggcaggaagactccaagcgagagggagcttccaggtcacagataggtgatacaaaacattaaaattcttttgagtttctgattagcctttccaaaggaggcaatcagataatgcagctgtctcagtgagcagaggggtaactttgatagaatgggaggcaag

SEQ ID NO: 11665 - DNA, 1956 bp, Homo sapiens
tttctgttcataaaagcgacatatatttgtttttgtttgagatgggtctggctgtgtcgcccaggctggaatgcagtgacatgatcatggttcactgcagcctcaatctccctggctcaagcaatccccacctcagcctcctgagtagttaggaccataggcgtgtgccactacgcccagctaatttttgtattttttgtagagacagggtttcccaggctggtcttgaacacctgggctcaagtgatctgcctgcttcattctcctaaagtgtctgttttctttaattacagaaaataaaaagtgaatgtttactcatttccacccccaggggaacctccatggacagttgtatgcatatctttgcaggcttttctgtggttatgcaaacatggagacttttctttttcagttattcgctgcaatgtgagacatttgttaatatattgtaatatgcctttattttaacttcacactgttattgccactataaaatagaaataaaataatgaaaactgtttttaaaccagagactgaggctggacacagtggctcatgcctgtaatcccagcacttttggaagccaaggcagacagatcacctgagctcaggaatttgagacctgcctgggcaacatggtggaaccgcatctctacagaaaatacaaaaattagccaggtgtggtggtgcttgcctgtagtccaagctacttgggagcctgaggtgggagaatcgcttgaacccaggaggtggaggttgcagtgagctgagatcgcgccactgcactccagcctgggcaatgggaacatgaccctgcctcaaaaaaacaaaaaaaacccagggattgtagagaccgtagaaagcaataacgctgtatgtcttagcttacagcagaaaaaatactcttctgaatttttctgaatagtcaaattgttctctatatgtgaaaactgaagaaataaatggttttccagtgagtggatgaaatattctcaaactaccatgtggttgatgtaagacctgctgattagactgtgctgttcacttgcatgcatcgtaaacctgagggctgttccttgtccatgcgtgcatcttttgtagctcatatttgatgccgtgctcaagatcatgtatgcggcagtggttccttggagtgcagctgtggagcaactggtgaaacagcacctggaaatggaccatcccaagtaagatgactgtctacgaaacaatgttgttatgctctggagaaacattgtgttttgagttgacgttcatttatgtttctatattgtttgctgtgtcccatagtacttcataaaaaagacaatccatgttaatatgggtaaatttgctttcagagtcaagttattacaggaaagttacaaactaatggagatgaaaaaacttttacgaggctatggaataagagaggtaaatctcttaaacaaggaaataatggtaagtacactcttcgaagagtcttttttctctttcatttctggggcaatatggaaagcttaatgaggaatttatattctaggaggctaatagagctaggtttttccactacatttcttttgttagatatgatgttaataaggtgttcagttatttatgagagtatttattctttttgacatggagtttcgctcttgccgcccaggctggagtgcaatggcgcgatctcggctcaccacaacctccgccttctgggttcaagtgattttcctgcctcagcctcctgagtagctgggattacaggcatgcactaccacgcttggctaattttttttttgtatttttagtagagatggggtttctccatgttggtcaggctggttggtcttgagctcccgacctcaggtgatctgcctgcctcggcctcccatagtgttgggattacaggcgtgagctaccgctcctgggctttttatgagagtattaaagacaccaaat

SEQ ID NO: 11666 - DNA, 1049 bp, Homo sapiens
taactaatctgatggggacgtggagaacctttgtatctagctcagggattgtaaacgcaccaatcagcgtcctgtcaaaacaggccactcggctctaccaatcagcaggatgtgggtggggccagataagagaataaaagcaggctgcccgagtcagcactggcaacccgctcgggtccccttccacactgtgctttgttctttagctgtttgcaataatcttgctactgctcactctttgggtccacgctgtttttatgagctgtgagactcacatgaagatctgcagcttctttcctgagtggagaccacgagcccaccgagaggaaggaacaactccagacgctctgccttaagagctgtaacactcactgcgaaggtctgcagcttcactcctgagccagcgagaccacgaacccaccagaaggaagaaactcccaacacatctgaacatcagaaggaacaaactccagacgcgccaccttaagagctgtaacactcacctcgggggtccgcggcttcattcttgaagtcagtgagaccaagaacccaccaattccggacacactagcagaggggacgtaaatggcctttatttttctttctttttttcttttttttttttttttgagacagagtcttgctcttttgccaggctggagtgcagtgggacgatctcggctcactgcaacatccgcctcccaggctcaggcaattcccctgcctcagcctcccaagtagctgggactacaggcatgcaccaccacgcccggctaattttttgtattttagtagagacagggtttcactgtattggccaggatggtctcccatctcttgacctcgtgatccgcccacgtcggcctcccaaagtgctgggattacagacatgagctaccgcgcccagccttgagctttatttttgacattgtaaaagaacagacaagcaggcagggcgcaatcttgtctttgacaggatctcattctgtcacccaggctggagtgcagtggcattatcatggctcactgcagccttgacctctagggcc

SEQ ID NO: 11667 - DNA, 1035 bp, Homo sapiens
tctgttgacattaacaatcaaacttttcagatgaagaggcaatggttaggatgactaagaggagtttcggacccatgtacacctcaaatctcagaatgatggctgggttgggtagtgtgaggttggaggagctatagacaaatgtttctttttgaaaaaggatactaagaaggcaagtcatgatgttgcccttactctgatacatttcagtgtagagggtttttttgctttgtttttttctttttatttctagatttcttttcaaccagttttcaggcaacattttctcaccaagaaagacctcattaaagctcttgtggagaatatagatatggacacaagcctcattttggaatattgcaggtaattctttaaacattaacggtatttttgctgttaacaaactggtaattcttttgcaagaacacagtaataacgatgattattttatgaggtccatagaccactattttcttttgctcattcccaaactgagtaaatatgaaatcagattagagtctcttatgataccaccatttaaattcaccatttagtgtttcccaaacttgtctcctgataagcactgcttagggcacttgatttcaaatgcaggtttctgggcctctctggcagttctgactcagtgggtctggaccaaggcctagaaatcgctggtctctaataggagctcaggtgattcctatgatcagaaaagttggagaatattcttctgagtaataaacttctaaatcaggttaactagggagcaaagtaatcttaaaaattaatgaaaagtatgatttagggagaatttctaatttcctattaaaaatgtttataaaagaatttttatttttatttaacttctttctttatttgagacggagtctccctctgtcacccaggctggagtgcagtggcgtaatctcagctcaccgcagcctccaccttcaagccattctctggcctcaacctcccaagtagctggaattacaggcatgcaccaccacgcctggctaatttttatatttttaa

SEQ ID NO: 11668 - DNA, 1053 bp, Homo sapiens
tttcaggcagaacttgaggtagattctataattcctatatccacctaggcagatattcttgggggaacaaaatctatttgtaaacaaatagtgtaatatgacattagggttttgtttgtttgtttgagatagggtctcattcagccacccaggctagagcagtggcatgatctcagttcactacagcctccgcctccccggctcaagtgattgtcatgcctcagtctccagagtagctgggactgcaggtgtcccagctacttttaaaaaattacctgtgcccggctaatttttttagtatttttactagagatgggttttcgccatgttgcccaggctgatctcgaactcctgagcttaggtgattcacccacctcggcctcccaaagtgctgggattacaggtgtgaaccactgcacctggccaccattaggtttttaattagcaatttttatatcatttggcatttgattcaacaaggatttttaaagtatttaccaagagcatggactgtgcttcagtggaaacaggagttagaaacatcttggccacgtagaatatgtggttgacttttagaaaccagcctttacagatgttttaacttacatgtaagttcaaggtacacactaaaagttccttgaggccagaaactgcatgtatacatagcacctagtacagtactttgtaaatcccaacagatatatactgaattaacaaatggctcatttaaaattcatggagtcttttccttttacaaattatctaatacggggctgggcaaggtagctcatgactgtaatctcagcactttgggaggctgaggtgggaggattgtttgaggcgaggggtttgagaccagcctgagcagcatagtgagacccccatctctacaaaaatttaaaaaattagccaggtgccatggtgtgcacctgtggtcccagctacttaggaggctgaggcaagaggattgcttgagcacaggaggttgaggctgcactgagccgtggttgtgccactgtactccagcctgagtgacagagcaagatcctgtct

SEQ ID NO: 11669 - DNA, 1050 bp, Homo sapiens
tggccaacgtggtgaaaccccgtctctactaaaaatataaaaatgagctgggcatggtggcgcatgcctgtaatcccagctactcaggaagctgaggagggagaatcacttgaacccgggaggtgttggttgcagtgagctaagatcatgccatcgtactccagcctgggtgacagagctagactgtttctcaaaaaaaaaaaaaaaaaaggttttgagtcttctgagaatttagaagcctatctttaggcatctgtaggctttcagacataatcatgatagcaaacagtagtccgtgttcccatgggtaaattcttttattctgtgtagagtgctgtcaaagacttgtgttactcattcctaagcatatgtcatgcaccagcactttagtgtttaaaattattgaaaacttggacaggcagatgactatggaaagctagaaaggccaatataatctagtgaatctgccagattattaactaattaatgttctctctcgaagatgtccagtctcaggtgatcttgacctgatcggagtcgccaggcagtatatccagttagaacttccggcttttgcattagcttgtctgatgctcatgccccactcagagaaaagacaccagcaaattaaggtatcgtgcacatgattcctctgggctgccaaggaaatagaaggtttcatcttgcatgtcccttgcaaaaggtcgcattttcatttcagcaaacctgtaaagcatgaatacatcagatatgtgtgaagcttgtatgggggcttagtgggaggtaagactgaaagatagattaaggtccagctgagggctgtcttacaaggggtttgggccttattgtctatcagtggggaaacaagtgattattttagaacagcaaactgaaatgatgaaggaattattttaaaaggaataacccattaacccatgtaggcttggacagaggagaggacaagaagtgaaacagttgggaagatgttgcatttgagtagaattttatcccacttgatctcttcatagcaaccttgtgcataggcaggga

SEQ ID NO: 11670 - DNA, 1050 bp, Homo sapiens
tcaataaataaacagcataactcaatttgggctagcgacatttcaagtatctaatggccatatgtggctagtggccaccgtattggccagtgcagtagagaccaggatgacccatagttgtacatccactttcccttcttgagcccattgctacccttcctgggtcgttgttaattccagtgttctttaaacacgcagtgcccccaggcaaccacaaatctctaccaatcgattggaattgtgtgtcagaagaaactggcttaccctcctggtgtagacggcttagcaagaagtcagggaagtgcaaaatcagattggactcttggtcgagggattttccctggaggatgtggttggaacactctaaaagggagaagagcaagaaaaggcgcaaagctggaactgtggggcagggtgagaggagggagaaaagcacgttggcaccttgacaccataaacaggtggtatttttaggcagggaaataacagagtgaacttgatgtttttaggaagatgaacttgacagctgcgggtaggatgaattggctagaaggattggaggcactcccagatgaagaactatttaaattgcccaggaaaaattacatgcatttatttctacttttttttggtgcttatcgcccatcattccttctttttgagatttaagtgtaaagggctgttttgagcagctctggatgttggttactcattaatctactcattaatcagcagagatttgtccatgatgctagttgttccatttcctttaggggataataaccttgtgttatgaattgcacctttatcaaattaagagaaaatgagaaagcagctttgtgataacaactttgagaccaactaaaagaaaatagctgactgggcgcagtgcctcacgcctgtaatcccagcactttgggaggccaaggtgggtggatcgctaagtcaggagattgagtccatcctggctaacacggtgaaaccccgtccctacgaaaaaaaaagaaattagccgggtgtggtggcaggcgcctatagtctcagctactc

SEQ ID NO: 11671 - DNA, 1145 bp, Homo sapiens
tagtaaagctttaaccttttatagagaactttgatttagagtaattttttggtcttatatattctttcctaaatttagaccttaaatcatacatgtgcatcttttgcacatggctgtgcagtttggatttttgcatgggacttatgaatagtcagctaataaaataagagtaaccttaatgccaaaatctatacaaatgagcagaggaaagaaagggcagtataaattatgtgtaagactttctaagtccagctctatgagcaagtcatgaaaatgaggcacttatgtgctcaaagcaagaaatagagggagaagaaataaattggtactgtgaagaggtacctaatccttcttaatatctaattttttatgggacatatcgtggttgaatacagatttcctgtggataagaagtcagatgggagtggtttgttttattctttgtattaacaagtatagggggtgatttttaattacgacatattgtttgactgaaaatgttttgttgtgactcagttctttttttttctcctagtactgtgaatatatgcctgatgttgctaaatgtagacaatggttagagaagaattttccaaatgaatttgcaaaacttactgtaggtatgaacattttttttcttgcattaaacttctgtacctgagacaaatgcatgtatggcattattctaaagataggaaagtcctcctttagtaggatattacagaattaacatttatctgttagctgtttaagttctctctgagataggataggtctgaatatcaactttcttacataaaaaagtaaatgggccgggcgcagtggctcacacctataatcctagcagtttgggaggctgaggcaggcggatcacaaggtcaggagatcaagatcatcttggctaacacagtgaaaccccatctctactaaaaatgaaaaaaaaaaaaggcgtggtggcaggcacctgtagtcccagctactcaggagggtgaggcaggagaacggcgtgaacctgggaggcagagcttgccgtgagccgagatcgtgccactgcactccagcctgggtgacagagcaagactccgtctcaaaaaaaaaaagtaagtaaatgattggctgggcgcagtggttcacgcctgtagtcc

SEQ ID NO: 11672 - DNA, 1027 bp, Homo sapiens
cagatgtgagccaccgcacccagcctgagtttctctttctctctttttaactttattttttgaaaaacccggtagactttttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaacccgtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaa

SEQ ID NO: 11673 - DNA, 1105 bp, Homo sapiens
ttccaggtggagcaggtgaagcgggagtcggagttgaaggtatgtcccttgtggcacagggccctgccccggcatccccagcccactgccccagtgacacgctgtcctgtcccagctagaggagaagagcgaccagctggagaagctcaagagggagctggaggccaaggccggagagctggcccgcgcgcaggaggccctgagccacacagagcaggtgcatctggctttgatgactggaggtggggttctggggccagtcctgggtggaagtcaggtcctctttcccgtgaacaggccccacctgggtgccactcggtgatcctgggatgcagccctgacccagacccaggggctacatgggagacaggacctaccgctggtcctcagggagccctgagtctaatggaagtgatcactaacccccagggcccagtttataagcgtgggggcagggtgggtggggcctgggagctctgttcacatgcctggtgtccatgtctgtccacagagcaagtcggagctgagctcacggctggacacgctgagtgcggagaaggatgctctgagtggagctgtgcggcagcgggaggcagacctgctggcggcgcagagcctggtgcgcgagacagaggcggcgctgagccgggagcagcagcgcagctcccaggagcagggcgagttgcagggccggctggcagagagggtatggcctccccagatgcagcagcaccactgagttcactgccgtctggcaaccatcgatctgtctccgtgatctgcctgttctagagatttcatgtaaaggggatcatacacgatgcatccttttgtgtccggcttcttcactcagcatcacgttgtcaagggtcaccacatcatagcctgtgtcattacctcattccttttatggctgagtcgtactctgccgtgtggacagaccacattgtgtttatctgttcatcacttggtggacattgggtttgttgcaactttctggctgttgtaaatagtgctgctgtgggcctttgagcacaagtttctgtgtaaacatctgccatcacttatcttggatagatagctgatgtgtgtggaacacagtaga

SEQ ID NO: 11674 - DNA, 1052 bp, Homo sapiens
tgggccaccatatgtctgcaggtggcagagcactgaagggcccggggccacacacactgtggtgtggttcccactgcctcctggacgttgtcttgccgagccctcctttcctcttcctcctcctcctgggatagctggccaccgacggtggtcccagtgctagtgtctcagtgtcatcctcccccaaccttggccccacccacccgcacagacgcctccgccctggtggcagctctgacccgcttctcccacctggctgcggataccatcatcaatggcggtgccacctcgcacctggctcccaccgaccctgccgaccgtaagtgggtcctgggatggcaggttctgtccacctcactggcttgtctcccctgggggtccttatggagcctgtcggtggggggggctccactcacggtcctttctcaccccaggcctcatagacacctgcagggagtgcggggcccgggctctggagctcatggggcagctgcaggaccagcaggctctgcggcacatgcaggccagcctggtgcggacacccctgcagggcatccttcagctgggccaggtgaggcacagctgagtgtgggtttgggaggcttgggcctgcctctgacctctgcacccacctctgggttggctgaacaggtgtttgtgcgtggagcctgcagcctcaggacacagggtggggaccatgcaccctcctcgatccctgtggtccccaacctctttcccaggctgcccgtgggacggggggggacggaggctacccctgtctgactcccatcctcaccaggaactgaaacccaagagcctagatgtgcggcaggaggagctgggggccgtggtcgacaaggagatggcggccacatccgcagccattgaagatgctgtgcggaggattgaggtgagcacgggatctggggactcccctcattcctgtggagctttgggggccggaggccccaactgggctgggtacaggctgcacccactcctgctctcagcctccagacagaggacagatggcgttttccaggggcctgtga

SEQ ID NO: 11675 - DNA, 1030 bp, Homo sapiens
cggtctgtgcctgccccaggccagagcaggggacgaaggtttacctcttcccctcctggccttccagcctcaccttctccctgcatcacagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccaggtactgtgctgcccagcacctgagagggagaaggtcgcttcccaaggcctggccaccacctccgtcttcccttccagtcctgacggatgagcagaagtcccgaatccaggccatgaagcccatgaccaaggaggagtgggatgcccggcagagcatcatccgcaaggtggtggaccctgagacggggcgcaccaggtggggagctttcggcctgacttacaccacaggatctgggagtgttggctgaagatgtgtgctctcgggaggagtggggccgggcggggttcctggtgcctgaaaaaggccaaatgtgggcaaaaatacggtcacttggagtaagtagttgcaggggctggaagggcctggaggaggctcttgaaagggctgttgttggccgggctgaggctggcaaggcagagcccagctccactgccttcatcagggagagtgggtgaggccccagggtctgtccactcaaggctgcggggtgggagccctgggacccctctgccggctgcttgtggttctgctcctctggcattaggggacctgcctattccttgctgaacggagaccctcccacccccaggcttattaagggagatggcgaggtcctagaggaaatcgtaaccaaagaacgacacagagagatca

SEQ ID NO: 11676 - DNA, 1034 bp, Homo sapiens
gtggaatttgtagattgcttttggcagtatggtcattttcacaatattgattctacccatccatgagcatgggatgtgtttccatttgtttgtgtcatctatgattcctttcagcagttttgtagttttccttgtagaggtctttcgactcctgtgttaggtatattcctaagttttgtttttgttttttgttgttgttgttgttcgtttttgcagctattgtaaagggggttgagttcttgatttgattctccacttggtcgctgttggtgtatagaaaagctactgatttgtgtatgttaatcttgtatccagaaactttgtgaattcttttatcagttctaggagctttctggaggagtccttagggttttcaaggtaaacgatcacatcattagcaaacagtgacagcttgacttcctctttatggatgtggatgccctttatttcgttatcttgtatgattgctctagctaggacttccatactgtgttgaagagaagtggtgagagtaggaattcttgtcttgttccaattctcagggggaacagtttcaacttttccccattgagtattatgttggctgtgggtttgtcatagatttttttttgctggttttgttttgttgtgagacagtctcgctctgtcacccaggctggagtgcagtggggcgatctcagctcactgcaacctccgcctcccaggttcaagcggttctcctgcctcagcctcccgagtagctggattacaggcatgcgccaccacgcccggctaattttgtattttcagtagagacggggtttcaccatggttaggctggtcttgaactcccaatctcaggtgatccacactcctcggcctcccaaagtgctgagccactgcacccagcctcagtttgaagaattttttaatttccatcttgattttgtttttgacccactgctcattcaggagcaggttatttaatttgcatgtatttgcattttttgtttgtggggtttttttggtgttttgtttgttttgaaacggagttt

SEQ ID NO: 11677 - DNA, 1047 bp, Homo sapiens
agtgttaagcatctaaaagtatatttaacattatctgactaatttatctgacaaattttaataaaactatgcttcctgggttcatttttctcatcacagcaaaatcatttaaactacttgttttaaaagtagtgcattaattaatatatgaagaaaactaaccatctatcattgaaatacttaaaatatgactaaataataattatggccaggcatggtggctcacacctgtaatcctagcactttgggaggccaaggcgggcagatcacctgaggtcgggagttcgagaccagtctgaccaacatggagaaatcccgtctctactaaaaatacaaaattagccgggcatggcagcgcatgcctgtaatcccagctacttgggaggctgaggcagggagaattgcctgaacctgggaggtggagcttgcagtgagccgagattacgtcaccgcactccagcatgggcaacagagcaagactccatctcaaaaaaacaaacaagaacaataacaaaataataataattaccactgagggccaggcactttattaactcaattgatctttacaaattgttattctcattttttggaagaggaagcgtgaagtccaaacttgctgtccagactctagcttggctgggtctttgcttgtgccacccaacctcccttacttacccaaagcgaagataatgtttgtcagctcctcccatggcagcttacaaatcacctatgtaattattagttattgattctcactgtctcacttgacccccaaattagtagttacctgtttcttaggctttactgcccttgcaagctattaaattggatatttagatttagatttttttttttttttttttttttgagacagagtctctctctgtcacccaggctggagtacagtggagtgatttcagcccgcttcaccctccctctcctgtgttcaagtgattcttgtgcctcagcttcccaagtagctgggattacaggcacctgtcaccacacccagctaatttttgtatttttagtagagacggggtt

SEQ ID NO: 11678 - DNA, 1222 bp, Homo sapiens
tttgggagacagagtctcactctgtcacccaggatagagtgcagtggcacaatcttggctcactgcaaactccacccccctgggttcaagtgactctcctgcctcagcctcccaagtagctgggattacaggcatgcgcaaccacgccaagctaatttttgtatttttagtagagacggggtttcgccatgttggccaggctggtctcaaactcctgatttcaggtgatttgccctcctctgcctcccaaggtgctgggattacaggtgtgagccactgcgcccagctggtgtatttgttatatacgtataaacttgcggagaaaggactgttttgaaacttacattgaatgatctgtatttacatcttctaggtactggagctgcagaattgagaggaataggtgctagacttgtaatgtgtcccctgcaattgggggctcaaatgcagagaaagctatgaccatgagtggggcgtggggtgtggctcggtatactagaatgtgaaatggataagatgatctatgtgggtgcttcctgctccaaaaccatgattctcatggcagttaagctgcaaaacttctctgccttgcagaaatagaagacgctttcaaatggctcaacctggttatcagagtgtcactttcgaatcctctttcaccctctgggtaatcttttggatattcaactgtagtaggctctgcagagggcataggcagagtacctagcccactggagttagtggttgggctggagaccctgccttgaaggatgctaaagcatgagctgatttgggagggattgtctgagcagtgacctgtcaccacctaatcctactcagtcttatccgttccaatgggagtcgagggaggctaggtgggaggatggctacaaacagccatttgcttatctgtggatgttggaaggtgctctggtggattatggaattcaaggttcttggtttttacccatgaggacactgaggcccagactggggaagtgacttggcgatggtcacaaaacacctctgggcagatgcagggaaataagtccagcccctgactcccaggccatgggccaggctgcaggagctggatgccttgaagtgtcttgtttgcatctatgactttgcacaaatacagtgaatctggctgtgggccctcaagccttaatggccacagagtagtggtgcagggcagtgagctatgctgaaacagccacca

SEQ ID NO: 11679 - DNA, 1038 bp, Homo sapiens
ttcaaggttcatccgcggtgtaataagtatcagtgcttcattccttttttttatttttgagaaggagtctctctctctcacccaggctggagtacaatggtgcaatcttggctcactgcaacctctgcctcccaggttcaagctattctcctgcctcagcctcccaaatagctgggattataggcgcacaccaccacgcctggctaatgtttttatatttttagtagagatggggttttaccatcttggccaggctggtctcgaactcttgacctcaggggagccaccctgcccagcccttcattcctttttatggctggataatactcccttttgtggataggccacattttgtttattcatctgttgatggacatttgggttgtttccactttttggctattacaaataaactgttacgttcctgcatagatttttttggggacatatgtttttaattctctggaatagatgcctaggagtgaaattgctgggtcatatggtaactctgtgtttaactttttgggaaaatgtcaaactgtttctaaagtggctgcaccattttatatctgtgagcagcgtactatttacttaatttttttttctttttttttttttttttgagacagagtctcactctttcgcccaggttggagtgcaatggcatgatcttagctcactgcaacctccgcctcccaggttcaagcagttctcctgcctcagcctcctgagtagctgggattacaagtgtccgccagtacacttggctaatttttgtatttttagtagagatggggtttaccatgttggccaggctggtcttgaactcccgacctcaggtgatccgccagcctcggcttcccaaagtgctgggattacaggcaggagccactgtgtccagcctatttacttagttatttaaaagtaaaacattttttaaaaaggtaagcagttttccaacactgtcactccacaagtgttttaagtgacagatcattgcagtgtgtctcccgatacccaggccagtctgctggggca

SEQ ID NO: 11680 - DNA, 1052 bp, Homo sapiens
gtgcttggcgtgtgcgtatgtgtgtgtcctcagccttgttttcgtcatcttggagcaagtctcttggcccctctggacttggttttctcctggatctatcggggatcctcacaaagcttgtcctgcctttctgctggggtcactgcagggcttggttaagacacttgtgtgaaggaaccttgtgacttgtagcatgtggcagggaaagccaggtgtgactctgaaggtggattttccaggacttgttggcagagccattgggagcctgggactgtgggaaaggctgcctgttctttcagaggcttttcttgtctgttttctggaagtttccatgttgtggcccagggtgttaaacagcagtggcttggggccacttgctggttgcgtagccttgggccagtcacttaccctgtccatgccttggctctccagtctgtaaaatggtacaataatgtagtacctgctagagctgtggtgagcattcaataaatgtggtcatgcaagaggaacccttagaaccatgcttggcactcagtaagtgccagctaactgttactatcgccacctctgcttcctcagtgttgtcactcccgtctgctctttcccacgctgctgccatactaggagcctgcagaccagtgagcagcaccggctggaaggccagctggcctatgcgggcctccgctgccatgtttgcagagggttgagctatgcggcaggcagtcaatatttgctgcagtgaggtgtggttattgcctttctgtgaaggaaacgcagggcatggcaggtccctctgctcttccccctcagggacacctggggctgcccctctgctctccctcacccccacagtgaccaccgggttgggagaggtgctcaggattgcatcctacacagagaggtggggaccccggctttggcagtttcagcatttcagccctcatgcggactccttcagcgttcttgatgttaaatgcgcagatacacagtggtctagtattctttctctttttcttttaattgatgaagcttcatttaaaaaaaatttttaa

SEQ ID NO: 11681 - DNA, 1755 bp, Homo sapiens
gggcacagcctctgatctgctgtacccgattttcttttttctttttaaggtggagtcttgctgtgtcgcccaggctggagtgcagtagcacaatcttggctcactgcaacctccacctcccaggttcaagcgattctcctgcctcagcctcccgagtagctgggactacaggctcctaccacacctggctaatttttgtatctttaatagagacagggttttacctatttgccaggctggtctcgaactcgtgaccttacgatccgcccgcctcggcctcccgaagtgttgcgattacaggcgtgagccaccgcgcctggcccactgtacctgattttctgtgaagtcagaggcctgattttcaggtgtgggcaagttggacattttttaacgtgctgcatgggcaacagaacatatctacgagccccattctgttcttgggtccccactgtttccctcctgatccagttgaaccccaggtgacagatcttccacaacagatgggtgatgagaaaaggagggatacttgggggctttgccatcactggggacccatcatccccagtgatgccaaatgaggccgattgtggcccggtgggcatggcctgggcaatcagggctcaagaccatcaagctacgcacgatgggcctaggagaagatactgatgctgtttttctttctctctgcccagtctgaagaaaggaaaagaatagatgaattgattgaaagtgggaaggaagaaggaatgaaggtaaggggctgctgtgcttgctgcatcatagctaaagctggaagagctcaccttccctggtcccgtggctgagagtggccaccatgtggctttcaccctctaatggccatggtgaccaggcagactctattaggttgtcaaagagccaaataccaaaagttgttaaggaaatgtcttatgaaggaaacataaatgggctttgtatataaatgttatccaggggaagcttttcttagaaattgtggttaaacaattcagtggctttttgtacattcacaatgcaatgcaaccattatccctgtctaatttcagaattttttcatcctcccaaatggaaacccttacccattacttaccactgcccaccatccccacctctcccctgcccagcccctggcagccactcagctgctttctgtctcagtggagttgctcttctgggcacttcatataaatcggattatacaatatgtagctgatgcccagggaaacttttaaaaggagaaactaatacatttttaaactgttttcctagataatgacaatgcccaagaaatgtgcttttctcttactgtatttcaaccacactcagtttgggcgagaggagaagtactctctacagtggggttcagatgggcctagactagggctccgggttcagaaagcttccacttccacccaccacctagggggattccggcttaagtcctgggcccctccagcaaccccattcaactccatgtagaatagagtgaggagacacaggagagaaatcgtggaatgaggtagagacccagaacactgggcctgctgtttgcctaggaaggcatagcgcatagcccctagacagagaaaccaggtgtgtggatttgagctgtgtcactgtctagctgtgtggcctcagacacgtggttgtgcctctttaagcctcagtttcctcatctacaaaatggggcagtctccacctagcagatctctcacgagctctgatgtaactgctttg

SEQ ID NO: 11682 - DNA, 1035 bp, Homo sapiens
tggttactggatcctacactcactttctaccaggaataaactgatctttcattgcaaagccacggcaagccaagtttatctgatgaaactctccctagcgactaagatgccttttctctgtgacaggtaagtgtgctggtgaatgaaggcacaattctcacactgggttatttgtgagctccttccatagagtaatccaggcaattaactggcgaaaaatacagcagcaacacctcacggttacgcttcacctctctctgactcaggtaaacaggaaggccacttagcacttctgacacagacagaatcaaaacactggtcccctcctctgcctttctttttaaaacaagatcaaatggctgacttgaagatggcttggaaaacaaagcagtttagaaagctacagggtgaacatcaaaaacatagggttagtgtcactcggggaccgcagtgggcgttgattactgacccgtcacttaaaggaccttctttactggatcatgggcaaggtggttttaaaacagaaacagaagagacaaaaagaattatcggtgacagagccgagaattctgaggcttcgctcgagtagaccgagcgcagccagtggcacagctgaaatcacactcaacatccacgtcaaatggagcacacaggtggcggccatgcagcttaagtggccagggggagacaggtcagccccagcagtagccgaagcagacattccaagggggcagctcaaacaaaacccaaaacacacacagtgcctacaagggaaacaagtcgtcggacaggctgcagtgtggggtcatctattatcagtcccgctgctaccataggcattatggctgtaaagatcctggttagagaagtacagatagacacagagaagataaaaacgggaggcatgaaaaagaaacaaactccacagacaccagtggaagggtttgattagggtctaagttagcggttgaattgtgtcacctgcctctaaattcacttaaaattttttttttttttttttttttttgagacaga

SEQ ID NO: 11683 - DNA, 1020 bp, Homo sapiens
gactcactgcaacctctgcctcccgggttcaagcgattttcctgcctcagcctcctgagtagctgggaatacaggcgtgcgccaccatgcccggctaatttcgtgtttttagtagagacggagttttaccatgttggccaggctggtcttgaactcctgacctcaagtgatctgcctgccttggcctcccaaagtgctgtgattacaggcgtgagccaccatgcccagccatattcttggtgaatttcttactgccattagacattacttataaagtctatgacttaatcttttgtgacattttatgcatttctctcttgcctccagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaaggtgagatgaacattcagaagatttacatcacattccaagagctaattttagttctatacatttttacctgtctgagtggagtacttattttttttaaatttcttaaccaaaacctttttgtgaaatacgctttttattttttgcaagtctcctaattaataaaaaagtttcttgaggctagtgtttgtttttttgttgttcttttttcttttatttatttattttaagattgtgtctcgctctttcgcccaggctggagttcagtagcgtgatcttggcttactgcaatctccgcctcctgggttcaagcgattctcccaagtagcgtcaggcgtatgccaccatgcccggctaatttttgtatttttggtagagacggggtttcaccatgttggccagggtggtctcaaactcctgacttcaggtgatccacctgcctcggccttctgaagtgctgggatttttttgttctttacatttgtcccttctaacagattttc

SEQ ID NO: 11684 - DNA, 1024 bp, Homo sapiens
aaataaaatggtagtcaggcatagtgacgcacccctcaggaggctgaggcaggggattgcttgagcccaggaattttaggttacagtgagctataattgcaccactgtacttgagcctgggtgatagagtgagatcctgtcttgaaaaaaaaaaaagatggctgggtgcagtggctcacgcatgtaattccagcattttgggaggctcaagcaggtggatcacctgaggtcaggagttcaagaccagcctgaccaacatggtgaaaccccgtctctactaaaaatacaaaaattagctgggtgtggcagcgtgtgcctgtaatcccagctactctggaggctgaggcaggagaatcgcttcagcctgggaggcagaggttgcagtgagctgagattgagcaccactgcactccagcctgggcaacagagcgagactctgtctcaaaaaaaaaaaaaaaaagacattgacaaatgtgttttgttttcaaatccttctatagctcaccagaacaagctagaagaaatgatcaatgagctagcagtggcgatgacagctgtaaagcacgaacaggaatacatggaagtccgggagagaatacacagagccagtaagtgaatgccgtcactttgcagcagtgtctgatggtgaaggttgttttactcaacagcttgctcgtattttcctcatttggaaactttgcaaattttatgtgaaagcattgactttaaaagtgtacctacacgagatattttttgagcatacacatgtgtggagctttgtagtttattattgggacattcattgtaaactagaaaatgctattaagatttagtacaagtttttaagagtttagttttctggccgggcatggtggctcacgcctgtaatcccagcactttgggaggctgaggcaggcggatcacctgaggttgggagttcgagaccagcctggccaacatggtgaaacctcgtctctacaaaaaataaaaaaattagctgggtgtggtggcgtgcacctatagt

SEQ ID NO: 11685 - DNA, 1102 bp, Homo sapiens
ctgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggtttttgtttcttttgggtctttcttttttggcacatgtgaatcttgttttgtgtaaaatgaaattactttctcttgttctctgatgatgggtttaaaattaaaagagcatccggttttggtatggggatgatccaggattatgttgtgactgatacatattagttacttgtgcttttttttttttttttggatctttgcaagggcaaaactacaagtaacgagttttatataattaatttaaatttgttacag

SEQ ID NO: 11686 - DNA, 1028 bp, Homo sapiens
taaatgtgaagggacaatatttttgatatattgggttaaataaaatattaaaatttatttcacccatttctttttacttttcttactatggctattagaaaatttaaaattgtttatgtggttcacattttatttctattggacagcaatggcctgaagcagggtcctcactgttggcactattgacattttgtgctggaaaattttttgttatggggctgtcctgggcattgtaggatgtttaacaacatcactggaatctgtccatcagaggacatcacctcccaaccctggttgtattttatttatttatttatttattgaggcagggttttgctctgttacccgggctggagtgcagtggcacagtcacagctcacagtagcctcgacctccctgggcctaggtgatcctcttaccttagcctcctgagtagctgggactgcaggcatgcaccaccacacccacataattaaaaaaattttctttgtagagacagagtctccctgtgttgcctggctggtctggaattcctggccttaagggatctacccacctgggcctcccaaagtgctgtgattatagatgtgagccaccacgcctggcccaccctgggttttgacaaccaaaaatgtctccttacattgtcaaatgttccctcaggggttgagcagggggatagcaatcactgtgtagaggcagttagaataatattacacctgctgtgatttaagtgagctcaggccctggggaccagggctgaatcctggagggagcagcctccaggccaaggcctgaatctaattgaggttttttttgattgctaaaaccaggtttcttttaaagtctggcaacctctacagtgcttaaaatgagagggtttatttgaatcatgattctgtgatactagagctggaagggaccctaaaacccaatgtcttcaacgccttcctggttcagagaggaaagtaggagcgacagggctagaattcaggactcccacctcccagctcagctcactgtcccca

SEQ ID NO: 11687 - DNA, 1719 bp, Homo sapiens
ctcatcagaagtgggagttgtagttgccattgatgtttctgacaagctggactgggtgagggaggaggctagctcttcccaagcagagggaaggactctgcatagggtagtgtggagagcatgggcgctagagcaggactgcctggtgcatatcttggctttggcccctaccagatttaaccgatgaacttagaggtccttacttgtcaaatgggggccacagtagtatacagcttcgtagggttgctgcaggattaattaattaatccatgcaaaaatgttcatgatagtgcttagtacacaataagtatgggttgagcattcctaacttgaaattccaaaatccaaaatcctccaaaatctgaagcttttttgagtgccaacatgatgctgagaggaaatactcggagcattttggatttcggatttccagattagggatgctcagctggtaagtatagtgcagctattccaaaatctgaaaaaattcaaaagccaaaaaacacttcgggtcctaaggaccttggatgagggatacttgtactactgttagctttggacacactgtggctactgttgcattctgttattttgcattcgttttgcatttagagatggctgagtacatgagaaaaaattccaaactggggatttggttttggtaaaaataggatgaatgcattcaggtgaatttaatgtctctaatttgggagtttgaatggaggacttgattgcattatgaagaaaagcagtggggtctgcgtccatggaggccttttaaataatgatgtacattgctttctggaaatcagtattcaccttagagcagtgacttctgaacttggcatcagaatttcctgggggaactcttaaataatagggattcttaggttcaatctcagacctactgaatcagaatctgtatgtcgtacccaagaatctgcatttaaaaaaaaaaaatctatcctttggctgggcgaggtggctcacgcctgtaatcccagcactttagagttgaggtgggaggatcgccggatgccaggccaggagttcgataccagtctgggcaacatattgagagtctgtctcttgaaaaaaaaaaaagaagaaaaaaaaaggtaaataaataaaaatctaccctggagatggtgtaatggctggcatgtatattgggattgggagttgggaactgttgcctgttggatgactgtgtttctctgagctatatgattttgtgacatacaaattaacttttacaggcagcagcacatgttgatatttattctgagctaggtagaccagttaacattccgactaaagtctgtcctacccatgggggaaatgacattccttaaaatttaatgctgaaactgaaaatagccatggggattattattgccaaatatgttttttattagtttccctttttattttgcaggtatgcaaggcagatgagaaatttaatcagctggtccattttcttcgcaatcataagcaggagaaacacctggtcttcttcaggtactcctctggtctctgtggtagaggcatcagggattcagccagaatgtgcaggtgcatgcggcctttgggttttggattccatctagcatggttctctccggaatgcttttggctgcaaataactgaaaacccaacttttgttgtccgaacaaggttggctttatttttctcccgtaaaaagtcgtccaaaggcag

SEQ ID NO: 11688 - DNA, 1044 bp, Homo sapiens
cactgccattttccttgtcattcccctagggagggcttgtagttaggttgcgtctgctgcagctattgctcactgttcccctctcccggttgtagaaggaccaaagtggccaatgactctaagccctctgtccctcttgcagcacctgtgcctgtgtggaatactatgggaaggctctggaagtgctggtgaagggcgtgaagattatgtgcattcacggaaagatgaaatataaacgcaataagatcttcatggagttccgcaaattgcaaaggtgggtgggcttcattgaaggtagcagctctcctgccacactgctctttcaggtccccaaatgccccattctctagtagcctgtgctgtccgcatgtgttgtctttcctgcctggaaccctcttccctctctaatctggttatcacatctctgtaaacaccccgagcctccattgccctgttccaattgctttgccttttgctatgtcatttccctagttactgaacttctgtgctagacagcaggctccgtgacacaggagtcctgtgtattgtcttcactcccagattgccctgtgcccggtccagggaaaggttgtgatgactgtcaagcagcaaggagcaaatccatttgtcctgtctgggtagaaactgtctgtggcttaaggccggacacggtggctcacgcctgtaatcccagcactttgggaggccgaggcgggtggatcacgaggtcaggagatcaagaccatcctggctaacgtggtgaaaccctgtctctactaaaaacaaaaaattagtcgggcatggtggctggcgcctgtagtcccagctactccagaggctgaggcaggagaatggtgtgaacccaggaggcggagcttgcagtgagccgagactgcgccagtgcactccagcctgggtgacagagtgagactccatctcaaaaacaaacaaacaaagaaacaaaaaaacaaaaaactgtctgtggcttattaggcttgtgactatacagcaggcaacttgtgtctaccaatgaccataacttgt

SEQ ID NO: 11689 - DNA, 1065 bp, Homo sapiens
gtgtgtgtgtattttgggggtgcatgtgtgtattttgggtgggtaggtgtgtgtattttgggggcgtgtgtgtattttgggtatatgtgcgtatgtgtttattttgtgtatgtgtgtgtttgtgttttgggtgtgcatgtatatacctgcccatgtaggtgctctccagaatgagttcatcaaaccgttacgtggagcgggatttcgggggaaatgttactgtcatctttatactttaggtatcatttaacaatgataaatgggaagacaaactggaataatgttggttgtggttcgcagtatattgtgtgacattggtgtgagaggactggcatgtgcctgggtggaattaacatgactgtgatttttaggtgattaaggctgcagaagacagtgcgttgcagtatatgaacttcatgaatgtcatctttgcagcacagaaacaggtgaactgagagcctgccgtttaaagtatttgtttcataacgaaggagtcaatttcattttttgaatgctctactctgaggtattctgactacgtaggcttatgaatgggcaaggaatccagaatctgtattatgttctagtcttttctctattttgggtcctggaccacttgagaatctgatgcattcccaaaacaatatgcactcaaccacagttttgcatagagtttcatggtattcaggtaacctttagcccatccttggaccccatgccaagaatccctggtttgacagtttgctgtataaaccttgcatcagtttctttatcttgttgctgtggcgaagctgtaaaaattcagtatttttactttgcaaagagctgaaatgttcagatgaagtataatacattttcttctttggtgtgtttatgaagaaagaaaacctccttaaaatttcagttttaatgtaaaatgctgctatagccatgcataatgttctctgttgtggagtggcagcatgatgtagtgaaaagagcctggactttggagacatgccgagtggggtgacagctttctcacccgctggctctgtgaccacagcccagccatgtcctgggtgc

SEQ ID NO: 11690 - DNA, 1080 bp, Homo sapiens
tggtcaggcgcggtggctcacgcctgtaatcctagcactttgggaggccgaggagggcggatcatctgaggtcaggagttcaagaccagtctggccaacatggtgaaacccatctctactaaaaatacaaaaattagctgggcgtgatggcgggtgcctgtaatctcagctactttggaggctgaggcaggagaatcacttgaacccgggaggcagagattgcagtgagccgagatcacgccactgcactccagcttgggtgatgagcgagactccgtctcaaaaaaaaaagcttcataaccactgatcttgcccaactctgagcttatgtgtaaggatactcaaacctggagagattaagcatcttctatttaataagtgtttattggatacctagtatatgcaacatcaattctggagagaaaaggacaggaaagacaagctctgcttgtaccccaggagtgaacatgtacatgtctaaagtcattctgggataaactgaggattgttttcattgactttttttgtgtatttactcttccactgataggatgataaagaaactaaaaaggtgtacaataaactgagtttatttatcagatctgtgtttagctttctctaagtatcccgaagttgtttgcttttatgttaaggaagaagaatcagggcttgcatgttaccataggtttatgggggggaactgaagataactgtgtcatctctgtatacatttcccttttataaaatgaacggaggctgatgtgtacttttattgtgttttccattatgtattcttatagaccctgttttgagtcactttaaaaatacagcaatgttttcctttcagaaggtgttggaagtgacagtgaggtggaagagaggtctggactggtgttcctccaatgagacagattccttctcagagtccccctgtatcctccagacccttctggtttcagcatctcataattcatcctgttcagcacatctactcattcaagtggaaatttatgccaactcttctctgacccataatgcctcaggcaagtgaagtctttgactgtcaaaactttcatgttg

SEQ ID NO: 11691 - DNA, 1047 bp, Homo sapiens
ctggaccagaatatgcaaagcctatagttagacaaccacctggcttttatttttttgagatggagttttgctcttgttgcccaggctgaagtgatctcggctcaccacaacctcctcctcttgggttcaagcgattctcctgcctcagcctccggagaactgggattacaggcatgcaccaccacgcccggctaattttgtatttttagtagagacagggttccaccgtattggccaggctgctctcgaactcctgacctcatgatccgcccatcttggcctcccaaagtgctgagattacaggcatgagccaccgcacccggcctttttttttttttttttttttttgaggcggggtctctgtcacccaggctggagtgcagtgcacaatctcggctcactgcaatctctgcctcccaagcaatcctcccacctcagcctctggtgtagctgggaccacagatgctccaccatgcctggctgtatttttggtaaagacggggtttcgccttgttgcccagggtggtctgtaactcctgagctcagatgatctgcccacctcggcctcccaaagtgctgggatcacagacgtgagccactgcgtccggtccatctgacttctcaaagactttagaccttgacttcagtgatttgttgtagtcttgtatgcttctctataaaattttaataaatgaaatgtcttatttttgtagaaaatttttattaagtgccctgtgactttaattcatatatgtagctatccaatgcagaatgaatattctcatcgctggcctgaactgagtaaaatgcatgagaagaactcaaaaatgttagaaattttagcttatcacaaattagttaaagtcataggagttttatttataccagagagaatcagtcttttctttagtttttaatacattcgtgttgattgatgtttcccatattccgtagaaaggattaagaaatccttaaaaatgcatgtaatacaaaaacacaaaatcactgatggggaaagatatgggggctgcgggaggaaaataataa

SEQ ID NO: 11692 - DNA, 1041 bp, Homo sapiens
tctcttgatgacagtgagggttcttgttggcatgaagtgtccttctgactcagttaagcgagaggatttcttggtaggatgggatgggcgttggtggctcacagggttgacaggggtgaggccaagcttgggaatgggtaggaacccagggagcttgctggatcctggtaggccatcacgctgccgcagtgacaatgacgtctaaccatttcctgtgccctagggtcatgttctccagaggcaacctcccaaaagagggcatctgattgattgggcttagatttttctgcccacctccgagtggtactaggggcagggagaaggaaggaatggctcccttagctgccaccaggataggcaggtgcctggaatgatcctctgtcaatggggagaaagtcctctaagggaagtcgggtgccaggtggacagaaacaaaaacatgcccactccactgaaagcccctgttgttcttccccaggtactgcacaaaaccgaggactatttgaggcaagtgctatgtaaagccgccgagtctgtctacagccgtgtgatccaggtgaagaaaatgaaggccatctatcacatgctgaacatgtgcagctttgacgtgaccaacaagtgcctcattgctgaggtctggtgtcccgaggcggatctgcaggacctgcgccgggcactggaggagggctcggtaaggctgccttcctctcctctgccaggaacagaagagagactgatggaactgataaattcagagaaaaaaaggaagtgagaatttcatagagtaatgagaatgcagtgtgttgactcttcttttgtttttttaaaatattaattaacaaaattaaaatagagatggggttttgctgtgttgcccaggctggtctcaaactcctggccccgagcgatcctcctgcctcagcctcccaaagtgctgggattacaggtgtgagccactgtgcccagccttggctctgtttttgaactgaaattatggtgagctggtcattcaaagctgtatgtgagtacatgtgtttttaa

SEQ ID NO: 11693 - DNA, 1030 bp, Homo sapiens
ctgagcaacagagccagaccttgtctcaaaaacaaacaaacaaacaaacaaacaaacagtgattttacagaatgtctctctctctctctttttttttttttttggagatagagtctggctctttcgcccacgctggagtacagtggcatgatactggctcactgtgcaacctctgcctcccaggttcaagtgattctcatgcctcagcctcccaagtagctgggactagaggtctgcactaccatgcctggctaatttttgtgtgtgtatttttagtagcgatggggtttcataatgttggccaggctggtctggaactcctgacctcaagtgatccacctgcctttacctcccaaaatgctgggattacaggcgtgagccatcgcgcctggcccagaatgtgtctcttaacgtggtctttctgtatgttctttcaatatatagtctttggtggtggttttgttaatttcataaacgttctcctgaattatagtttttggtatttgctctactgtcttgctttggttttcttcttttaggacctcctgtcatctttcagtggaaccttctttgcttatcttcagtatctgtcactttcctttgaatcctttttgtctttcgttacttctttttgatttgtaagatttctcctcttcgcgccttctgtttctcttacggcagtatgaggaagggttcttcacttttgtgttccttctagttttgtcttacttctgaaataatttctttctttttttcctaattccttcttgagttctgttacctcatttctgagtcttttaaaatctgattcctggtgctttttcctgtcctgtattttttttttaattcttttaactccttttgaaacagtaagttacaatggttttatttgttttgtggacattctttctggcatcttctcactgtctgtggggatggtattctactccttggcttttttcttcttatgaccttatgtaagattgggcttctccctcctcttgctcacttttaaatgaaattagacttt

SEQ ID NO: 11694 - DNA, 1032 bp, Homo sapiens
gtaacacaaggctgggcacggtgctcacacctgtaatcccagcacattgggaggctgagacaggtggatcacctgaggtcgggagttcgagaccagcctgacctacatggagaaaccccgtctctactaaaaatacaaaattagacgggcatggttgcatatgcctgtaatcccagctactagggaggctgaggcaggggaatcgcttgagcctgggaggcagaggttgcggtgagccgagatcacaccattgcactccagcctgggcaacaagagtgaaactccgtctcaaaaaaaaacaaaacaaaacaacaccaccaaaaaaaaccaaaaaacaaagcagtaacccagattcgttgaatatggatagttattttcttcttggatagtaattttttatctttccttgtttatgtggaagagagagagtggtgctacaatcccctcattcatgaatataatccccacaaaagaaacaccccccactcggatccgcaccaacaaattcaccgagggatttcagaacatcgtggatgcttatggagtcggaagctacagagaagtcaatccaggttggaagtctgatttgtaaatacccgtatttccaatggcattgttgcattcttgctctaagaatggaatagatatttggaaagagaggctgaccattacttttttgctatcttatttaaaagtataaggttttaaatgtaaccacacaatcctatcttgtgaattctggagaaagtcaagattgttatgtatcattgtgtttgaatgaactcaggttttccatatttgctgtgaatcagaaatctctttcccttttttctgcagctctctttaccatcatcaccttcccgtttttatttgctgtgatgtttggagacttcggacatggctttgtgatgtttttatttgccctcttgttggtgttaaatgaaaatcatcccagactaaatcagtcacaagaggtaaaaatataaacactccagctcatatatctggttaggtggcattagcagtgaccga

SEQ ID NO: 11695 - DNA, 1047 bp, Homo sapiens
actgggaggctagaaattttaaaattagctgggagtggtggtgcgtgcctgtggtcccagcttctcggaaggctgaggtgggaagattgcttgagccaggtcaaggctgcagtgagccctgattgctccactgtactctagcccctgggcagcagtgagaccccttaccttaaaaaaaaaaaaaaaaaaaaaaaaaggttgggcgcggtggctcacacctataatctcagcactttgggaggccgaggcaggcggatcacctgaggtcaggagtttgagaccagtttggccaacatggcgaaaccctttctctactaaaaatacaaaaatcagccaggcatgctggtccagctactcaggaggctgaggcaggagaatcgcttgaacccaggaggtggaggttgcagtgaaccaagattgcgccactgcactccagcctggttgacagagcgagactcctcaaaaaaaaaaaaattatcttaatagaccctgtttcccttttcctaacccacctgaagggcaggctgtaggaattaattttcagacagtaagagaagcagtcaatgagtggggaagttacggggactcagactggccggggcaccgtggggaggtcagccatggtctggagtccctcttggcacatcttgggttggccacttgcaccatttctgatttcattgtattcacagctaaactttatgacaaaatagacatacaggagcatgtatggcacatgtatgtaaatgtgtgataacacatgtatgtctcctgcccaggtagaggggacataacccaggaccttgagagcatcctgacccttccagtctctgagctgtgtgtgactctcccttgccttgccttttgtcaagacttcctaggcacatctccctaaacgctatgtggttccatctggcaccctttgacgttaacaccgataaaattgttttgtaattgtctgtggccctggtttaaggaaatcaatggttctcagattgaaagcatcaaaagaaaagcctgaatattgtttccttcttaaacttagag

SEQ ID NO: 11696 - DNA, 1036 bp, Homo sapiens
cactcatgggtagccttgatcacaggagtcctccctttgcacaattccagtaatgcacacatgttagtttccacagtgtagttaacacctgttccccagcagcatggttcccatttcagtcaccacagtacctagccgtgcagttaggtgcaggtgcatttaccagcctacgtgcggcaggtgtcgtgatgaagatgctgataacccaccagtggtgctcggcaatgtttcaggacgttgaaggtttgtgcaaagggtgcaatgttgcaagtgggttcagacgtagaaaagaataggacaggccaggcacagtggctcacacctgtaatcccagcactttggggggcccgaggcaggtggatcacctgaggtcaggagtttgacaccagtctgaccagcatggcaaaaccatctctactaaaaatacaaaaattagctggttgtggtggcgggcgcctgtagtcccagctactcaggaggctgaggcaggagaattgattgaacttaggaggcggaggttgcagtgagccaagatcacatcactgcattccagcctgggtgacagaccgagactctgtctcaaaaaaaaaaaaaagctaaaaaaaaaaaaaaataggacaatttggcaagtattaggaaagatgcttgctctgcatcaggtcacccagcttgccaatttacacagcaggaaccaagcactgttcaaactaccctaataaacttttttttttttttaaataacagacaaaagactttaatactcagtgcttctaatgtttcaaagatagatttaccattttttcatttccctatattttttgttaaaacattaataactctcttattagctgggtgctgtggctcacgcctgtaatcccagcactttgggaggcctaggcgggcggatcatgaggtcaggagatcgagaccatcctggctaacacgtgaaaccctgtctctactaaaaatacaaaaaattagccgggcgtggtggcgggcgcctgtagtcccagctactcaggaggctgaggcagga

SEQ ID NO: 11697 - DNA, 1029 bp, Homo sapiens
tatttttgtaacaaaatataaatgaagatattttaccatgaagagattgcacttatccttgagaacagtctaaatataaatgaagatattttaccatgaagagattgcacttatccttgagaacagtctaatgatactttttttactttcagactgtttctagctaaagttctgataaaagtattgagttaatttaaactttcaaacactgtttagatcagttgaaaactaattcttaatagccattgttttataatctttagtttaaattcatctgtttgacatttggttttttgtgaacttgagtcagtcctattgaacattttgacctatattcttgcaaattatgttaatttttcatattttagtttgattttagacaattattttcaaaaagaaacctgactttttttcaccttcttgacattgtgagtgatacacgttaaaaggctatttgcccgcatcctcctctatcctgtttcgaggtagagagcttggcacttctgttacaagctgagagtctggaggtgctgagtttaacgtggctgtgcagctgatttcaaggcatgagctgaacagcgttgacacagccgtgacttacaattaaaccctttcaattacagtacagattctgtgtgctacttgatgagatgttacccaaggccagtttggacttactgctttttgtccctcatattaaattatcaaatgatgccgatgaaatgcttgaaaatgattctgctctcaaagttatgcttccctagaaaggtgtcatgtcgggcacttgtgttgggtgactatgacatcccagcagtgctggtcaggtctcagagttgctttcacctagagctgatgcttccacaaggggacatttgtgttactttgctccaggggtctgtcataaaaacaatggtaactacttcatccctaggaagcccaagacttcagggcactgttagctgattggtaaataagggacacgatattcacgggaattgtttactgctccccactagtaattctcatggg

SEQ ID NO: 11698 - DNA, 1045 bp, Homo sapiens
cattttttaacaactgctgcaccatgttccatagtttcagtatatcatggtttagccatttcccaaattgatagcagtttaagttttaactttaaaacagcttttttgctggtggtggttctctgatgagatgaaatttcggtgataggagcacagatctacgctaattatcgagattcggcatttatgatgaagttctcttttggttaagaaattgatatgtggaagcagccacccctcccctatggtagttctgactctagcagttagaagttgtgtgaccttggggaggacattgaatcacaccaaacctcggttttcttttctgtaaatggcctgctctgtctgctccatagagttcagtgatacagtgcgtatgtgttgtggaatgtaaagtagtatatataaaggttggttttattagcctttgtgatccaaaaattatttgcaatatcatttatattttttgaccagatgtgtgtgtatcatatcacagagcactacagatagtcaactttgaatgctttttaatttgtgactttttaaattaatttttatcaagtactgacaatacattagtcttcttaacaatattttgcaaagcattttttcctagggctttcttttcttcctcttcattaaaaaaaaaaaaaaagagagagagatagggtctctttctgttgccgtggctggagtgtagtggcatgattctagttcactgcagcctgggactcctgggctcaagtgatccttgtgcctcagcctccccagtagttaggaatgactacaaccatgtgccaccacacctggctgatttattttatttttgtaatgacaggctcttactatcttgccccaactggtctcaaactcctggcctaaagcagtcctcccaaagtgttgggattacaggtgtgagccactgtgcccagcccctagtggttttacataccttaaaaaataaggcatataaattagttgactgtgaataaacatattagcaaactgaacactagacaatactcgcactataatatttaagctt

SEQ ID NO: 11699 - DNA, 1045 bp, Homo sapiens; identical to SEQ ID NO: 11698

SEQ ID NO: 11700 - DNA, 1045 bp, Homo sapiens; identical to SEQ ID NO: 11698

SEQ ID NO: 11701 - DNA, 1024 bp, Homo sapiens
cattctcattttaacatattacaaaacacatgaacaaatccagagatcccaaggctgtgtgtgtgtttatgccagtaagaacttgtcataaatatcggtggaaaatgacactttataccaaagcaattttattgctcagatttaggcatatgtaaataaactgcatttctagagtaaagtagcacatacagattttgtgtatttttaggcggatgtatgcattttatagactctgtaccttcctaaatactgtgtctaaatatggcttcgctgagagaccgactttccctccccctcttaattctttgctggccctgatccaggtcttctctgcatcatgaattatggtgggggtgttgtatttacagaattttaaaacctaagacctgcagacggcttttggggaggtctagaacctttttaagttatgtgcagaattttgtgtacctgtaggtctatgcatttttctaggaaagggggctttccttatgtttgtgactctaagagataaagaacactggctggcatatggttactcgttgtttggggatcttgggaggcaaaaggggtgcctaagagttccagttagtggaatggataggaaatgatgggtataataaacggaggaaaaaacacaacgctgtgttgtgaggaaagagggaaaaggacgttggcataaaatggaaggatacatgtgcatgtgttgttatgctgggcccaggaggtaggctgtgtggcagtttcgatgtcatacgcttaagacaacagttctgcgaacagtgtattaaaagaatataggtgaggacaattgagtattcagaggggactggctggacgtggacggaattggctacctgaatggaaaacactagatctcaactgaatctgtcttggttacagaggaggcagttcttgctgtaaaatgggtgagggccccagtactggtgtgggttgtatttaggttctcaaatagacctattcatattgctcaatgccatgttctctcatgtctaatttttatgtc

SEQ ID NO: 11702 - DNA, 1155 bp, Homo sapiens
tcagcatttgtgaattcagtgttcgcagggacctcataaaacataactcctgcgaatagcaaggactgctttatctcttttctgaccccaaactggattcaagtaggtgctctgcaagcctgttctgcagcttctttcacttctgaattccccgcaccctccatgttgggtgcccattgctgtctgtgcagtggagttttgccaaccacgggtgcccacagatatccacggcctttgggcaaacctgtcaagagtgtgtgccatggcttctggaatgcactggaatattccctggctgcatgctgtgcttctttctgcggggctgtgtgttacccactccataagagggaaacagctcagtaacatccctacagcccatcctgggctattcagagccccaccgagccaaggtgctggcactggttgtaccctacgcctgagttattctttgccatgttgattgcaggccactttatacaaagatcgcgactaggacaatttctaaaaagattgaggccaggcgcagtgctcacacctgtaatcccagcactttgggaggccgaggcgggtggatcacctgaggtcaggagttcaagaccagcttgaccaccatggagaaaccccatctctcctaaaaaaatacaaaaattagccagggttggtgtcacatgcctgtaatcccagctacgcgggaggctgcagcaggagaatcgcttgaacctgggaggcagaggttgcagtgagccgagatcatgccattgcactccagcctggtcaacaagagcgaaattccatctcaaaaaaaaaaaaaagaaaaaagattgagacttaaaatgggaccctactgttttgaatcaaattccctttaaaaacatagactcaatttctttcccttcgtcctccctgcccctgccccaggtctggaaccattctcccccatccctccccggaccccagcctgcttcatcacacatcgggattggccgttcaaattctccttttacaggacgtgtgctgcaccgaagggcttaacattccctccttgttttcagtgggctggggtgtgcaggggtccccgggtgggagcaggaggctgaggagagcctgctgcggcaatgaaagcaccaggttcctcctctttctcaggcgcggccc

SEQ ID NO: 11703 - DNA, 1043 bp, Homo sapiens
tttttttttttttttttttttgatttttttgagacagagtctcgctctgtcgcccaggctggagtgcagtggcgcgatctcggctcactgcaagctccgcctcccgggttcacaccattctccttcttcagcctcctgtgtagctgggactacaggcgcccaccaccacgcatggctaattttttgtatttttagtagagacggggtttcaccgtgttagccaggatggtctagatctcctgaccttgtgatccgcccgcctcggcctcccaagtgctgggattacaggcatgagccaccacgcctggccaccctcctcttctttctaatgcagcggtcctcaacctttttggcagcgggaccagttttgtggaagacagtttttccatggactgggtcgggggatggtttcgggatgattcaggcgcattacgtttattgtgtactttatttctattatcattacattgtaatatagaatgaaataattatacaactcaccataatgtagaatcagtgggagcactgagcttgttttcctgcaactagacagttgcatctgttccttctgggggtgacgcggacagtggcagatcatcaggcattaggatctcacaaggaacatgtaacctagatccctcgcatgcagttcacaatagggttcacactcctatgaaaattttttttttttttgagacagagtctcgctctgttgcccaggttggagtgcaatggcgtgatcttgactcagtgtaacctccacctcccaggttcaagcgattctcctgcctcagtctctcccaagtagctggaattacaggcgcacaacactacactcagctaattttttttgtatttttagtagagatggggtttcagcatgttagtcaggctggtctcaaactcctgacctcaggtgatccacctgccttggcctcccaaagtgctgggattacaggtgtgggccaccgcacccagccatcttttttttttttttttttttttttgagatgctgtctccctctatcacccaggctggagtg

SEQ ID NO: 11704 - DNA, 1180 bp, Homo sapiens
gcagtctccaacctgtcccagtatttcagcccagcctcggtgtccagcagcccggcccgcgcgctcctgctggtcggcgtcgtcctcctggcctactggttcttgtccctgaccctgggcttcactttcagcgtcctgcacgtggtgttcggccgcttcttctggatcgtgcgggtcgtcctgttttccatgtcctgcgtgtacatcctgcacaagtacgagggcgagccggagaacgcggtgctgccgctgtgcttcgtggtggccgtctacttcatgaccgggcccatgggcttctactggcgaagcagtcccagcggccccagcaaccccagcaaccccagcgtggaggagaagctggagcacctggagaagcaggtcagactgctcaacatccgtctcaaccgggtgctcgagagcctggaccgctccaaggacaagtgaaggtcagccggccgggcgggtccacagttaccagcacgctgtctcagaaaacgaaaacggaggaaaaaaaccccaaaccccaaacaatcttaataaacacgactgagcaagaaagtggcgctgtgtagggctatttccacccacccggcagctcttaggacacattcccagaagagcggaaagatcattgacgtggaactacacacgaagtgtaattagtgggggaaaaaatattttttaaacaaaggatataaccatatttagttgtacagtaagagaaatttatctgtgcatagagcataaagttaattttttcaagcatttaaatacatcttttgtaaggttttttaataaaggcagattgagtcaagtttattaaaactttacatggaggggaagaatatgctaatttgacatttgagaaaagtttaaatgcgagcgtttgttttcacagcttagggattggtgggtgaggtctgtgtgcgttattttcatgttcccaaactgtgagctttatttcatgttatttttggtggatgttgacttagttcatgaatgttgtcacttctaaatgtggacagttgggctgcaggatgcaactcaacctcttttggatcctagagacccctgccaagcccccatcagtcctatttttaaatgaagacatcgccatttctagaagacctgagattttcttccctctgtgcttcgatgtattttaacctcaacattttga

SEQ ID NO: 11705 - DNA, 1065 bp, Homo sapiens
agaacgcaaaggtttgggtcagtgattaggaagactataatatgactttgtgcatgcccgggagggctgccttgtagagaggatgtgagcagcttagtcgctcatctggccctgtgattcaggcttatggagcgttaagaataacagctgtcaaatggcctagacatggttaatgcaatttgttgctagtggaaatcctgaattgcttcctttctgtgatcactgctacttcttaagatgcttttgatgaatgtcatctgccttacaagttgacacctgataacttctccctgatgggtttccgaactggctgacttaaccaaaaagccagctcttgccatctatcttgcattaaaaggaattcctgaggctcctaaggggtcagctgccccactcctgacttttttatttttaatggtctataccttctgcaacatttttgtttatggccatttgaatagttggactttgactcctcacttgtgaataataggaatatattttgcagaatctaacataatacccttaaaattcatactggacaaccatcagtgtgatgtatagtatctggtgtaaacaaattttattcagcatattaaattattctgtgttttgcttttccttgatatgtaggaggtgcaccagtaccagtttttctcttgtggtggcttaaaacgctgattgccatttgcattgtctactgaaaagctgtggcagcgagtggtattattgaccatgtgttctcatgtctttttgcagatttaaaggttttattgtagtgtccatttaatatctgcatgtgtgtttaatctctgaataccatgtaattaaactgattaacttgtgatggtgatggtgattagcacacactaaaaacccaatgaagcaattgtctccctcttcttaactggaaatcacacttgtgaggtatggtatccattatcaacagtggattcatgattgacttcatattttgtgtatctggttataaattttgtatagcatttaatttggcacttaatataaatccatttgatttgaatagtgtgtgtgtgtacatggtgt

SEQ ID NO: 11706 - DNA, 1123 bp, Homo sapiens
ctttgggcaagtcactcaccccgttcctgccttatcagggttagggagtggatactattgcccctctttttttctgagacggagtctcactctgtctcccaagctggagtgcagtggcgcgatctcggctcactgcaagctccacctcctgggttcacaccattctcctgccttagcctcccaagtagctgggactacaggcgcctgccaccatatccagctaattttttgtatttttagtagagacggggtttcaccatgttagccaggctggtctcgatctcctgacctcgtgatgcaaagtgctgggattacaggcatgagccactgtgcccagccttattgcccctctcttaaggctgtgaagggcagtaagtgcttctaatgagctcagactggggcctggcacatagtaagcattcagtaaatgctcaatatgttttaactggcaatcatttcttccccactaaaccaagaactctcggtccatcttagaatcccgggcacagagagggcaccagtgtagacatgccatttgtggtttgtgtgttcgccacagccaaggtctggacaggccccttacctgtgggtgagggagcttgggtgtcaggagtgttgggactcactttgcataaggggtggctggggctggagggagccaggtgcagggataccttgtccagggccatgtggccaggaaagggaggagtaaggaccatggccttagagtaggttgaatgtgttaccttgatatttgcatagagagcgtcagaagtaaacagagggacacccaagtcccagcaggacatgaaagagtctgagaaatcgctgtgcatgcacttagttaagtggacgtggtgtctttccaggaagggcaggcacttgctctcggggggtgcatctgggcactgagaatggggaagaggggcttgcctggctgggggtgagcttctgtttagatgccttgttccagtgccagtgcccaggcgctggtctagggggtgaagacttctctcctggatgcttctgtcccagtctcctgcccatcagaagtggctggggaggaggaaggggtggcattctcagtccaggagggtttggtgccaggaagggccatttctgg

SEQ ID NO: 11707 - DNA, 1047 bp, Homo sapiens
ccaagtccctgttacctgtatgtcccatgcacttttttaaactgatgctgaagttggccaatgttttacttaaaaaaaaaaaaaaaaagtgcgttggggcagctccaagggcgtctctgtaataatgtcacagtcattcccttgtcccccacccgcccgccgtgaactttgctgaggggcagaggaagtggcgggagtagagagaagcttggcttggtctgcgcctcctcccgtgccttccgcagtggccaaggtgttcagctggaggaagacccctccttcctgtcatgactgtgcatcctgagagcacttcagccttccttccccctgtccagtcagcactggcggggctgccagaagttctcaagactcagtgagccccagaggagctcacaagtccccagggggagccccatctcagtaacccccgccactacaaccctgccaaaccaggagctcgggctgtgcgccacaccctttcactcccttccctaccgttggctgttcttgccgcctctccactgtcctccttcatacgtttgattgagcggttcctcggttcctctgtgaccccggctaggcactgccatctctcacgcgtgccgtcgtagtagcttccgaccagtctcatttctgcttctctctactgtacacctttttatctttttcttttctttcttttttaactttcatcacctttctactatccagtacacaccctttaacaagtggatccgaaccagtgtttgtttctgtctctctcccagattaaatattctttagagggctgggctgggtagcttacacctgtaatcccagcactttgggaggcagaggcggatggatcacttgaatcccggagtttgagagcagcctgggcaacatggcaaaactccatctctacaaaaaagaaataacttagctgggtgtggtggcacacagcctgatcctgagcccgggaggttgagtctgagtgagctgtgatctgtctactgtactctagcctgggtgacagggcagaaccctgtctaaaaaaaaaaaaatcct

SEQ ID NO: 11708 - DNA, 1035 bp, Homo sapiens
ggggccccaggtgaggctgactggctgcctgggggaccacactttgagctgcccagcctccctcccacaacactctgccccttagactcccccagagtcagcgtttctgcttccctgctaagagtcaccagggagctctgaaaacaaatgcccgccgctcctgacccgttaattagttatcctaatgagcttaattaacttaatagtcccactgcaggcggtgctaccaggcagccagggtggagagcctgtgctgtgaagtccttactcacaggttctggggccactgtatgtgccctgggggtagccctaggtgttggtcttgaactgcttgcatcaggctcatgtgcgagggaatagcagccatctgggcgatggctacccatgtttgcagatggcagtctcttaacacagtgtaaccttgaggatggccaggagggaagtgaatagaagccttgtctgagagtgctttaatctgttactaacattaataatctgttaataattaataatctggactaacactcagggagtgtcagtgaatgttatgagttccaagaacaagcccatgcctgcatggaaggaatcccctgtttcaggaaagcagtgcccttggctggactgcagactccacgtgcagtacagaccagagacatgggtgtggtgatcctgccttttaagatggggctcattaactagtgtatgcacgtgtaggcttatgccattggttggcataaatgcactgcttggaggattcaggttcctctttaattgaagattccgagaaccaaaatatggggccactttgctttgctgttgtggcctctttggaagatgaatcttcttttgtatacactagcagagctgtgctaacaggctctttctgtaaggtggggaatctttttggtagtgtaaacacacactctatactcttcatatttcagtatatgtctgtaaatacttctggtatttcttgatattgatgccttccttggcatagtggttgttctcagatataagttgtgctttgatcaa

SEQ ID NO: 11709 - DNA, 1044 bp, Homo sapiens
gaattattttggatgccctttttaaaccaccatgtcttccccaggagaaacctttatatttaaggatgccttctcatgcaagacagcaaaattcttcattttagtctgtatggcatttgtatttcagagtaattatccctagcaaatggctgcaggctgcgtttaactgattcccacctccttccctgagagaaagtccatttgtcagttgagtatagggccaatgttttgagatggatgttgctgctgaattcaaaatagaaaaccaccttttcccaagatggcttgtggcttctgcggctgtttctagtgcagaaaacaaatctcctgtttgtgtcgcccctttggtggttcttggccacctacaacaatgctgcctgtcagctttgggggtaagcctaggcacacttcctgggtgacagtcaatagctgggattaattttatttgttcttgcacagatatttgtatcttgctattgtaaacctcaggatctagtaagttagtgacaacacatgatatttgctgagcggttctctgtcattgagctgtagtttaggaaattgaccccacatctgtaggaagggctcattaatctagcatctcctcctctcccttctccccacgggggaagcatcttacttcagacccacttggtgagtgcttccttttgggcaatcattggaaacaaagcgtttgctaatcaggtgatcaatagcaaacaaaggacatgggctcagaagacttcaaggccatttccaaagcctccttcagccgtgttggtacacacatggcttgttcattgtaagtgatccttctccgtggtggttatgaaaacacttaaaatattctctaaaagacagcccttggccctgtcagcagtgctgattaagcaacttgaaaccttcactcgttcgatgagttttccttcaattagcttgaatctctgagatctaactgcctcccctggtcccaggaagtttccaaatctggccaccgtccccctggaatcctggcttttctgggggtagaaacagagggaagtg

SEQ ID NO: 11710 - DNA, 1035 bp, Homo sapiens
ctgtgcattcatcttatttctctagttgtggcatttcccagcaaaaggaggaaaaccgagggtcgcctagagtcctgtttcacacaggttctgcagattcaggagtgagattgtattcatccattttcctactgctatgaagaaatgtctaacagtgggtaatttataaagaaaaagaggttgaatggactcagagtttcacatgactggggaggcctcacaatcatgatggaaagtgaatgaggagcaaaggcatgtcttacatggcaacaggcaagagagcgtgtgcaggagaactgtcctttataaaaccatcagatcttgtgagacttattcactatcgagagaacaactcgggaaaaacctgcctccatgattcaattacctcccactgggtccctcgtacgacacatggggattataggagctacagttaaagatgagatttgggtggagacagctaaaacatatcagagatgaagtgaggtgaaggctgaacgcacaggggaggtatgtggataagttcatgaggggtgggtgcagaacctgtgactggggggctgcgtggtgtttggatttcctgccacctttctcctgagcccattggcaggaggagaaccctgtttgttcctagccgtcccttggggctggcagccacctgtcttctagggtcttcctcacctcatcataactgcactgagtgcttcctggggcccctggaggtggtcatttatttcctgtggccctggctggatggtagacaggaatcccatgagcacaggcgagagccagttgggtacccttctggtgcctgagaattatgcaaatggggataggtgtagtggtccctgctcccccccgaccccaactccttctcatcatcatcattagaaaggcctcatgagatccagtctcgtcagcactttgctgatgaattaatcacaactggctggcgtgttctggccactgtggtcttggtcacccttggcctaatgacagtgtttccagagataagaatatagaagttgccagagc

SEQ ID NO: 11711 - DNA, 1034 bp, Homo sapiens
aagtgaatgaattttaattacatctcaggttaaaaaaaaaaaaaggcgccagtgatcgaggactcgtcactgggctctgttgctcctgaagtttcctagcccacaacacaccaacactgccaagggctcttctggattcaaggtgaaacacatgtgccataaatcttggagctctgaatgtttggaaagggcccgactgtgagaagaagtaacacaccgtcccgtgcagatggctggctctgaggaggagttcatgggagcttggggacactcttgcctctagttctaggaagctgggccacttctgaagtaatggcaatatcaataaagtaatggtctttatcatagaataacgtgataaaatatatagagaagtaaaaaagtataaataaaagtaaaatcatcataaaacatagtagctaggcacttctgaagctgtgtgtgcactgattcattcacccagtgactcacagccttatagcctaggtgctggcacccctactttcattcgaggaagtgaactcaggttcaggaatttacccagcatcccccagatggggtggcaggagccacatcttccctgaaaactttcttgcccagggtgtctgctgggatttaggaatggtctatgcctgcatttttatcctggtcaggctgaccctgaaccctgagagatactcttttttatattcccatctggaatatgcactgccggggtcagtggggtgtctggagggccctctcgaggccagcttggatgtgacacgtgtcgtgggtcccaacggggcccagtagagtgtgcagcgttagaaaaatgaacatgctcggctgggcgcggtggctcacgcctgtgatcctagcactttgggaggccaagatgggtggatcatgaggtcaggagatcaagaccatcctggctaacatgagaccatcctggtgaaaccccatctctactaaaaatacaaaaaattagctgggcgtggtggcaggtgcctatggtcccagctactcaggaggctgaggtaggagaatgg

SEQ ID NO: 11712 - DNA, 1050 bp, Homo sapiens
agctcatcaggggcaaagttgcatgaatatttttttatttccttccctgctttacttccagtgcctagaatgctgtgagacacagagtggaagccatctgccagtaattactggtacaagaggcccttccttgtccccatcccttcccctgctatcaaaaatgtttcaaaaattatctctatcgactgcacctggcttatggttggaaagctgaatgtcaaagacaaaaatattgttgatgctaccccctagaggcagtgcacagctgcacacagaaatctcagtgaaagtgtgaatttcacagctttgagaggatcttcttcatagaaatgacacatcacaagcaacagagctgatcagaggtagagcttaccaatatctttaacattttatatgttaattggttacttctgtgaccatcttgacatatacaaacatttacctgacaccagcatattcatttttactgataggattttataattttttttctagagttagtagaattttactgcctatccagaactcatgatctattggctgccaatatataaaaaatgttttctccataaagcactttaaaatatttttcattaatacatgatgtaaagtataattttttcctcttcccttgtaaaattgggatgtatcatatatactagaatttctcataggttggcagacatggatggagtatacactatctatagggcaaaaccctggtgcatgctgtagccatatctgctgacctgtgagaaattccagtatatatgctgacctccacagagtactttgaacagggaaactttaatataaagaactatcaactcctgtgtataacaggggattggaataaaaagggctgagaagtatagagaaccttaaaggaataacagatgcccaaagcagcctacctagggctgagatggagcggttaggtcagtggacttgctggattcactaaatggcagtaatcattatcactgcagccatctttcaatgagggctccctgtgccaggcactgtgctcagccccttatgtagagtatc

SEQ ID NO: 11713 - DNA, 1092 bp, Homo sapiens
tgctctgctgcccaggctggagtgcagtggcacaatctcagttcattgcagccttgaccttccaggcttaggcgatcctcccgcctcagcctcccgagtagctgggactacaggcaggcaccaccatgcttggctaattaaaacaatgtttttttatgtagagatgggggtctcaccatgttgcccaggccggtctcaaactcctggcctcaagtgatcttccctccttggcctcccaaagtgctggaattacaggtgtgagctaccacgcctggccttccttcctttaattctaaatgcactgacaggcattatgtatcaaaattaaaacgtccatgccttgaacccagcaattgcgcactgagatgtttatcacacagataaatttccacgtgtgcaaaatgtcttaataatgactgcagcagttgttcgtaagaggagagatttgaggatagcctaaactgattaagcaaattatgacatatccatgcagggaaatattttgcagctgttaaaaaatgaggcgggccaattttaagggagatggaactgtaagatgtgcttttaatgcataaagcaagatgtagggagttagtactgccaagtgtggacaagagaacaatacacatgtatatgtttgcaaataggtggagcaacaccctaaggagtcctataagactgggggagttgggtaccttctgggagggtaatggattgcctgggggacaagggatgggaggtgataatgttgtatggtgtgcttttgtattcttcgaatttcatgccatgtgcattttttaacttaaattatataataaaaatattttaaaagaaaaaaaggcaagctctcaatcgtcctttccccttaaaatgagaaaaaagggcctattttagtattttccatagatttttgtctctttgtccttgtgaccgagagcttccagagctatttttctttgctgtgaaattgtaatgttttgtatctggcttctagatttccagtgcagaaatgaaatctaaaaatctcaaacgcccacgacatggcattctggggtaggagggaagaaacccccaccctggctgtattctgca

SEQ ID NO: 11714 - DNA, 1030 bp, Homo sapiens
cagagaggttggcagagtataacctatgggccaaattgagcttgtgagctaagaatagtttttaagcttaaaggattatatattaaaaaaaaccccaggccaggcgtggtggctcacgcctgtaatcccagcactttgggtggccgaggcaggtggatcacctgaggtcaggagttcaagactagcctggacaacatggtgaaaccctgtctctactaaaaatacaaaaattagccaggtgtggtggcgggcatctgtgatcccagctactagggagactgaggcaggagaattactcgaaccctggaggtggaggtctgggtgagctgagatcgcgccactgcactccagccggggtgacaaagagagaccctaaaaagaaaaacccaaaattaaaaaattaaaccccagacaaagaagaatatgcagcaaagactaaacggccagtacaaccttaaatatttactctctggccctttatggaaaacatttgccaaggtctgctgttgagcattgacttatgtgaatctatcactgctttcccattctatcgccagtgggcactgggtattaccttccctttaaaatcaatttattataactgagcataattataattaaaatcttaagagtaatatatgtacatggtcaaaatggaaacacacagaatggcatggaagcaagtctagttgctcaggccaggcctgctcacagagatcaagtaattgctcacagcattttctgctttggagatttttctgttttggcatggttggggctgagggtcaggtttgggttgggttaggccttctccacaccacacttgtaaaaaatgttacccaagttttcttttgatacttcaatgatttcttttgaaagtattagatatttggaatttattttagcatcagggtgattttgggcttcttatccaagtcccagtagctcatgagattgtctggctgtgagttatcagtcaagtctgtgttttctgactgccttgaagtcatttaatttgaaagcgaatgtg

SEQ ID NO: 11715 - DNA, 1047 bp, Homo sapiens
ttgaacccaggaggcagaggttgcagtgagctgagatcgcaccactgcactccagcctggggacagagcgagactctgcatattaaaaaaaaaacagaagggaattctgtatctattaagcaaaaactcctcatttctcccctcctgccagcctctgataacctcaaatctactttttgtctctataactttgcctattctagatatttcatatgtaagtggagtcacacaatatttgtcctttagtgtccggcttcctatatttaacataatgttttccaggctcatgcgtgttacagcatctatcagaacttcattcctttttataatattccattgtgtggatagatcacatttgtttattctttcatctgttgatagacatttgggctgtttccactttttggatactatgagtgatgctgctgtgagcattcatggccaagtatctttgaatatctgttttcagatctttagggtctatagctgtgagtggaattgctggatcgtatggtaattctatgcttaactttttgatcaactgccaaactgtttcctacagcagctgcaccattttatattttcgccagcaatctgtaagggttccaatttctccatgtattttcccagacattattttccctttaaaaaattgtagctatcctagtgagtgtgaagtggtatctcattgtggctttgatttgcatttccttaatgaataatgacgttgagaattttttatgtgcttatttgccatttgtatatcttctgtggagaaatgtctattcaagtcttttgctcattttttaattgggttgtttgtctttttgttgctaagttgtagaagtttctattctctggatagtaaacccttatcacataggaatttgaagatattttctcccattctgtgagctgtcttttcactctcttggtatagtgtcctccaatgtagcagtccccaacatttttggcaccagggactggtttcatggaagataatttttccatagacagtgatgggggattgttttgggataaaactgt

SEQ ID NO: 11716 - DNA, 1051 bp, Homo sapiens
gtcttccttttggtagagccattgttgatagatgttaagcttatgttattctcttagctgaagttaaggagattgagtgggaactgaacagtctgaagacctcaaggaatgtatgcagacctgagtagcattgttctctttcacattactggattgttgttcttgtaaaatttgttccgaaaccataaggaacctgaaatctgctacctttgactgtggaagctctcatctgcttgagaacagaaggtctcagtctgttctgcactttttactttgaaatactatttagcacatccttcatgaacccattattcgatagccttgatagatgtttgtttattataacaggtacatctcctttcacaggaaatgcaaaaaggttatttcttccttagctcccaaaatgaaggctgtcttggaaaatgggaagcagaatgccagaattccagtccaatgggtataacacagtgtggcttgtcactaagaaatttactaggatactattgaactctttgacctctactattatagctcgttgtactagttagggtaattaatgttagctgctgtaacaaataaccctctatctcagtggtttaacacagtgtaatgaggcttggatggagtttctgagccacatccaagtagctacaaacaagtccaagtagtaatcagcgatgctagccacttctgtcctatgtctatgtcatctggaaactatgcttgttgctatgccatccttgaagtttccatggaaaccctggaagatctcacaagatgttttcaaaggccaggactggatgtggcttatatcacctccacccacatttcatccgtcaggctgcagatacatggctttaagagaggcttggaaatgtatccttcctatgtacccaggaagcagaaatggcgaggtgaacatcgaggagtgtcaaacatgtttttgccattttctacacgtctgctatttgtctcttgctgtgctgtcatcaaaatgcttttcacctactacatttttttcaaggccagtctcacattctcctctgaactt

SEQ ID NO: 11717 - DNA, 1033 bp, Homo sapiens
atatggccttaaatattcagagtttagaaagagctgagccaagtcacaggagattatatgcaccaatgacaaatatggatgatgaactgctgttggttgctattgacaatgcgcaagttttacactatttttactattcccatgtcattctagaaaggagacactgataagagatggtatctgtatgcttacgtcataatgggctcaaacaaatgattcagtctgtagtttcctaagccttttgttctgacctaagagcctgctatgaagccccatggggtggaatcctccttctcttgccctgaagagctctactctagaggggcaggtccaagttcacagatcccgttattgccatatacctggttttctccactccacacaaatgtactaaaagtatcctctgctcatcctcatagacgttgttttggaagatgatacctttttgctcagctgtcacctatatagcctcaggaggatggggattcgtctaacaaattattgcccagtcttcagaggaacaaagtgaaacctgcagatcgcaagctcagagctgtattcacactttttaaggggattccaggactgttgcaagtttgggggcttgtgtcaattgaggcgatttaattaaatggctgtgatgcatttactatggcttcagtgtcaatgtttgtagtaaattttactataactccaagttgaatggagttgtccacagagctatgaccttggcatcatcccagggacatcctcaaatacatggcacattcattagcaccctttggagagatcctctgagtctgtggagttgtcacacagtcatacttcagagtacagaaaacactgaatgatttttagggagagtcttgcagggctcaccaaagatctttgtgccttggaaccatgagttagataagggaaaaatgtgaatttagaaagatgtaagttatggtaatatccaaacaaatgaacttgtttggcctgtgattgtatgacttttgcgggacagaatcagaggacatacatgattttg

SEQ ID NO: 11718 - DNA, 1030 bp, Homo sapiens
tttgtcttgaagtcaatttgtcggatataagcacagctactcctgttcttttttggcttctgttggcatggaatatctttttccatccgtttattttcagtctatatgtgtctttataggtgaaatgtgtttcttgtaggcaacacatcaatgggtctttttaaaaaatccatttagccactctgtttttttattgaagagtttaatcagtttacattcactgttattattaagtaaggacttactccttccattttgttactagttttctggttgttttgtactcttctcttccttcttgctttccttcttattttctttcttgtgaaggtgatttttttggtgatacaatttactttcttgcttttttatattttatatgtttgttacatgttttttagtttgagattaccgtgcggcttgtgaatactatcttataacccattattttaaactgataacaacttaacatggtttgcataaacaaataagcaaaaagaaaactaataaaaactctacacattaacatcatccccccacttttaaactttttgttgtttctgtttatatttttttgtactatgtcctgaagagttgttacagttattatttttgattggttcatcattaagtctctctacttaggataagagtagtttacccatcccacttatagtgttataatattctgtatttttctgtgtccttactattactagtgagttttgcaccttcaggtgattacttattgctcattaatgtccttttctttctgattgaaatactccctttagcatttcttacaggacaggcctgatgatgaaatccctcagcttttgcttgtctgggaaagtctttatttttcctttatgtttgaaggatattttggccaagatgtactattctagtgtcaaagtttttttttcctccttcagcactttaaatatgtcatgccactctcttctggcctttaaggtttttactgaaaattctgttgctagatgtattgaggctccattgtatgttattt

SEQ ID NO: 11719 - DNA, 1023 bp, Homo sapiens
tcctttcaccccaaagactgaggctaacatgttctgggaggaaaaaaacacagaaaacaagacccatcataaggaagatggctagcatctgttgaatgcttgctctgcagatacaaatgtggattatctcgtttaacctgcacaatgacaaatgtgctcttatcagccccatttcctagatgagcaaactaggcacagaggagttaacttcctcaaggcccagaacctggtaaaaggtgcagctgaggttcatactctgctttccagctttattaaggtctgcttgacaaatttaaagattgtatacatgtatggtgtatcacttagtgtttcgctgtgtgcatccattgtgcaatgatgaaatcgagctaattaacatttccatccccacacataccttttctttgtaatgagaatatttaagatccactgacttagcaactttcaagtatactagagtcaccaggctgccccataggtctccagaatgtgaccctcctaactgaaacttcggaaccattgaccagtgtttccttatttcctctcctgcagcctgccagcccctggtaaccaacctcctactctgtttctatgaacttgactttttaagaatccacatataggtaaaattatgaagtatttgtcttttctgttttgtttgtttgcttggtttttttttttttttttttttttttttgagactcgctctgttgcccgggctggagtccagtgacacgatattggctcattgtaacctccgcctcctgggttcaagcaattctcctgcctcagcctccccagtagctgggattacaggcatgtgccaccacacctggctatttttttttttttttttgtatttttgtagagacggggtttcactgtgttggccaggctggtcttgaactcctgacctcaagtgatccacccacctcggcctcccagagtgttgggatgacaagcgtgagccaccaccccagcctgcttgtgtttctttcctctcccccaggcataaccagaacg

SEQ ID NO: 11720 - DNA, 1051 bp, Homo sapiens
cccggtcccagtcccgttcccatccctacacctccggccgccgttccccgggccccgccgccccggatgccggccccgcccgccgccttcccgctcccaggcctggccgccatggcgccgcgggcgggaggcctttgtggggcgggcacgtggggcgctgggggcgcgggagcggggccgccatgggctgcggggccgcgcgagcgctcgcctccgtcctctgcctccgcaggaacgccgcgatggctgcgcagggagagccccaggtccagttcaaagtaggtaaccctgcggggcgggaggcggccgagcccgaccgcgtgcgactcgcgggtccctcctcctggggccacgatggctgtaatggggccccgcatccacattctttgttttaagtgagcctgtggtggttaaagttccgtgactctgggatcttgagaggtgaagtgtttagggtttacttccaaaatgtgtttttcaacagcttgtattggttggtgatggtggtactggaaaaacgaccttcgtgaaacgtcatttgactggtgaatttgagaagaagtatgtaggtatgtgctggaaaaccttgcttgtggaaatatgtgagaaatgggtaagttcatccactcaatcgcatcgtttccgtttcagccaccttgggtgttgaggttcatcccctagtgttccacaccaacagaggacctattaagttcaatgtatgggacacagccggccaggagaaattcggtggactgagagatggctattatatccaaggtaggcatttgtaacttgctgaacggtttttgagaggttttgtgtacttcagtcttcaaggttatagaaaatcaggtctgttccaacaaatagtgtcatttttgggttaaaaaaagacaagtggacttcggggagttgaccaccattttggtggcagagaaaattttattaaagttgtgtcatttgcatgctgtgtcatgctaggcatgctttagaaaaaactatgacttacactgggacttataagtcatatttaaaacaataataggctgtt

SEQ ID NO: 11721 - DNA, 1010 bp, Homo sapiens
gcctgctctcgccccaccagaagttgtcatggacccagctttggcagcacagtatgagcacgacttagaggtattgtggccactttgctgttcagattgttcggtttggcttgtttattcctggcagttttgatctggagtgttaacgtttttccatctcttcgtctaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggat

SEQ ID NO: 11722 - DNA, 1704 bp, Homo sapiens
tggatgggggaccacaagatcctcatcgacaggtcggttcctctccccacccgtcgatccttcccttccctcacccgcttgatctcgtctgatgttgacttgactgcaaggactgcagagagttttctggagccagcggggatctgggggacaccccctcccctgtccccacctcctcctggtgttctggtggggagggggacggtgaaacctgccctaaggcactggctggaattgcgtgccgcgtccgtctccggagggatcgtctctggtcccgcagcccctctcgacccctcaccctgtcgctgggctgcagttggcgattccgcgcggtgaaagcagccagtgcccagggtcttttcctgagtgcacctgggcctgccgcccggcgatgccatggggtcgtgcgctgcttttctacttgccgcgctctcactgctcggtgtactgggagggtaccctgggaggcgtgcctttattcttccgaaccgccgctcactgagacagtggctagaagtgtctcttggacctgtgagttagccttaacctgttatgcccccagagccctcagtggagcgcccgtactttgccggcatgacgtttgatttcccggtgataatccgacgagtttgacagattgaggtagtgagcaaagttgcccgtcagttggtggccacttgacttcgtgcggaccctggccttgctcttggaagagatagtgttcttagggctggtttcactgtctcttaagactgaagggtggagctgggatatagatgtgttgtttcttttcaaatcaaacctgctttaggtcgtcactcgagggtgtctagcgattatgggcagtgggggcctgggattagggatttctaaaggcgtttgatttgaaaaggataacattacatgatgtaggtggtttgctcccctctttcttcccattttttcaatcccccttcccctcgtctctgggttttggggttgttgtggggtggttttttttcttttttgcctgttcggctacttctggggcccggactgaaaagctaaccatgaccaaccattaaactgtggaatagtctctccacgtgaagaaagcccatcgtttgagaccattaaaactggattcttcatagccctggagcatgactgtagggatgacctctgagctggccagaatggacacattaatgaccaaataggcctttttccatccctgacgtttccttttggaattagagctcgaaaacgagaactggtgaagggagggccgcggaatcagatcatgtctggatctgatggctccgtgctgtgctcaagcgtgctgtgccttcacaccatggtttatattgaatgtgtcgcctgagttgtcaggcttgcttttccaaagtgtcacttgtgttatttatcattaaagtttggtaagcaatgaagtctgagctctttgtacagttttcctatcattctgtacatgatttgagttaggtcttccaaaactggtggggagcaaacgccgcacatgtacatgtataatatttttaataataatctacatttgtaagttaaggaggtttacatcaaaatccaattaattttgaaatttaatgaaatgcagtaacttgactaccttggaattttgggcctttttcctgtaaatgtcttttttggtctacattaatatttttggttcccattacaaaagtcagc

SEQ ID NO: 11723 - DNA, 1246 bp, Homo sapiens
atcttgatagttatgcccaggtggtttacaattcaaagatgaaaatcagttatctaggaattgactaccttatgtagtgtcatgctgtcaggaatccacagaaatagttggagagaaatcttagcgataccaattaaatacatacatacctgaaagagcagcggaggggaaaaggaacatggattgagcacctgctaagtgtggaggattatggtagagatgttcacatgggctatctcacctaagccccacttggccctgggagtggatgtgatgacttcacaaccagtgaggaaacagagaacagcagaatcccggagctaacaagcggcagggcaggagtttaactacagttaacccttgaacaacacaggtttgaattgcgtaggtccgcttgtatgaggatttttttcagccaaacactgatcagattgagggatgtgagacccgcatatatggagggtcagcttctttatatatgtgggttcaaatggaccaaatgcagaattcgagcacgtgtggatattggtgtctgcaagggtcctagaaccagtcccctgcgtataccaagggaataccgtgcagtctgaccctatacacactccttctgctgcaccccacctccccccaccaccccacctcatttggaattttgtaaagtgagtttcacttgcgttgtgggtagaagagaaagctgaagatggcttctaggagtaacaacagaaggtaaagaagcagggacagccagtcacatgcttccatcttgctgcctgctgttagcaggtgccttcctccctgcattgttctgaattttttaattttctttttatgcagaaaaaaatgaggccgaaaatttagaggaaaatgaagagcccttcgttgcccccttaggattgagcgtcccgtctgacgtggagttggtatgtgtcctgcatgagcactagttgtcgtcattattatttatcataattcactcctgcttgtgggaaagctcaataatgattatagctgctttttaggcatataatgctttaaaatggtttgtgagttaatggagaaaaagatcacaccctatttattttccccaaaggaaaagggaagaattatagcaaaagagctagactggagcatcagggacttgaggagttgggtgtgattcagcggccatgtagttgaatccccagattttactagcttagaaaaactaaatcaggatcagtggcgagtgggctgctccccacacata

SEQ ID NO: 11724 - DNA, 1043 bp, Homo sapiens
tggaaaacatcacataagagcctcactttcacccagtatcagaatcacttccagatgtaaatgccagttgtggaaattcttaggaaagtaaggatgcttcagcagaatgaagaatcatctattttcagccagcagttatattcaattaattttttaaaaaatgaggggaaaaaaaaagcctgtatgtctaaacagcttttacaatcaaataggaaaaaattctgatagtctagtagaaaaaagatctgcagtgcgaataattcagaggcaaaaatgcccatacggtttttaaagactcaccctcactgcctgctcacaggcatcgtgtccgccgaccgtagaacctgaaatccgtagtaaacacccctccagcgctttggttcagctcagctccagcgaatgttaggatgtgaggcttcgtgttacagtagaaaggagcgcactcataggcatacagaacactgtgcaggtctaagacttaggagaagacggagatttctaggctgttggaatgttattttgtatatgcgagtttgggtagcttaataatagagattaaataaaagaaatgcagacaaaacctacaatggagtgccatttttcagctgtcactcaagcagagaaaaggtgacagacgtttattgtcggtgggggtgtagatttgtgccagcgatgtggtacttgtggagggccagcgggcagtctatcagtctaaaacacacgtgcctccaacccaggatgtctgctctcatttactagtatatgggtgaacatagccacatagatactcatcatagtacagttttagtagtagcaaaagactgaggcgacgcacatcctcggtggaggactaatggagtccctctggtgtgctctcgcggtgggctgcagagctctgggggtgggccagggcccgagcgctgcagggccacccaccggaatggctcttcctgagggtggaggcgaggtgactcaaggggagggcagcacgaggcagtctgttcacgtcagaaggggagggaagtgtctgtagtgcttctgta

SEQ ID NO: 11725 - DNA, 1438 bp, Homo sapiens
tgccaccagtgtttttgccaaaacataagaagtcacctttgcctcagttcccaacaagttcctcatctccatctaagaccacctcagcctggaccttattgttcctgtcactatcagcattttgggcaaagccattcagcaaatctctgggaagttccaaactttccctaattttcctgtcttcttttgagccctccaaactgttctaacctctgcctgttacccagttccaaagtcacttccacattctggggttatcttttcagcagtaccccaattctggtaccaaattactggattagtccattttcacactgctgataaagacatacctgagactggagagaaaaagaggtttaatggacttaacagttccacatggctggggaggcctcacaatcatggcagaaggcaaggaggagcaaagtcatgtcttacatggatggcagcaggcaaagagaggctgtacagagaagctcctgtttttgaaactatcagatcttgtgggactcattcattaacatgagaacagcgcaggaaagacccacccccataattctgtcacctcctaccaggctcctcccacaacacatgggaattgtgctagttactaatcaagatgagatgtgggtggggacacagccaaaccataccagttttatctcagttggaaaatacttggacacaatgtgtgatgagccaaataataaatgcttttaagtatttgggaggatgggaaggaagatcatattttcttaaaaactttgggcttacatcttaaggagtttttggtttgttttaccatttttattcttgcaatatgagatttatgttatagagagctagtagataaccaccctgcctaaaacgaacaattgccagaagggatcttttaggaattcttgaaaattatctgagttcaggagatgaagtcagaagtcatgagaatggagataattgagtggaaaagagaaacttgcagaaggagaaagagtttctccgccctgatttctctcattcacttctagaggaccttgaaggtttctaacatcccctgggtgtattaggcactttcctcattcttgagaatgcagaattcagtaataaaaacaattattcttgaatcgtgttgtcagtgcctgacatttacatgcatagaatgtggacctctcctggggtgcaggtcttcactgtgaataaggcagcactctaactataggcagagtaagattctcaaatcaggcaggctggcacagtctgaaggacctaaaaatacctgtttcagggatctgcatcttcagatggtaatgaaacttttagtaaggctttttttttttttggcaaaaaaaaaaaggtagtattgtagaattttacattaaatagtggaattgccatgaaaacaatttattctgacattgatccagcagccgaataagcc

SEQ ID NO: 11726 - DNA, 1032 bp, Homo sapiens
caccaatctcctctctaagaaccttctcagcacaggagttctgttctgtgtgttaaattcacacgagattaagatcatgcagagatacgagagaactggctctgatttttgcaagaagccagttgaatagagggccttgggagataattaggcagatttctctgacctatgttaagtagctctgcacgtttcagaggaggcagtattggagaaggacttacaaatgtgcttcctgcttttaagcagcttggttctcgtcatacaactatacttgcctttagggactgtgtaggtacctattggaatttctttcttggatttatttggagtaggctttcgtagtactcatagcgtttattagagtaacattacgtcagcatttaacttagtttaaaacgtagtcccctttgggaaattcaatataaaatcctaagaacagcaacaaacctaacaagatatatgtggtcccagcttactgagggttcaactcgatgatggtgcacatgcaatttgcattcagtagaacatcagtaaaatgcttgagatactaaaaactttattataaaataggcttcgtgttagatgatgtcatccagccgtcagctactgtaggtgccctgagcacatttaaggcaggtgaggctgtgccatggtgttcggtgggttataggtggattctgtgcattttccacttcacggtgttgtcagtgtatggtggggttgtcgggaagtagcctcgctataagcccaggagaatcccggcatgtcgtggcagcctgaggacagcaggagccccttggcacactgtgccctcccccgttcatgactagtaatggcacagttattgtaaagctgatgtggcttttgccagcccagacttcagtttgtagactacagcccagcttgtagattttatttctgttgtcaccctgtactagtccagaaattcttaaaatttagtgttcacgagaattgctgtgtacaacatacaaggggctgtatacaaaatccctgtgtcctatagttggtagt

SEQ ID NO: 11727 - DNA, 1046 bp, Homo sapiens
atgcagtgaagctgcagttgtttgcaaaacatgcaggttcataaagttgacgcaggtgatgttggggtgcttcatgagtctctcccaagctgttggccaccaggggaccctggcagctactttagttaacctgtgaagccatcggcagagccctagcttctccagcagcgagggcccccagtgttcaggggacgagtatgagacaggcgctttaccagtgggcctggaatgccctgccttgaaaggagactcctgggaaatggaatgaaacacgcgagtttctgtgaaaacgactctttctggtcatgctgagcaagtcagacaggaaatgaaggaggttgaaccatgcttgccgacttgttttcaatataacaacaacaacaacaaactgcttattctttgttatttctaagaattagcttgtgattggggggaaatgttaattagtaggaaaaatgcaccttttatcactaaaatccccatttttcactcttgacaacaatcctgtctagttgactttagtttctgtcgtgtgcatcaccttcaacaagagcctcccctaacacactgtttataactcacatgtctctccgggcatctgaggcggtgaggacccccgagcagccaggactgagcttggcgagcccctgaagcccaggggtctcacagactcttctcctgcagtgcacttgcccccgtggccgccatcatccccccgccccccgacgtccagcccgtgattgacaagctggccgagtatgtcgccaggaacggcctgaagttcgagaccagtgttcgtgccaagaatgatcaaaggtcagaagaagaattttatatgttaggtatatggcatttgggggtttcgtttagcctttttttaaaaaaatgtaggtacagaattaatttttttatatatttttaagccttttcttggctcaaatgtcttttttttttttttttttttttttgagatggagtcttgctctgtcacccaggctggagtgcagtggcgcgatcttgattgactgtaacctctacctcctggg

SEQ ID NO: 11728 - DNA, 1034 bp, Homo sapiens
ttttaaaatttctgtataatttcctgctgacagtttatagtgacatttaatctctaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaaggtatgctgccacttgcatgttggccttgcacattccaccataagttggcaagcgtaggatcctcggtgacctcagactcagcgccctcacctgcaggctggggtggggttggcggccccctggaggttgctgtggtgaaacctctgccttccatgctgtgtcatgcttgcctcgcgtggcattggaggtaacgtgagtgtgagcagcccttaggtatgtgtctgtttaacagtctgttcagtgtactggacatttgtacagaaagtttcaaataatcctttgtactccctgggacttctgaaactatttatatgcaaactgttgtaccagtgaaattcatttattaatttgtcaaagcagattccttgagaatctctaccaggcaatacttcactcactcgatttcagttactttgttatgttcttggagcaagactttgatgtcacaggacagacaggcatgtaaaaatacaaagtcagtgtaattaaaaagcagacagaagcaaaggccagagcaggcccttagccaggaacctcgtggagcagcagtgggctccccccgcgggagggaggttctgtggagtagaggcgttcagctggtgttgcgagaggaacgggaagctctgaggcaggggtgcagccctaggcaggagccccgtggtgcgagctgcccggccccgtgttgagatgcggtaggtggtcagcagtgacttcgggggtggctggtgaaggagccttggccagcttgccccggtgcaccctgtcggggaggggccagcacatctgacaggctttaggtcagcgg

SEQ ID NO: 11729 - DNA, 1072 bp, Homo sapiens
ttaattatattgacgtttctaagagtccagggccattattgaaaactgattttctgcttgaagtcacttcgcttatttttctgtggaaaacaacattctaagctcagacttttcaaatgatgctgaaggctgaatcagctttcttgttttgggagtcagtctgaaatcctctcacatctggcaggaggcctcagaaataataactgacgggcaaggaggggagaattagaagagcagagaagatgagtttgtgtgagaccctgtcgagtccccgagtgccgcagggtgggctcctgccctgagtcccgagtgctctggccacccgctgtagcctcagctcctctgagccatttgacatgccagccccagaaacgaacattttcaggcaaggtgggaacccccagcagccccccgggacgccgtctcacagcctttccacagctcttcagagtcggggctgcctcctggctcctcacttcagccagttatggccgaaggatctgtggtcattccttagctttaataggatttcttggctggacgtggtggctcatacctgtaatccgaacactttgggaggccaaggcgggtggatcgcttgaggccaggagttcgagatcagtctggggtcaacatggtgaaacctcgtctctactaaaaatacaaaaaattagccgagcgtggtggagcatgcctgtaatcccagctactcgggaggctgaggcaggagaatctcttgaacctggcaggcagaggttgcagtgagccaagactgcaccactgtactccagcctgggcgacagagcgagactccttctcaaaaaaaaaaaggatgttctgcagcaataaggggatgaaatacacaacaacaaaaatgatcatgaggacgcttgtagccacacagaaaatgcttctgatgtaataagcaggagaagcacagtataaaatatatccacttctgtggttacagccatgaaaatatgcatgtagcaaggagggaagggaatttaagaaagtaagggacctgttacagtggcgtacgggttctcatgttttgatatcgtttgtgcag

SEQ ID NO: 11730 - DNA, 1039 bp, Homo sapiens
gctgctgtgtgacggtgactacggcccaggctggagctcccaggagaggccacagagtcctgttggggcctagagggcagggagcatccatcgcttacctcttgaccactaaggagagcctgtcttggttggagcaggagatggagggaggttagcattcatgttcatcaagtagaagccccagccgtggtgcctggcagggcctctgacagcccagggtgccacgggctcacccctcactcagtgcctggcactcagtagaggttccacctttcacttcaggaaataggtccaccatctgtccgctcaccccggcttccagtagctgtggacggccacctccattggtgccgccagtgagcactaccctctcggccgtgggggtgccatctcacgagcgcctcctctggttctcacccactgatgtcaccacccagtgccttgcgtggggcagccgtgcatttccactctttccaagcacaaggagcttgttttgtgtccccatgtggagttcgtgcagcctcctggctgtgtgggtggaccgtgtctgcgtctggagctacacagagaaggatggagcattgcacatcgtagccttgagcttcataacacggcactgctaagtgcatgggggtcaggacactcagggtcccagagccttccagaggacgagccttacattgccaggatcacccacacactgggaccctcctgctcctgggacggatggtcccagccatcacccacactgcctagccacaaggcacacactaggcagagagccacagcaggtcctccccacagcaccctgggcaagaagaccgtgctgcggttggcctagtaccacggttccctccgttgacaagatgtgatttttttcttaaaacagaaaaattagcaaaggaactataaagcggatagataccagcaatgtttcatgtacacctggctctgtttataaattacattttgttccttagtaatcctacactgagcattcatgtctgctctcatacaatctgatgaaaattaaaatgtt

SEQ ID NO: 11731 - DNA, 1711 bp, Homo sapiens
caggggccaggaacttccaggcccgccgtctccactgggacgggaccttgatgcccacagcgtggtgagactttggggggtgtcacttctggaggtcttgaaatgacagcattatgcacccccagcctcctgcaggcgctcgcagctcggctgggtgcatccttgattgtacgggtgccgtggcccatgtgcatcctgcctcgccccgactcagtttccccaattgtaaaatgagagacttggtcttcaggcctcgtagtcaggtgtcagcctccagaagcagcacctggtcccggacaacctgcctggaagtgtggtgcactcaggtggtaccacgggcaaagactccctgcttgggctctgaagagctccctctgcctctgaggtggtgcccccttttcgtttattttttgttgtttttttttaagagagggtcttgcactgttgcccaggctgaagtgtagtgtagccgctaactcctgggctgaaatgatcctcttgcctcagcttcccaagatgctgggtattacaggcaaaaactcatgagtgcctgagtctccttttttaagaaaatttaagcatgtagtaaaaatccagtctgaacaaacatgggaaaagtcagcctccctcctgccccccttcccgcccaggcaggccaggcagcagcagtaatgacactgactgagcggcgggcactctgttgtcctggggccgggctgagagcgctggccagggtcatctggttccaggcagtgtctccccttggccctgtgaccatcccctctgcacagcaggctgcaccagcacttatgtctccacgtcactgccctgagcgcctatctgccacccctgggccgctgccgtgggtgcagggcagcccttgctgggagggagtggggtgagctggccctgtccagcctctgtcctcgcccccaggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgtgagtgcccggctgggctgggggctggggactctgggcgtctccctcacactcccctctccctccacaggcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggaaggtcagcaggcactgtgcccaggaagagcctgcggcctcggcgtcccccagtctccaggagcctctccctccgagatacccacccagctttgtcaatcacccaagcactttatgcatatagagacagaacctggacctcacca

SEQ ID NO: 11732 - DNA, 1033 bp, Homo sapiens
gggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtaggggcacagtcccagcagtgctcagcagaacacaggcccacattgttcccattgtacagaggagtgagctgaggcacagagaagtgtgtcacttccccgcaaggccacacagctgctgcaggagcaggggcaggcggtcttgagatgttccttgtctgcatgcctgcgccacccacttgctcccccacggggtgcttttcgaccctgggagggctgtcccagggtcaggcttgctgccagcacacctactatggacctggcatggagcataatcagcagctagacagctgcggaatgtagcttagaaccggaacatacaggattgtaggtgcagaagctaaaagctaagtgaatgaaaatgtcattctcagttcttcgctctggggtgagagatgtccccaaagcccgagtttgttctttcttttttttttgttgtt

SEQ ID NO: 11733 - DNA, 1056 bp, Homo sapiens
cttggcctcccaaagtgctgggattacagtcgtgagccactgcgtccggccagcctgagttctttcatggtggcccagtgaggtttcaaagggtgacattcccaggcagggctcagggagattcttcctgtcatctagatatctgtgaaaagagagtccttcctgcatacctgggtggcagattcaactgtgtgcaggccccagggaggtaaggtgggcaggcgaggggccaggcacctggcgagccgtcctatagatggggcgatgagaggcccccagcccagggacggcagggagttggggggccagcggtggccaggagcctcgtttcatctgaagggggtactcgtggctcagtggcagctggtggtggccatgttggaatgtgacagtgaccgtatgcttaaatgttatcaagggaaaccagcgttgcatactggtatgggaaatctcttttttaagtgctggtagttaatttttcccaagcccggtgcaggctaaatacagcgcaggtgctgatttggcctgggccagactggactgctgtggactccactgatgagaggcatatatacttccgaggcacctgcatttgttgagtttccaaatggccccattttattttcccctgtggtcagtgcgacctgtgaggatgtgaaggagcccaacaaaggcccctctagtgtccccagcccttggctttccctgcacaggttcctgacctggttaagagaatgaccgagaacaaacaccagactctgctcctgatgagggagtggtgggggcaaggctcctgtgccaagcctgtcatgggcccctgtgggcatccaggagcagtggagagagtgcttgcctcttattctccatgtggtcttcttctgcaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgt

SEQ ID NO: 11734 - DNA, 1040 bp, Homo sapiens
gaggggcatgctcttgggtgtctctgtggccttgctcttcccttaagatctgtttgttgcagcctgcgtgctgtcttctgactccatcttcagaaactaaccatctgatcaaagcatgcctttctgctgctagtttaaatatgcactttttaaatgtttgttaggaatatgcttgtgcatttataaattctgtagtctttgatttcatatatacatgtatttcagccaggtacccaagacttagaagagccttatacgttttgtaacttctttttttggagatggaatcttgttcttcattgcagcatcgatttcctgggctcaggcggtctcctttggcctcctgagtagctgagactaaggctgctacattgccaccatggctggctaatttttgtatttttcttgtagagatggggtctcactatgttgcctaggctggtcttgtacacctgacctcaagtgatcctcctgtctcagcctccccaggtgctggcattacaggtgtgagccaccatgcctggccattttttatcttctgtagattcatggtttttaaaaatccgttgtccattttctcacagagataagcagtgatgtccttgcgatgaacaaggggtcttgtttgtcttggagtaagcaagaagaagctccctgatagctgtccagccagggttgaggtgaaggcacctcaagaagacaggggcacctgggtgtgtccagcaggactggagaagtctgaatggtggcacccaggtcaagctggcttctgtggcaggcctaagtgtgaactggaacattgcggagtggtgtggctcctcacccactggctcagtgctaaactgtgccaccaagagtccatctgcttcccttgaaaacttgaatgagatttttgctcctttatgacagaagttagctattaaatagattgaagcagcagctgcccccttgatgtgggacagtgtccaacctctcctcttggaacgctggcactgatttgggtgccaggtgccactcaccattgcgtttgcacccttgct

SEQ ID NO: 11735 - DNA, 1033 bp, Homo sapiens
ccatttgaggttctgttggtgggtatgtgaagtgtctaaacttttggaaagcagtttgacaatttaaagcaaaagctttaaaaatgtgaattatcgcagcccaataatttctataactggtgcagcattcatgaaatgagatgccgacccatgtttattgaatggagagatgttaatcatctattaaatgggaaaagaagattatagcacaatgtggtattctagttttgaggaaaataatgtgtatttggtgaaaagtataaaaacactttctagaaaagtcaagctaaatattgatggtggtttttgcttatagtcatgtttctcctaatccaccctaagagcatacgaggatgtatatgacagtgaattgtatgtaattttagtctgagaagatttaaaaaaagttacatatccttttttttccagcatgacatagagtacaacatacaattcttgcacttttattcaccagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggcgagtgctgccgttgtcatggggtcgtaagaatcagtctgtcggagctggtgaggccacttcccgagaccagagctcgggcaccttgcttaggaagctttcgagcaccagagtcagcaacgtgtgcactctcctgggctgttgcttgttggcctttgaatgagctgctcgtgcctccgtctgtcttgcacaggggatgcacctcagctgtggctgccctctgaggtgcttcatgccgtggaggggctctgggcattgtttcagggttagcgtgagtcaccaccacggttacttctagagcggtcgctcgctcacttgctttccttttttgaaattttaattcttacctcaccacctaatagaacctgggcaggatgtagttagtatgaaataaatgaaaaagcaccaaactgacga

SEQ ID NO: 11736 - DNA, 1077 bp, Homo sapiens
acagcattccgtatgttggcctgaagaaggtctgccatgtgtggaaaaaccagggctgtcattcacagcctgaagtggaaggggaaatacacttccagtttcctgcccatttaattaaatttaacctgagaagtttaaaagctcagtttcaatttctgtaatagctatgcaaaataatttcgaagccttatagtgtgtaatgagtaacagacactcaagtggtgttgcctctcagtgacacttgctgataaccattttagtggacgatgaagaggaaacaattgaagaggaggaagcaaatgaaggcgttgtggaccaccaaacagaactttctaatttagccaaggaaggtaggctgttgctaccttattaaacattcagtaagtaaaaagaaacatttaaaacatgtgagatgtgaataataatatattgagtaacaacagcagcagtgcctgttttatggaaaacagtccctgtgtgcctcctgctgctctctctcctgacctggaggtcctggccctcctgggttgtgtgtcggacactgccctgactgtctttcttccctgccacctgcgtgtgtctccctgaatgtaccgttcatcttgagtgtgtgagaacttcatatgaatgaatccaccacagcttgactgaatgtgccgttcatcctgagtgtgtgagaacttcatgtgaatgaatcccaccacagcttgactgaatgtaccgttcatcttgagtgtgtgagaacttcataccaacgaatcccaccacagcttgactgaatgtaccgttcatcctgagtgtgtgagaacttcatgtgaatgaatccaccacagcttgactgaatgtaccgttcatcttgagtgtgtgagaacttcatgtgaatgaatcccaccacagcttgactgaatgtaccgttcatcttgagtgtgtgagaacttcatgtgaatgaatcccaccacagcttgactgaatgtaccgttcatcctgagtgtgtgagaacttcacgtgaatgaatccaccacagcttgactgaatgtgccgttcatcctgagtgtgtgagaacttcacgtgaatgaa

SEQ ID NO: 11737 - DNA, 1068 bp, Homo sapiens
gggattataggcaccagccaccatgcctggctattttttatatttttagtagagatagggttttaccgtgttgcccaggctggtctccaactcctgacctcaggtgatctgcccacctgagcctcccaaagtgctggggttacaggctgagccaccgtgcctggccctcatacattaaattgaggaatatgactttttcttttcttcatagtcaattatgatagtcaaattttctaggaatttctttatttcatctacattttaaaatttattggcatacattgtcaataatttctccttacagtgtttccgatcttggctgtgtttgtatgtatgtcccttctttctcctaatactgtgtatttatgcctgttttcttgatagtcttgtcaaaagtttgtcagattctttttttttttttttaatctggcgcctgtatattgttttctgttttgtttctgctcgtagtatttcttttttaaaaacatctttttctgagtttttaacttggatgactagcttcctaattttcatcagctcattaatataaacatttaagggtctgaatttttccgtaatactgctttagctgaatatcatatttattattcagttttaaatattttctgatttcccctgtatatatattttattgacccatgagttatttagaaggatgtttcttaatttccaaacaatacagggttttcaatatatatttttattattattctacattaattgcattttgatcagacagaagatgtatgggattctcactgacctggattttgttgaggtaggttttgaatggaccagtttataaacattccatacatgctttaaaacaacatgcattcatcaggttatggtacaattctctctctcagtccaccaggtagaacttgttgattgcattatccagttcttatccttactgatttttgtcttcttgctctatcaattactgagagaagtatgttaaaatgttccattatgataatgagtacctatttctccttaagtttctgtcagttttcattttatgtattttgagactatgttagt

SEQ ID NO: 11738 - DNA, 1135 bp, Homo sapiens
agcctctcattgggtcaaggcttcttcatggtcttcaggaacctcttagagctttcttcacagagatgtggaatttttgaaagtttaattctaagtatatttagctcttcatgtccatgggtttcaaatccatgaatttgatcaactacagatagaaaatatttaccaaaaacaaaacaaagcaaaacagtaaaaaataagaacacagctgggtgtggtggctcacacctgtaatcctggctgcttgggagactgaggcaggatggtcacttgagcccaggagttcaagttcagcctgggcaacatagcaagaccccatctctaaaagaaatattaaaaaaaaaaaaaacagccaaccaaaaaaaccccccaaaccaaataagccaaaataacagtacaacaattacaaaaaagataccaaaaaaatgtgtaacaactatttacatagcattcacattgtattaggtattataagtaacctagagattatttaaaatatatgagaggatgtgtataggttacgtgcaaatatacattactttatataagggacttgagcatccttggattttggtatcgaaaggggccttggaaccaccttctcagggatactgagggacgactgtatttaattttctgtctaaacaggtttttttttcttcgatttcattttctaactcatttccatatgtggaggctgatttctgtgtattgtttgttctgagacaccttacagaattatcttcttactggaagtttccagtggtttggcttgtttttcctacttacatatagcatcatatgctgtagtggtgcatcccagcatttcgctctggaagcatcagacagacaggaaaggtgaagaaccttgttaggaacatcatggacacaccacctgaattccacagccaacacttactttcactgggctccattaggtctatgtccatcaagccagtgtggcaaatatttaacatcctgagcaaatgaattcaaaaagtgttttgctagtcccaagtggacagtgcctttaacatggtccttgtagggtgcttgtccatggcatttgttgttttggctcaacagtctttgacataaaatacagatgcaaacaagctcacatatcacaagtaca

SEQ ID NO: 11739 - DNA, 1127 bp, Homo sapiens
cagaaaggtatttctctattcgtgacacatttgttactgtttggaaggatttcattccagtgtcatctaagttcagtgagttcagcaaatcgttgtgcacttagcgtgttcaggcatcagctggacgtggcagtgcgcagaacctgcaggagagaggtgcttttcctgccgtgggctagggtatgcataggacggcccctgccctgtctctgtgttacagggattgtccttgctggccctcagtggggaaagacgctgacagatgtgatgagtgtgccagggccatgtggccaaccacaaggggctttcttcctcacaccccacctctcaggcactgattttgttcgccatatcttaagaacacaccacatttaggggtgtgtgtacctgccctgaagttatacaggggaaaagaggaatgaatgaatggatgggtacagaagtgggtagatgcaagaaagtaaatggggtaatggatggtggaaccccagtgtggaaccttactgccaggcacatgggtgtctgtagcgtttctgactgtcggactctttccataaaatgttggaaaggaggtctgctgggatgaaatgatgtgcatctggtttaggcactgttgtctgtaggctccaaccctacagggtcggtgggtttctccccgtgtgcggagacgagagagcgtagaaataaagacacaagacagagataaaagacagctgggactgggggaccactactaccaagacatggagaccagtagtggccccaaatgccaggctgcactgatatttattggatacaagactcaggcaggacaaggagtgtgagccatctccagtgataggtaaggccacgtggatcacatggccactggacagggggcccttccctgcctggcagccgaggtagagagagaaggagagaaacatcttacattattatttctgcttatcggagacttttagtactttcactaatttgctgctgctaactaaacggcagagccaggtgtacaagatggaacatgaaggcagactaggagtgtgaccactgaagcacagcatcacagggagacggttaggcctccggataactgcgggcgggcctgactaatgtcaggccctccacaa

SEQ ID NO: 11740 - DNA, 1032 bp, Homo sapiens
tgggtcgggggtgtgggggtgtggatgtcttctgcagagccctgctgcccacggctcctggcctgtgcacccctctgcacttgctcctctgcacctgtgcccctaccagcgctgctcacagtctcccttcctgctcagcttttctgctctctgtttctgtattatcaccttcaacaaatactataagtactttgttcaggtgattttgtctcctccaataaagcaagccccatgagtacaggtgtgtccgagggctgttagtacagtggacagatggactgttgtagtgggttatagtcattgaatcttgtgatgttcaatcattgtgttctggggtgactcactgggtcctgtggtagttgtcattgtgcatggatgagttcaattactgctcttgtgtgtgtgacctcacggcatcggggcagctcagcctcgttcgtgcgctctgcctgccttgtcaggtctgtttctgagacgcgctcctgcttgtgttgcccagggtggcctcgaactcctgaactcaagcagttctccctcctcagcctccggagggcccgggaccgcaggtgtgtgccacgatgccgggcttttgccagggtttttacttcctttcctttcttttattttgctattcattttctaacttgttaagatggagtaccacctgagcttatttcacaaattttattatttggttttccttcagtcctaaatgtttttgaatttccattttgatttcttatttactgcctgggttctttttagaagtgtttcttaatttccaggtgaggttttccagttactttttattattgacttaaaaataaatcttcattgtattgtcagagaatgaggtctcaatgatttcagtctttgaaatttgttgaaacttgctatctagtccagaatacagtcagttttaaaaaatggtctgtgtccttccagagcagtcttcaggatgggttcacttgtgagatgattttgttgtaactgggtcaagtttactgtgtgtgtcatttcggtcttctgtgt

SEQ ID NO: 11741 - DNA, 1033 bp, Homo sapiens
aggctgaggcgggcagatcacctgaggtcgggagttcgagaccagcctgaccaacatggagaaacccgtctctactaaaaatacaaaaaaaatcagccaggtgtggtggtgcttgcctgtaatcccagctacttgggaggttgaagcaggagaatcgcttgaacccaggaggcggaggttgtggtaagctgagatcacaccactgcactccagcctgggcaacaagatcgaaactccgtctcaaaaaatatatatattacttataaaagtctgtacttcatgttcagtcacagtagagacaagtagaaactccctccttcaacaatacctagcactcaaggagagatggccttacagagtcagcatgtggtgcagaggtctcttggccatgattttaggtcctcctgggtccacatcgtcccacctggccatggatacgttgtcatctgatctgttcactgttaaggtaacagttgtcataactactacaaaatggttaagtgttaggactttaatgatggtgatcatgtaataaagggcctggaggataatggcatgcttacgaattttctgggtggtattcacatgtttgaaaaagcattgaaatgtatgattttgggtgatgactctgagaagtatggagcatgacccattttgaataggagaacagaatgttgtaaagtgattcttggtcccctaagagtccattgacaaccaccatgtagaggaaaaatggcaaagaatgggctctctccaaagtcaggtgctgaggcccttctaaggaggaaaagccaacgccctttcactgtggtttccagctgctacaggaacaaatagtgtctatctgtgtccagcttattttttgacttctttgagtctgaagatactttgaaaaactttgatttgccagagtaattttttgtaccttggaatgagccatatttttaatttgctttttgatgttacaaaatgtaccctcataagaattcaaacaatacagaaaaataagtccttttcagtccttttgtgctgt

SEQ ID NO: 11742 - DNA, 1029 bp, Homo sapiens
accgagtctcgctctgtcacccaggctagagtgcagtggcgtgatttcagctcactgcaacctccccctcccaggttcaagtgattcttctgcctcagcctcccgagtagctgggactacaggcatgtgccacgacgcccgactaatttttgtgcttttagtagagacagggtttcaccatgttggccacgctggtctggaactcctgacctcatgatctgcccacctcagcctctcaaagtgctgggattacaggcgtgagccaccgtgcctggccaagtacaaagttttataacaagcatattacttattttgttgcgttgtattccattctttatttttgtccgatttgatcaatcaggttttgaaagaggtgttttacagtcgttcattctaagtgggtttttttctttttttttttggttttggtttcaaaatcaggttgtcctaggaaattttgttttcatgcatttggttgctataatgttggtttataaagatttatgtatgtcatgtataatttgtgagtttaaactttttaaaattgtattagtgtattttagagacagggtcttgctccgtcacccaggctggagtgcagtggcatgatcatagcttacagcagtctccagctcccaggctcaagtgatcttcctgcctcagcctcccaagtatctgggaccacaggtgccatcacatgccctgccgagttgcagctttaatcgggacataaggcttctttttgtcctgttctatgtgtttgccatgaattttgttttgcttaatgttgactgtactactgtggctctcggagagagggggcagttgaaaatcttgccaggtgtccttgggactgggtgtgcctggctggacgcagagctgcttgagaggggctgactgtggccggcgcttctgggcctgagtgtgtcctctccagctcccctgtgcccacctttgtttcacgcagaaccttcctcagcgggttccacagctgaggctggccgcctccaaacggggtccccgccagtt

SEQ ID NO: 11743 - DNA, 1890 bp, Homo sapiens
ccgtgtagggatagatcgtaatttttttatccattcacctgtcagtggacattcgggttgtttccagtttttgactctcacatataagcctaggaggaacacgcacttacaagactttgtgtggacacatgctggctcttttcctaggtaagtacctaggagtggaacggctggattgtatggcaggtgtttacctttttaagaaattgccaaactgtttcccaaagtgtgtggaccattttatattccccctagtagtatatgaataggttccagtttctccacatccttagcagccagcacttggtatgatcggtctttagccatcttaggaaggcctgtaggagcatctcactgtggttttaattgcattcccctaatcactaatgaagttgagcatcttttcatgtgcttattttctatccatttttctttgacagtgtttgttgacatcttttgcctggtgaaataaaaaaaaaaaaacctgagttggagaattctagatagaagttctgtatcagatatgtgatttgaaaatattttctagtctgtggttatcttaacagtgtcttttcaggagcagaagttttaattttcatgaagcctaatttaccagtttcttcttgtatgaatcatgctattgtatctgaaaagtctttgcctaacccagaattacaaagatcacacacaaagatgttttttctatatttccttctaggaagtttctggttttagatttcacatttaggtctacaatccattttgaaatttttttggtctgttgtacaaataatggatgagagttcatttttttgcatatggatgtccagctgtttcagcatcatttttgaacacattatcctttctccactttatgatcttcgcctctgttgaaaatttattaaccatgtatatgtgaatctatttctggcattctgtaagattgttccatttccacgctgtcttaattgctgtggctttataatacacgttaaagtcaggaaatctaaatctttttgtctttttcataattttggctcttctaggttctttgcatttccttatgaactttaaaatctgcttctcaatttctgttaaaagcctcttggggttttgattgacattacattcaatttttagatcaattttgggagaactgacatattaacaatactgagtcttctgattcatgagcactattaatgtctttaaaattttctctctgcagtgttttgtggttttgatgtacaggtcttgcacatctatcagatttattcttgagtattttatattttttgaaataatttttttttgagacagggtcttactctgtctcccaggctaaagtacagtggcacaattatagctcgctgcaacctctatctcctgggctcaagtgatcctcccactatagtctcccaagtagctgggactacaggtgtataccaccacccccagctaatttttttttttctgtggagatggggtcttactatgtttcccaggctggtcttgaattccttggttcaagtgatccttctgccttggcctcccaaagtgctgggattgcaggcgtgagccattgtgcctggcaggattttctcagagatgattattttgcctgagaatgaagggctttaatctttttcccttacagtctgtctgtgttttatttctttttcttgactgactgtgctgctacaatctccatgttgagtccaagtactgagagaggatgtcctgtatcagttcgttctcacaccgctataaagaaatacctgagactgggtaatttataaagaaaacagttttaattggctcacggttctgcaggctgtacagaaagcatgatgctggcatctgctcggcttctggggaggcctcaggaac

SEQ ID NO: 11744 - DNA, 1072 bp, Homo sapiens
cctgggactcctgttgccatagcaacccagctaccgccgaggacttctgcggcttttccagcccagcagcagccgctccaggtactttctgatggctccacagtgcagctccccagactttcctcactcggatttgaggactcgatgtgctgaggcaggacccagaggggtcccaagagcctgtcctcttttgttcaaaatacatcttgaaacgtctttgtgaaggctcttagttttaatgcatggatgctgttatttttccctactgttactgaaattaaaaagtgtttgtctctgatcattagttctgttaacttttctgctggaatgtttttcatttgcatttgcttttctgatatatttgcagttttcattgcttctgtacgattgtggcctctttggatgtttctcttttttttccccctttgtctgcttttaaacaaacagattttctaaattgttttcttgctatagggagttgattttgttctttaaacatattctaggggatgagtagcaaaaaacaatgatttcagatttcagaatacaaggaagttcctggaaactgcaactcagttatctctcctctcctctcctctcccctccccgcccctcccctcccctctcctctcctctcttcccttcttccttcctatctttctttccttttgatggaatcctgctctgttgcccaggctggagtgcagtggcacaatctcagctcaccgcaacctccacctcctgggttcaagcagttctcctgcatcagcctcccgagtagcagggattacaggcacgtgccaccatacccggctaatttttttgtatttagtagagatggggtttcaccatgttgcccaggctggtctcgaactcctgacctcaggtgatcccccacctcagcctcccaaagtgctgggattataggtgtgagccactgcgcccagtcaacatttctatatacttaaaaacatgttttaaaaattaggttaaaatatacataagagttcccattttacccatttttaagtgtacagttccgtggcatgaagcacattcacattgctgtgtg

SEQ ID NO: 11745 - DNA, 1032 bp, Homo sapiens
tacagacatgagccaccacgcccagccaaatcgccattctattttggtctctgaaacttaacattttgcttgaggaagggctcatatacaaggatattgaaacaaatgttgttttatatgataataatgcctgaggatcaacacatatacatttcctatcccaatatcccaaaaatagcaatcagtgtatttacagatgctgcagatccctctgaggagttgattctgaggctgtccctgaggacccatgccaggagatgtgtcccggaagtgactgtcacagatgcagtcccccagatgatgaggcaaggcctgagggtctgcgcttgttgggggaaaggtttattacaacttctcccaagcaaacagatggaaagcaatacctagagcagctccagtgcttgtgtgtgggacacctctgcaggggccttgtgtggctttgtcctcatttcagttagagttgagagtacaacccattttcatgtatggtggactttataaaacctaagtctgctttctactcagtaaacgtttagacatttttcttttcacattattctccagttactaagattttgtctgttgtcaaatccacataagccttctgttttttggtgaagacatattatagacttagagttttatttctttccacaaatactttgacattgtcatttttgccttagtttatacaactatttttctaagctctagatttagttttcacatggatacctctggtgttttaattctggcttccgcttttggttagcagttgtgacttagatttcttatctacaaactacttctgaagcctggttctgttgtgctgcctttagcaagtggtacacagaaaagtactaaacgatgaaaagattatttttgttcctttctgtcaaattcaaaggctaatatggagggttttttgagtttatttatgatcactggccaatagctctaagctgtgatatcatgttctttgtcatagaaattgaagagacagtggagaaatacttattttaaaatcagtgt

SEQ ID NO: 11746 - DNA, 1045 bp, Homo sapiens
tcattaccttacttctctgaaacagtctgaattccaaaccctgtgtggccctaaggattttggataagggactatgtacctataatataaataagccatattatttacaatcatgagtttctgaatgttcactttttttatttttggagacagagtcttgttctgtcacccaggctttagagtaccacagtgtgatctcggctcaccgcagcctccgcctcctgggttcaagcgattctcctgccttagcctcctcggtagctgggactacgggcatgagccaccagatccaactaattttttgtatttttagtagagacggggtttcaccatgttggccaggctggtcttgagctcctgatctcaggtgatctgcccgtctcaccctcccaaagggctgggattacaggtgtgagccactgtgcccagccagaatattcacttctaaatgtgggtgtgtattcaggtgacttgggattaaaaaaaaaagaaaaaacccttatgggattttatatttagaagttctgttgttgaaatatgaacctgtatctgttgttgcagtggcagaaggctgcagcacaatgaatgattattgtgaaagctggtaattttgtgcccacaaataattgtcaagaactttctaataataaaatacagaaatagattaatagttgctacaaacataaagagagactccatggtagaacactttaggaagcacattttatcttttttgaaccaacatgtatttccaaacatgtaagtaataatatcaagcgtggtgggaagattggattggaggctgattctgatctgtgtgttgggatgaactgtggcattcacagcattgagcaaaatcatcttcaaggacagcgtttaattctgttgttgacaagtcttttaagaaaaagtactagtttgggaatttttcacagatacaaataagcttgacccctaaatttaaaatattatttaaaaaataaaatgtcagatttattcatctgtcacagagtttattctgttgatggtaatattggctttggct

SEQ ID NO: 11747 - DNA, 1034 bp, Homo sapiens
aagagctgcttgcctctattaaggggagatgcggcatgggcgttatttctcctttttaaggcagcaggcatttcctttaccatcattgccaggcaggttactcctctgagcaaatcagcggcaatgatgagtgtgagatgcagatccttgtccatgcgcacttcgtgtgtcctgcgtgctgtctctctgctgtcaccacagggggccagattggctgtgcagcctctgcacatgcagcagctccgaaagctgaaacaccaccagcagtaaaaagctgtgcagccctcagccgctccaggcctgctgctgcacagcggaaggtaagtggccgctgggctttgtgggagctgcatctcacactcatcattcagggcccttaggccagagtggggctggactgagccccttccttttggaggcagccgttaaacagagctgaggaggctccctgcatgggcttctggaggtggggaggggccgagtgtcaaggaactctgaccctgtaatttttacatatatttgctctctaggggagagcttgctttgctgtatagtataatttttcaaaaatatttacaatgatttctgtgaaaaatcactctgacaaggacttctatttctggtaatatggtagatgagagaacctgaaaatctatctcaacaaaacatctaaaaatgccagattttcaaaaagtgccagataaaatatataaaaccgtgaatgagtctgcaggatagtgagtctagaaaccaggcgagggctgaagtctaaggaggtagttctgtgctaaagacactctatggcctgggtccccatggacccagatgacctagaactttgaggtaagtttggggagcagtctggagaagccttgggcccagggaggggcagaaccaaattggagacccccatataaggctgggctcacagagggatacagcaaacactaccaggaaatgatgaagtgggcaaactactactctaagcttcactgcagaaacagtatctcacttggccatggctgtggatggaa

SEQ ID NO: 11748 - DNA, 1095 bp, Homo sapiens
taccagcccctagccccaggggtcgtcagttctgtgggcacagctggactagaattccgggataaagctggggccgagcggcggctgcccctgtggtcctcgcgccccaggcctgtggctttagcgacacctggctagcgtgggcccgggccgccctccccatggctgaggaagaggctctgtgtgtcccaggctgctgcgtgggatcgccagtggcagctgtcagcaggggtgatggccgggggaggggctcccagggccaggagcctcagagaccagtgtgggctgacaaagcccagccccagtggttggtgcgctgggtgccctcactgctgtcatgagttcacaggggccagtgtgggccatggaaatgaagcctgagcctgccttccgctcggggcccaaggccttggacaggagtgagaggggctgccgtgagcaaatgcacggcccattcctgtgcaggggccagtgaggggaggggccaggacaggggcctctggagagggtgggaccccagtggtggattcctcgtcccagcagcgctggccacacagcagggcccagcatgcagggcggctgagcaggagctggcggggagcaggacacccaggcccgtggctcctctccttccttcgactgcccagatctctgctcacagggtcctgccctgcgtcccccctttggggacagcctcacctgcccggtgtctccagcacctggcttctttctgttgtcttcctctaaatctaaatccaaatgacttgcctttccttttattcttttcgttattgtgaggaagtctgtttgtacagagagtgcatggacgggacatatgttggttttgaagaggtgacctcccgggtctgagtgatgcgtcccactcagtgtgttgaccaccatcctgatgcgtcctcatgccccaacctgcggcagccccgcatttccttagggacagagggggcagctgcctgctttcccccacctgccagcaatggtgtggtccgtccttctgggggcccttctagaatccttggcagaccccactggtggccggggcaggctccagccctttgtcacctccctcctggcaaa

SEQ ID NO: 11749 - DNA, 2114 bp, Homo sapiens
aacagtctcctgccctctttccactttcaggcccctgcccctacccccgggctcctgtgagtacagagggggccgagtgagtagagccatgtctggggcaggcctgaacgggctgagggagtggggaggggccatccatgctggagctgagcagtggcacttggctgccccttaatggggaaggccaggctgccagggagggctgaggagagctggaaactgcagcctgggtccctgtggccaacagctgggggtgcagaggacacccgtggaggaaacattcaggacccagaggggctctcgaggcctggccatgaccctgcagcctccagctcgaacccactgtctgcactggcttgcggtcggggtgccgccatggggagggcagagacaccagggcgctatggtgctggacatccatgttgtgtcctggggcccgcgccctggtggggacactgctgccaggcgtcgccctgggaaatgcagatttcgtgtggccagatctttgatgtttctgaagagctgggaatccaggtttctctggatttggcaatgttgaaatgttggtggtcaattctaatttttatgactcactttgctgaccagaagatgcagctgtgggcctgcgaggcctccggcaagtgggatttggctcccatcacaggcagcagattggagcctgaggcctggttggaacatggcttgttcccttgtttctggaaggggttggtactcagtggggctgcgcctgcccaggaagatgggcttgtgtcctggctgctgtagagggggtgggggcagcccagcctgaaggttgaggatggaggtgtcttccggggggtgacagtggggatctgggggaggctgcccgctgcccgactacagagaccctgttgctgcctcaggaacccctctggagactggggcctgcgtgcagtgctttagtgaccatcagccctctggtcacctctgtgggggcctctgcccaccttgttgttgttggcacaggcaggctggtcccctcccatctgcagaaggggttatggggagggcgtgagccttctgggagaggccgaggcgtgttcctgcagagcccacggcagacgagggcagtggttggtttgttgttgggggaggagaaggggaggtcggggtggattcctggaagatgggtgacactgagactgtggcggtggggccaaccccacgaggggcctggagctctaaggcccttgggtcctccccaggtcaggccaagtccatgagccatcgctgagcagcccccagggagggaggggtgtgagcgtgggtgggctcccggcacctggcccagcatccacgcctggtgtgtgggcatctgcctgcagaccctcgtccgagggccccgtctctctggacccctcactgcaggtgaatagccacagtccctcccccaggccctgccctgcgtgttggaaacaccacctcctgggccttccccgtttgctcattcgggatccttgtctgggcactgaggacgatgagctccgcctctgttctcgcgtcagggctcggctcctccgtgtgtggggagacaggctgggatagcatgctgggcgactgtggtgagggcaaagacacagagggcatgagtggggggctgggggggcacctggatgttcagaggccagaaggcaggactacccgcaggtgcccaagggagacccagggccgcccagaagtccagggggagtcctggggcctcggagggatctgagcagggctgcggcctgacccaggatctctctggcctccctggcgtcttcccaggtggcccaggaccgcagtaccagactgagctggactggcattgaccaggccgaggccaccggccatcctcctccggccagaagctgcagtgataggggacatccctagcagttcacaaagctgtggggagaccccgagggggaagggtttccatgctgagccacaggcccggccacggtgcaaagctgtggggggactccgaggaagaagggttttcatgctgagccacagtcccggccatggtgcagggatttggcacgaagcctctcctagggccggtacacgacctagagggctccctggtg

SEQ ID NO: 11750 - DNA, 1074 bp, Homo sapiens
ggacaggacccaggagcaggacaggacccaggagcaggacaggacccaggagcaggcgaggggcccaggcgagggtctggattgtgctgaagcctgggacccactagtgggggtttgggacttccctgaggcctcagactcctgggttgctccctaggctgaggctgccatgtgtgtgtgggcgtgtgtgtgcatgtgcatgtgtgtatgtgtgtgtgcgtgcatgtgtgcatgtgcgtgtgggcaggtctgtgcctgtcctgtgtgcagctcgtgtccgtggtacccccgtgtggtgggctgcatggggctgtgcgttgccttgtagaacagtgtcacgggttcctctctgggcctctgtgtgtgcgtgtgtgtgtgtgtgtgcacccgcgtgtgtgtgacctgtgtttgtgtgtttgcatgctgtgcatgtggcattgtgttgtgcacatggcgttgcgtgttgtgcacttggcgttgtgtgttgtgcacgtggcgttgtgtgttgtgcacgtggcgttgcgtgttgtgcacgtgtgcaccccttgccacctgcctgtgactggggcctccagcctaatgagaaggcacagccaggccagcagcctcccgtgttgctgagtggcacaggcattcatcacctggtctggttttatgaaccatccttagagtggtgtaattttgtccacattggtggccagcaaagccccagctattgctcatcctcagcagcttgtgccccaagtgtgtggtttggccttctcagccaccgtcagtgctgtaaggtagagttgcttccacccaaggatgtggtgactgactccagcgtggcagggggctagtggatcgattagacagaatgaggatccacaagagcttgctggggttggagccattcctgccggcacaggaccctggcttgccctcccacacccatgcacagaatgttctggaggggcctttggccagcaggagccagagtgaggggctgggtgagctgcagggtggtggtggcagcccatggtgaggcccaggcctcagggacccatctcaccctgcacacggcatttagtt

SEQ ID NO: 11751 - DNA, 1036 bp, Homo sapiens
ctgggctgggtggagggttcagggtggctttgctgacgtgcctggcttctgggccttggtggctcaaggcccaggcagctgtggccagcccttgcagagccttagccaggctggcagcaccattccagcacattctgcaggtcagagccccccagcccagcccaggttctaggggaggggttggaccctggcctggaggggcctcatgagtgccgcctttcaccccacccacagctccctgcagcgctcccaggtatgggggccacagccatccaccaggcaggacagccccacagggcagggagatgcctgaccaaggagggtggcacaggcagtgaaggtggcggcgcacagccctgctggagagggccaggccagagtctggggtgcccatcaagctgaaatccaattatgagaacaggccgggctgctgtgacacgggggttaggaattaatgttaacactgtttctggttaagactttttgtgttgataaataattcatgaggcagttagcactttgagcctgacaacacgagaatatattaatacggtcggctccaagaaaggtcagccacgtgcttggggccagggggccatcttttattcattccctgacacaggctcattaattattctggcccagccggagctgtgctcggagggacactaatgagaaaaaggagagtggatttgagatccacacgccatccgctgtggggacgtagagggagagatggaaagaaacactggtgaggcctctgaggcgggatggggcctgcagcctggctccctgacagtgctggttgggtgtgaagaggtgagcggagctgatccgcaggtgtgtggggcactggctgccacatcccagctctcccagagagatgaggaacaggagcagatgcagccagtatcagagagcaggaggtgcatggggaagtgaggctgaggctgtgggtgccccaagcacactaggcccagcgggtgcaggaacccccagagaagccactgagcagagacccagaggggaggctcgc

SEQ ID NO: 11752 - DNA, 1033 bp, Homo sapiens
ttctggggagccgcagtgccccctggaggcccaaaggctggtctggactcctccctgcccacctgcacaggccccttcactattcctcctgtttctctcggagtccttcctgtttccgatgctgggatggtcactgcgtagcctgggtcaccggcagtggctggacggggcagggaggtggaggcggaccccatgggagccacacttctgggggatgatgttgaggcgagcagagaggagaaagccacatgccccaacctccaggccccctggcttcccaggggtgagaggttcctgtccttctttctttgtaacaagccaggattctaggggtggtggccgcaaggctgggggagggagagggtcatcggggccctggactggggctgggagggtccctttctggggtgccggggtctcctagcttccatccgacccggcccctgtgtggttgagctgggtctgagcagaaacaacctcctcagaaggatgtcctacgtcactgcctgggggttggtggctgggggcgctggacatagagttggtgtttcaccctgcagaagcctgggctgcaggaccccgaccccggggaccgcacagggtgagcagaccaagtagcgtcagtgccaggagctcagcatcccttcccaccagctgcaccgcagccctttaacacacgaacgtgcggggcccaaccgctgctcctttccgaggggcccaccttcctccagtgcaggggcccttccggcgcgtgtgggtgtggcaggcccgcctcggctcttgccatcttacaggcatggacctgctgctcttctctgtggttcaggcccttgcgacgtgactaggaagggcttcccattccagcaagaaggtggaatccacacctggtcttctctgatacgttgatggtttttcacttctatgtttgcgatctgtctggaattattttcagataagaggtgaaacaggagcttgctctgaaggacctacgccacacctggcccccacagcctgcaccccacacctggccccc

SEQ ID NO: 11753 - DNA, 1035 bp, Homo sapiens
acccgagtgtgctcatgtacacgtacccgagtgtgcccatgttcatgtatccgtgtgtgtacgtacccgagtgtgtgtatgtgcctgtgtgtacgtacttgagtttgtgcccatgtacgtgtacccgagtgtgtgtacgtgcctgagtgtgtgtacgtgcccaagcacaggcacattgtccagatccacataacactccttctttgcagttgcttcctccacacacagagtgtcccccatctctccagggtacacactgcagtgtgggtgaacgtcaaaagccgtgcagtgagagaagccaatcacagtaggtccgtgccgcctgacagtgttcacatggaagttcggaaaagacggctctgtagagacagacagatttgtggtttcccagggttgggggtgacggttaggagtcagggtttctttttggggtgatgataatgttctgtaatggatcgtggtgacaggtgcatcactgtgaacatactaaacgctagtgaattgtaagcgttagacggtgagttggatggtatgtgatttacatctcaagtcttagtccgtgcgggctgctctggcccagttctgcagcagacattcacagctcacagtgctggaggccgcaagcaggtcaaggcatggcagagtccctgtgagggcttcctggtccatagagggtgcctctccgctgcgtcctcacatggtggaaggggctaggtggctctggggccctttataaggcactgatgccgctcgtgaggctccacactcaagacctcatgacctcatcaccttccacctcctgatcccatcacctgggggtgaggatttaaacatgtgaattcttgatagacagaaacgttgaatccacaactcaatgaagctgtttaatcaaaaaaaaaaaaaaaagaagaagaagaaactaggagggaaatatctatttaaggtcattcttatgaagctcattcctggaaactgccgtgaagtcccccagagcatggggccctccgtccacccctccccatcagcggccacatt

SEQ ID NO: 11754 - DNA, 1033 bp, Homo sapiens
ctgtgttcagggccagtccccgggcaggcggccctcacccgttctatcctcccaggagatgcagctggacccccacaagctggaggtgggtgcaaagctggacctgttcggcagaccccctgccccgggcgtgtttgcaggcttccactacccacaggacctggcccggcccctcttccccagcacaggtgagactggagtcgggccaggtggggggcacagaaacctcccgctcgtgcccagctgagcctgccttcctgtgccaggagtgagagcgctctctggaccgcagcaccagcctttgcttcttgatgctcaccacttattcaggtcaaagcctggcaactccctcacctcaccccacccctcacctctcttctcctcacctctcctctcctgtcctccccaccagcctccccagggtggacctgggcctggggctgctgctcctccccaccaagtcctgcccagtgtgtcctggggggccttcagcccacgccacacggctctgaggcggctggtcctggccacccctcctccctggggctccctgttctggccccaccagaggcaaaggaatggcagggacccaggcccacgcgaggctgcccctttctgtctcccagcccccgctttcccaggaggagtttggcctctcgctgaacagtaggaagctgctcctgaggccaggctgggcccacaccccagtgccccttcctcacatgcatggttgctcccggggtcccaggacgggcccagctgcggtggtttcctaggaagggttccaggacttggcctgtactgtcctcagtagcacggcccagggtgggatctgccgggagcagcgagggcctccctgccctcagtcacccactcccccgagtcaccccctcccccgggtcacccctcccccagcaacacaacgtgaccacacccgagtgtcatcctccaggcacgcagaggcacgaagactctggggtgctgatctgtaggcaccactgcctggcacaggcccccaggaggaaagtgggct

SEQ ID NO: 11755 - DNA, 1090 bp, Homo sapiens
tgaaggcagagccctgtccacataagggtgatgggcgtgcccagcagccacatgaggctggcttcacaagcatggtggcctctgggccatggagcatcccagtagtctggctttctcagaaagcagaagtccaggctgcagtttctggctgtccgcatcctggctcaagccccccggacacgtgctcagtgtggcgcccagttctgggccctccacactgcccgccccaccgaccctgctcctcccccgcctccccttccctcctctggatacctggtggctgtccctcggtgctctgccatttgtcctgcgaggctgggccccctcagtcccggggccagtgctgcctcctccatctccttggcaggtcttgatatcttgctggcagggggcaggatgattccttgttgctcttttctctcttccatataaactttcaatctgcctgttaggttccagctttcactggagttgggttaaaggggtacatcgacctaagagggattcgtacgtcatctccggtatcattttcctatccctgatcatggtgtatctcatttatttaggtattagtagaattactcatagatgctttatattttactaatattatgattggaatttgtaagttacattcttaagctgttgctagaaaacagaagtgcgtatctgttttgaagatttgtatgccatctcttgatgctgtaactagcaatcctgctaaattcttacgaatgcaaagacatttgtctgtcaattcctttaccttttctgtgtagaaagtcatatctaggagtgggtggtttgcccccttgtgtaaactgtcggtacgtttctggagccactgttccagcgctttgttccagatgagtttcctgagtaagcctggcctttactttcctgtgctgcacctggcaggttttgtcacgagggctctttgccgtcttcagtgagttaaggcgctttccttttttctgctctctggaagagctcttgtgaggtctgatcctcactgccttcaaggcttggaggctcacagttcaggttccaagtactgattttttttctccactgggtgtggtattcctca

SEQ ID NO: 11756 - DNA, 1029 bp, Homo sapiens
gcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccagg

SEQ ID NO: 11757 - DNA, 1056 bp, Homo sapiens
ttgaaatatggctcgtgtgattcctgaagggaatgcttagtttacgtcaatttaaacttaacgcaagcagggccgggtgcggtagctcaggcctgtaatcccagcgtttgggaggctgaggccggaggatcgcttgagaaatttgaaaccagcctgggcaacatagtgagacccccatctctacaaaaaatacaaaaaaaattggccgagcgaggtggcgcgcgcctgtggtcccagctactcgggaggctgaggtaggaggatcccttgagtccaggggtcccaggctgcacagtgtgagccgagatcccgccacttcactccagcctgagcaacagagcctgtctcaaaggaaaaaaaaaaaaagtagtgcaggtttttaacattagttatgtgttgaaatagtatttttagcatattgaattaaaagtatgatcgaaattcacctgtttctttttaatgttgctattagaaaatgtataatttcacatgttgctggcattctgtttctgtcggccaggactgctctagcggcaaggatggttttcccagtcctaactcctcattatactcagtactttgagaaagggggcacagaattatactactgtggttgcgttaggtactttatattagatttttatcttttgttaaccttatttcctctattattagcatcatacactaagcatggtgtatatatcaaaattaatgagccaaaataatatagattaattatagttattatattagtttataatacattactgttaactaaggttcatgtttcattgagatttcctcagcttttacctgctgttctgttctagggtcccacatgacaagtagtcttcatgcctccgtaggcatgttttggctgtgacaatttctcagacttgttttgatgatcatgagtgtttgaggcgtcctggtcaggggtttggtagaaggtccctcaattgagacttctctgaaggttttctcatgattagactggagttacattctttttccttcttttcttttttctttttccttgagacggagtttcgctct

SEQ ID NO: 11758 - DNA, 1051 bp, Homo sapiens
gaggcctccccagggctgtgccaagggccttgtcttctctccatgctcttcccaaatagtctgacaatttggaaataacatcttgtcagaaaaactcaaacttgggaacagaggtctcaaggacatatcttgtatttcaacatcaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtatgtggtgggttcagatcctctgtggaccctcgtggttatgtggccaggtgcatatctgctggcgccttggttatgtgactgggtgcaggtcctccgccgacccccttggtcagctttcttgaaagtgcttggggcactgggcctcctggggcccatgtccgagaccatcacccctgaatcacacattattaccagtaactgtcagctgaacttggacagaagacaagcttttcaaaatgtccttaccttggccgggcgcggtggctcacgcctgtaatcccagcactttgggaggccgaggcaggtggattacctgaggtcaggaattcgagaccagcctggccaacccggcaaaaccctgtctctactaaaagtacaaaaattagccaggtgcagtggtgggcgcctgtagtcccagctactcgggaagctgaggcaggagaatggtgtgaaccctggaggcggagcttgcagtgagctgagatcgcaccactgcactccagcctgggcgacagagcgagactccgtctcaaaaaaaaaaaaaatgtccttaccttggccaggcacggtggctcacgcctgtaatcccaacactttgggaggccgaggcaggtggatcacctgaggtcaggagttcgagaccagcctggccaacagggcgaaacctcgtcactactaaaagtacaaaaattagccgggtgcagtggcaggcacctgtaatcc

SEQ ID NO: 11759 - DNA, 1025 bp, Homo sapiens
tctagagtcccagctacttgggaggctgaggtgggtggatcacttgggcccgggagctggaggctgcagtgagctgtgattgtgtcactgcactccagcctgggcaagcgagggagacttaaagcaattttttcttttgaaacggagtttcactcttgttgcccaggctggagtgcagtggtgcgatctcggctcaccgcaacctctgcctcctgggttcaagtgattctcctgcctcagctcccgagtagctgggattacagtcgcccaccaccatacctggctaattttttgtatttttagtaaagacagggtttcatggagaaaccaatatagaattgttcaggctggtctcgaactcccaacctcaggtgattcacccaccttggcctcccaaagtgctgggattaaaggtgtgagccatcgtgcctggcctaaaaaatttttttttcttcatctgggtttttgctttgaaaacaagtttctccaaatttacagatttcctgatgatgttgggtctgaactcaccaacttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacagctcaatcttagtttgcctccagttaatcttttatgcttagggattaaatgtgtggttttttttttgtttttttttttttggagacggagtctcgctctgtcacccaggctggagtgcagtggcgcgatctcggctcactgcaacctctgcctcctgggttcaaacgattctcctgcctcagcctcccaagtagctgggattataggcgcccaccaccatgcctggctaattttttatttttagtagagatggggtttcaccgtgttggccaggctggtctcgaactcctgacctcgtgatctac

SEQ ID NO: 11760 - DNA, 1052 bp, Homo sapiens
aacatattattcatggttgttttaagttttgtctgataccttcaacatccctatcatgtctggttctgatgcttgccctgtctgtgtttttgtttttgtttttatttttttttttgagatggagtccaggctggagtgcagtggtgtgatcttggctcactacaacctccgcctgttgggttcaagtgattcttctgcctcagcctcccgagtagctgggactacaggtgcactccaccatgcccggctgatttttgtatttttagtagagacggggtttcaccatactggccaggctgatctcgaattcctgacctcaggtgatctacccccctcggcctcccagagtgctgggattacaggcgtgagccacggcgcgtggttgccctatgtttttttgccttttagtattgccttgtccctttacattcatagctagacatgatgtactgagtaaaaggaattacttttaatagtactttactaatgtggtgatgagatgtcaggaaagggtgagcattctgtaggcccctgattaggtctgtctctttgtgagcctgttctcctggactctcaacctcacaagtatttcccaggccacccccaccccatctcttagatgggacagggtggaatttggtatatctctcttccctcaggttagttaagctctgacaaaaccccaatatattaggctctgggaacctggttgagctcctgaaagtaaaactcagaaaagcttgggactttgtctccctccactcccaccatgactgggtccccctggactttttaacttcaaacatgtacacacctagcctctagcaatttgtcagttgcagttcaggtatttctgtcctgacgctttctcacagagatttgtgatctggtaactactgtgtttctgcctgtctctaattttggggacagtggtttgtttgccttgtatcttcacttctctttcagatctaagaagagttgttgatttttcagtttgttaaactttttacttgttaggacagagtggctacttccaaactctttacatgcag

SEQ ID NO: 11761 - DNA, 1050 bp, Homo sapiens
tataccacaatgcatttattgtttaccgctccattcttccttttctcattctctatcaaagttataaagccatatttgaaagcaactgtgtacatcttgcatactttgtctccacatacatcctagcattctcaccttaatactctgtttagttacacaaacatttttcatttctttcagattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcaagtggcattcacccaaaagaaagtacttactcaggagagagtctctgaaagtggtaaatatgggggaaactgtcttcttcctgctcagctagtactgagagagtatttccataaacgtgactcacatactaaaagtttaaaacatgatttagttcttaatggtcatcaggacagttgtgcaagtaacagtaatgaatgtggtcaaactttctgtcaaaacattcaccttattcagtttgcaagaactcacacaggtgataaatcctacaaatgccctgataatgacaactctcttactcatggttcatctcttggtatatcaaagggcatacatagagagaaaccctatgaatgtaaggaatgtggaaaattcttcagctggcgctctaatcttactaggcatcagcttattcatactggagaaaaaccctatgagtgtaaagaatgtggaaagtctttcagccggagttctcacctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaac

SEQ ID NO: 11762 - DNA, 1046 bp, Homo sapiens
ggaaacatcttcagtctctttttaactcttgtggtagttacctccatatttctaaataaccagcttattctgctagaccttggctttctcccctaatgattgctcagtatagaaaggtaatttacttctctttcactctcctccctccataccttcccaccatatacacactcatgatggagacatgtctcttctcatgttcccatgcctccatcattctgatacagttatttcatatttttggttaaatctgtctttagtttttatgttggtatgactgtaattcctgtttatagggaaatcatgcaagtatacagtgatttatttttgtttctaaatttgtattttttctgtagttaattttttgctaatttaattttgttaccattaatgttttcatcatgtattcaattccagactctcctttcagtatctgaatattcttggctgatactttcagccaaattattaattgtattccttttttcttcctagtgatattgactgctaagtttttctgacttgcttcagagtagcttagtttttttaaggcctgctgtgcaatttttatcctgggatctcctctttgattttattttctatatcctctgtcatttcttttcttggagcaactcaagagtagcttcctggaaaagggtgatacaaacattgagacctgtgcatctgaaaatgttttgactttattcctcattgctctattttctgtcctctagttttcctaaagagaagtctgatggcattctaatttttgttacattgtagaaagctttgtttttgtttcagttttgatttctctggatggttttaagaactgcttcttgtcctgttaaggaatgatgttccctctcagtttatttttatccatttactaggtattgagatgttattcccaggaggactgggaagtaatctgcattgttctctgccatttctctagaagttagcatagtgtttggcacatagtaggtatttaattattttttgaataaatctaatgttcatagatccctaatgacatgtttata

SEQ ID NO: 11763 - DNA, 1022 bp, Homo sapiens
cactatggtcagctgaggctcagaactgtacattgttaatgggtttttcaagttcagaaaagcaacatgagcttttgttctgtggtagcatgttgatgtaataagtagctatttcaatagaggttcccagaacagcttttgttactgtcattttcttaactttgttcacttgtcttttattttgagctattgggtgtgcttttaatacattccttgtttgattgcattagccattgtgtatcttttgcatacagcttactaaatcagatggcttcagaaatgggtggtagaggagtaggcagaaacttgcaaggatatgtggatatttggaaatggttgtttcccaagacaggatggaagtcttttaagcaagaaacttggcccatgctatgaagtcatgaaatgaattgttggcatcatgtgctcactgaggctttggggaaatggataagttgtcattgaaaaattttaaacagaattctggagtggtcaagaggggaatgcttttgatacccatgtataacatggagaataatgatcttaaaacttcaatttaagattatgtgtcagtgatactacttagttacatgtagctatagagtcacagtggtgaaaaactctgccagttgcttactcacaaagttagttttcttcactacctcatcaggtttgttatgtgagtgggcattaatctgggaagagtgggaccctgccagttagattagggctatcttggaggaatatgcggattcaatactgcaaatatttctgaaacaccttctgctttgtactctattagatacccaaagaaattttcatccttgaagcggaggaatttaatgatacctgaatgcctaactgttgtattctgcttatacagaatccaatctcaagatacttggggtgaagaatgatgattcacagaagggaagggacatcttacataaacaaataatcgcagatacttgctaaagtgtatcccccaatctgggaaatactgtaaaggtgtatattattattga

SEQ ID NO: 11764 - DNA, 1955 bp, Homo sapiens
gaagaggcattctggtttttggaatgttcagcctttttgtactggtttctccccatcttcgtggatttatctacctttggtctttgatgttggtgacctttgggtggagtctctgagtggacgtcctttttgttgatgttgacactactcctttctgtttgttagttttccttcaaacagtcaggcccctctgctgcaggtgtgctggagtttggtggaggtccactccagactcttgtttgcctgggtatcgccagcagaggctgcagaacagcaaagattgctgcttgttccttcctctggaagcttcatcccagaggggcactggccagatgccagccagagttctcttgtatgatgtgtctgttgacccctgctgggaggtgtctccccgtcaggatgcacgggggccagggacccacttgaggaggcattctgttgcttatcagagctcgaatgctgtgctgggagatccgctgctctcttcagagccgtcaggcagggacatttaagtctgctgaagctgcgcccacagccgccccttcccccaggtgctctgtcccagggagctgggggttttatctataagtccctgactggggctgctgcctttttttcagagatgccctgcccagagaggaggaatctagagagcaatagtaatttttttgtaggtttattatctccgtggattgtttttgaccttaacactctcttttgtcttgaatctgtagtcattatattcctggacagaacgaggtctggctgctttttctctcagtccaataaggagatgcagactgactgggaaagaagggagttaatttctgcagctggttatggagtaactcaccagaccaactaaaagttacaagtttttttcaacgcttgtattcattctaaattctatgtctgtgtgtaggaggtgcacctacaagccagaatgtttcattcaaactgtatctaatcttcaggtagggtccagggtctggaaagctttctctagagacttggaaaaatttccttatcttaagtgggccctggtacaaggtgtgtgtaagaatgccttcataactttatcaggctttagggtcttagaaaacccgggtgaaaatcttaatgggtttgttttcacatttcagcccttgtacgaaggcagtagtttctccagttatttactgtttaacttacacattcatcagaattatagtaatgtgttagtagaaactgttctggttgctcatggagacctggcctgccacaattacagtttttctccccaatggacattttctatcttatttaacatcagatatttaattttaatctcatatttttagtatattagaagctttaacctgaaagcctccattttgggccttgtcataaaataagttaaatgactctaattctgaatacttctctttgtttcttcttcaggacacagccagtgtgaagtcctctagtagtcttgaacccaatcttttttgtgatgaagagattcccatcaaatccgaggaggtggtgacccacatgtggacagcaccttcattttgtgcagagcatgcttattcttctgcttctaagagttgttctcaaggtattactcctttaaaaaactgtggggaacataagcagaaaaccaatgagaaaaagcattatgttaatcaagactgtgactccatttcgagtggagtacaatggttggccatgaaatactaatggaacctgaaaatgctgttttcttttggaaaagccaatccctgtttgcattttctgtcatcacaacctgaaaacttacatagagttttagagtcctaattagaagaacttgaggggccatctagtcccatgcctcagttctagaaaattccggataggtagtccttcaccctctatgtggtcattatcaggtgttgtggaactgctgctttttaagcatatttattctggtt

SEQ ID NO: 11765 - DNA, 1033 bp, Homo sapiens
gtagagaggattaaatggtttgtgtccttaggctgtcacatctaaatttatcttcccctccttaacttgttggtataggagttattataggttgtagactatagaaggtagattacttaaccataattttttttgtattatactttaagttctggggtacatgtgcagaacgtacaggtttgctacataggtatacacgtgccatggtggtttgctgcacccatcaaccacattaggtatttctcctaatgctatgcctcccctaggcctgcacccctggacaggccctgctgtgtgatgttcccctccctgtgtccatatgttctcgttgttcaactcccacttatgagtgagaacatgcagtgtttggtttcctgttcttgtgttagtttgctgagaatgatggtttccagcttcatccatgtctctgcaaaggacacgaactcatctttttttatggctacgtagtattccatggtatatatgtgctgcattttcttcatctattctatcattggtgggcatttgggctggttccaagtctttgctgttgtgaacagcactgcagtaaacatatgtgtgcatgtgtctatagtagaatgatttataatcctttgggtatatacccagtaatgggattgctgggtcaaatggtaattctagttctagattcttgaggaattgccagagtcttccacaatggttgaactaattgacactcccaccaacagtgtaaaagcattcgtgtttctccacatcctctgtagcatctgttgtttcctgactttttaatgattgccattttagctggtgtgagatggtatctcattgtggttttgatttgcaattctctagcgacagtgatgatgagcattttttcatatgtttgttggctgcataaatgtcttcttttgagaagtgtctgttcatattcttcgcctactttttgatggggtggtttttttcttgtaaatttgtttaagttctttgtagattctggatattagccctttgtcagatggatagatggcaa

SEQ ID NO: 11766 - DNA, 1033 bp, Homo sapiens
tggagtgcagtggcacgatcttggctcacctgcagtctccacctctcaggttcaagcaattctgcgtcagcctcctgagtagttagggttacaagcatgtgccaccacacccagtaatttttgtatttttagtaatgacaaagtttcaccatcaagctggtcttgaactcctgacctcaggtgatctacccacctcggcctcccaaagtggtgggattacaggtgtgagccacggcacctggaacaaaaaaaatatattttttccagagtgtcttttaggatccgatccttggagtacactttgggaaatggtataaaatttcttgaagcagccagaagtgtctcagttgccacatgagcattcccttgagaacagctttgccagttgttctgaagctgagtaaattcttataaactaagaaatacgtgcaatgcattttgaaactgtttttacgttaaaataatttttaaagaaaatactaaatgccagtataagaaaatggaaagataagagaatatggccagcagacatctagattaaactgatatcaaaaacagtgtatgatgaaagaccagaattgtgcctgccagtgaataaattatcaggttcccaccttgtttacatgaagagagtttgctcttattgcagaattgggtttacaagtaacttgctcaatcaagtaagcagaaactgtaaagttatataataaatggaggtgtttggtaaaatgcacttcatatgctcttacattctttttttttttttctttttgagatggagtctcgctctgtcacccaggctggagtgcagtggcgtgatctcagctcattgcaaccttcaccccccgggctcaagtgattctcctgtctcagcctcctgagtagctgggactacaggcatgcatcaccacgcccggctaacttttgtatttttagtagagatgaagttttgccatattggccaggctggtcttgaactcctgatctcaggtgatctgcctacctcggcctcccaaagtgctgggattatagg

SEQ ID NO: 11767 - DNA, 1050 bp, Homo sapiens
tttttttttttttttttgagacagagtctagctctgtcacccaggctggagtgcagtggcgcgatcttggctcactgcaagctccgccctgcgggtccacgccattctcctacctacctcagcctcccgagtagctgggactacaggcgcctgccaccacgcccggctaattttttgtatttttagtagagatggggttttgccttgttagccaggatggtctcgatctcctgacctcgtgatccgtccacctcggcctcccaaagtgctgggattacaggcgtgagccgccgtgcccggccaaaatccagtggtttctttctgtgtcttctatccccatgacctctttattgcactatatattgctgctgttgtttctttacctaacatttgctctactgtttttttagtctctttgattgtatttggccatcatttctagttctttctccttatatccccaacaatgggtgcagggttcagcctttgactgtttattgttgttattttgtgctgtttatcttggaattctcatctaagggtcttaagtctttcagctattaccttgtggtttcagttctcacttcttatagtttcctcctattacattacacacaggaattactatcactgtgaaagaggctgtgtccagccactcatttgtaatctgtgtttccaacatgtgtattgcacatttctatttagatttttatcatctcagtttcagcatctgaaatagaaaatctccttcctctccacccttcacaaaccacttttctttcctaattgcctcatcttagtaagcgccaggaccatcgtgtaaaaacttagcgtgatcttgactcatacgtttcctttttatttttttgagatggaatctcactctgccacccaggttggagtgcagttgcacgatctcagcttactgcaacctctgccccctgggttcaagtgaatctcctgccttagcctcccgggtagctgggattacaggcgttcaccaccttgcccagctaatttttgtgtttttagtggagacagggtttcacc

SEQ ID NO: 11768 - DNA, 1037 bp, Homo sapiens
gtatgtaaagatgctgatagattcacttaataacctcagacaagttagaggatatgtgtggaagcccttgacactctttagaagaagggtgtgatataaattaaaagttatagcagttttatctgtggaataaattaatgggactaatgtttataagttacaatggataatcacttctattttatgtggcttcctcacatattataatagttaagaactgcaaatcccacagtatgatttttttcttttgcttgtttttgtgttgaggctctgagaaatttttaaagagtacgtatttaagatatgaaagagttgtgtgttgttaatagacaaaataattgctaatcataagatatatatatatacacacacacacacacacacacacacacacactttttcctttggaaagttttttctttgaagagtatggaaacactgcataattcagagatagcctcaaattttctttgctttctctgattcctttctgcctttctcaaactgtagatgaattctaaaaggctcttaaaggtccattttcttattttttctcttttatattacaaatccaaacaaaactcctttatccaagttcttctgcctgagcataggaaagaagttgaagttggagtgcgtatatacgtgtagggcatagctattgttgtaatttggtttgtagcttgataattatggaaattttcaaaatttattttaaagactgtaactgttcatttatgaaaagtgatcagttatttatttcactgttagggaaataaagtatataattttataatttcactttgaattatctttctgccagacttgtttttaaaataatttctagatgctaaaatctaaattgtcctttgttttggtttttgcaaaaaaaactaaatgtcagccaatgtggattgcttaagtattactttttcccctttcctatttttttcttttttttttcttctaataacatctgttctttttgttctatggaaatttgagtgctgaatacttccacttaaccctttttggcc

SEQ ID NO: 11769 - DNA, 1036 bp, Homo sapiens
gtttacatttgaaattttacataattaaaagtttagaaataggctgggcacggtggctcatgcttgtaatctcagcactttgggaggtcagggcgggcagatcacttgaggtcagcagtttgagaccagcctggccaacatggtgaaaccccatctctactgagaacacaaaaattagccgggcatggtggcaggtgcctgtaatcccagctactcgggaggctgaggcaggagaatcgcttgaacccaggaggtggaggttgcagtgagctgagattgtgccactacattccagccttggcaacagtgagactctgtctcaaaaaaaaaaaaaaaagtttagaaatatttgattctatgtttatcatattgtttcgtttttcaaaacttatgtttcccttttgaatataggataaatctcagattctcagtccaaaacttaagattaaagatctcatctttttttctaatgttatttcctgtgtttttgcgtatgactcttccattctgccttttcaccagctagactagtatattctctctgtaatttaccttttacattcttgtagctcttcctcctagaatgtttattcaaatcttatctatccttcaaagctcaacacaatttcttccttgctgtgaagttttcctaacaatctttattagtccattcttgtactgctataaataaatactcgaggctgggtaatttataaagaagagaggctgtacaggttccacaggctgaacaggtagcatggctgaggaggcttcgggaaactttcaattatggcagaaggtgaaggctaagcaggcacgtcttacatggccagagcaggaggaagagagagaagcgggagttgccccacacttttaaacaaccagatctcgtgagaactcactattgtgagaacagcaagggggaaatctgcccacatgatccggtcaccttccaccaggtccctcctccaacattggggattccaattcaacatgagatttgggtagagacacaaatccaaaccatatcacaatc

SEQ ID NO: 11770 - DNA, 1049 bp, Homo sapiens
taatgatatataagaatgcttgtgatttttgcacattgattttgtatgctgagactttgctgaagttgcttatcagcttaaggagattttgggctgagatgatgggattttctaaatatacagtcatgtcatctgcaaacagggacaatttgacttcctcttttcctaattgaataccctttatttctttctcttgcctgattgccctggccagaacttccaacactatgttgaataggagtggtgagagaagacatccttctcttgtgctggttttcaaagggaatgcttccagcttttgcccattcagtatgatattggctgtgggtttgtcataaatagctcttattattttgagatacattccatcaatacctcgtttattgagagtttttagcatgaaggttgttgaattttgtcaaaggccttttctgcatctattgagataatcatgtagtttttgtcattggttctgtttatgtgatggattacgtttatcgatttgagtatgttgaactagccttgcatcccggggatgaagccaactcgattgtggtgaataataagctttttgacgtgctgctggattcggtttgccaatattttattggggattttcacatcgatgttcatcagggatattggtctaaaattctctttttttgttgtgtctctgccaggctttggtatcaggatgatgttggcctcataaaatgagttagggaggattccgtctttttctattgcttggaatagtttcagaaggaatggtaccagctcctctttgtacctctggtagaatttggctgtgaatccatctggtcctggactttttttgtttggtaggctattattgcctcaatttcagagcctgctattggtctgttcagagattcaacttcttcctggtttagtcttgggagagtgtatgtgtccaggaatttatccatttcttctagattttctagtttatttgtgtagaggtgtttatagtattctctgatggtagtttgtatttctgtgggattggtggtgatatcccctttatc

SEQ ID NO: 11771 - DNA, 1231 bp, Homo sapiens
atggtgattctgctttgaagagttgccccaattgctcctgtccatctaaccaatcaccagcttgtgatgaaattttttttgatgttcaccttgaaaccatgaagatgtcttgcctattcctaatgcttttctttattataaaaatggggactacaggccgggcatggtggctcacgcctgtaatcctagcactttgggaggctgaggtgggcagatcacgagttcaggagatcaagaccatcctggctaacacggtgaaatcccgtctctactaaaaatacaaaaaattagccgggcgtggtggtgggcacctgtagtcccagctactcgggaggctaaggcaggagaatggcatgaacctggaaggcggagcttacagagagccaggatctcgccactgcagtccagtctgggcgacagagcaagactccgtctccagaaaaaaaaaaatggaggggggtgctgcatggaatgcttttaccctttgtgatagttgtcactgtattcagattggttgataaactatttcaggatttgaaattaagaattttttcaactcctaatttgtacttaattattctgttgaatgtctgtcgttcattcctagttttctatttcagaaagaaaataaaggctttctggtagaacttcagcttcttgccccgtacacaaaactactggtattcatacttagtctttgtctatctctgtgggcaaagtgtacctttctcttcaaggataatccctcctcttccatcccttctggcatctttagtgatttcagcatactgagaaatctttctctcccacctactctgtctgttgaattccattcctcccaatatgtatttaagtctctatcatcttaaacataaaagccctcttcttacatgatgccttatccttgcctcttttcacacagaagtttcttgacaaatagtctttattgtctcagtttcctcaacatctgtttagtttttatactctataatctaactttgagctaagtaattttattgaaactgcactgtccaagttaccactgagtttttaattgtcaaattctgagattctccttttcatttcatatcttaattgatctctggtcatgtatatgtttaatgtggttggtgactcctgtccttgaaattgagattaacttgatttttctttcatttgtgtgatacctttctcttctggttttcctccttatattctgaccactccttag

SEQ ID NO: 11772 - DNA, 1087 bp, Homo sapiens
tttctgatccttgtctcgtttcatatgtactctcttttgagacaactggagcctgtttctggatgtttttgcctcggtttcttttgtggtcttatgtagacacgtctgaaagcgagaaagtggtgtctcttgggcctcttccgcctagaacttgggaactgatacttttctctcagccgtgggcctaaagcctttcgttagccgatatggtgtttaaagtacagtattatgacgtgacgtattcttccctcacgtatcctcattatggtttgatagtcggctatctctttattcaagacctggttggatcaaatatttgcaggcctcatctcagggctagggtttctgaaaaggttatctgagctctagtctcaccggatggtattactagacaagaactccagactaattattgccgcagtgaaaaagtcttagcggggaaagagaaggagcagcaataattctaaaatttagaggtttaggaaaaattggtttatagtggaggtggaaggaaatgttgaaatctcttgacgtagggaactcaagatcaacgattttagaatcacagttattgcagataactaggtttgcctataaggttaattataatctcacctttgaggtaaggaaaacagatactatcccttgtgtggaggggattaatgccccaagaggttgagtgattactcaaggtcaaaggtgtttttctttactcattagaccagtgctttttaaatgatgttgctggaccacttgcaccagggtcaactggatgcttgtttaaatgcagatctctagtcttgttgtggaagttctggaatctgcttttctagcaactagtctcagatgattctcatgtaagttgaggttttcgaaccattgctttagtcgttgcttgttaaaggcattttgctttatgttttgtctagtattagtaatgataaaatattaagcactgttaaccagtgttgctttttaaaaagcatctgccgtcaccactgactaccacagagataggcaccgcagcgtattaaaaacttaaatgacagcgaggaggaactaatttaacacctatagattgtttgct

SEQ ID NO: 11773 - DNA, 1033 bp, Homo sapiens
ctgataaagttttagattccaaattgttagcctttaagaaattacagtcatctgagaaggttattaaaatgcttctctgcactacgtatggtggctcatgcctgtaatcgcagcactttggggggccgaggtgggaggatccctgagcccaggagtttgagatcagtctgggcaacatagcaagatcccatgtctacaaaaaaattttttttaattagctgggcataacgatgcacacctgtggtcctagctacttgggaggctgaggcaggaggattgcctgagcccaagagttggagtaagctggggttgtgccactgcactccaactgggcaacggagtgacaccctgtgtctaagaaaataaaaattaaaaaataaataaaatgctcttcctttcccaactacatatttgtgtggtgctggtttttcttcatatattccaaccaaaagaacatattgtaacgggttggagaaacagatatgataatccagctcgatcctgctaagccaaatgttaaaaaaaaaagtacaaaaaatgtaaaccaatgccactcttctcaccagatttttttgttttggaaaatatagttattatttttaaaatgtatttaaatataaaagttttatattgaaatgaataaaatattttaaacatcttaggtttaatttctaatatagtaaacatcaatatgtattatgcatataaacaagaactttgggggttctcaataatttttttttttgtgagacagagtcttactctgttgcccaggctggagtacagtggcaccatcttggctcactgcaacctccgccacccaggttcaagcgattctcctgcctcagcctcctaagtagctgggattacaggtgcccaccactacgcccggctaagttttgtattttttagtagagatgcggtttctccatgttggccaggctggtctcgaactcctaacctcaagtgatctgcccgcctcggcctcccaaagtgctgggattacaggtatgagccaccgtgcctggcctca

SEQ ID NO: 11774 - DNA, 1052 bp, Homo sapiens
ggatttatgacattacaatcctgcattgtttcaagactgacattttttcctaaggaaggaaataatcatctaagaccacgaaaaaaggctgttttttgtttttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttcataattcttcccccaaaataatgaagtttgcagtttaacaactttttttttgagagggggggtctggctctgtagcgcaggctggagtgcagcggtgccatcttgactcattgcagcctccgcctgccaggattcaagcaattctcctgcctcaggctcccgagtagctgggattacagacacccaccacgacgcccgactaatttttgtatttttagtagaggagacggggtttctccatgttggccaggctggtctcaaactgacctcaagtgatctgcccac

SEQ ID NO: 11775 - DNA, 1010 bp, Homo sapiens
acaagaggggagtggacccacgctctgaaatcccatgcagtgatgtgatgatgacttgtcctttctctcctctgtgaaccgtagcagcgcctccggcccctcctgtgacgcacagcactcctgtaactgtctcagaaccactcctggagaaagacttccttgcaggagtgactcaagaattaatcagtaaataccttgaaatgcttgtaagctactgtgctgtatgtttctagtagccacagaataccttttaggcgacataaaaatcctcattttcgtgtggttttgttgagggggttctggctgatagcatatgtccagttcctctttggtcctaaccaaagggaagtgtacttttagggggaggggagagaaattccaaaaactttcagaaggtactgaagacatggaatttctgagggccagtttttccagtgctttctgtgagaatacttcattatttgctgatgacgcacttttccttgacctctgtagagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggtagcagagaggtgtttaggcacaaaaattaaggggagatcctagctttaattctgggaatttttgaggaaggatgacatttcatttaaagtttgatagaatcgggaacttctattagggaatggtactgcaagtagaacagaattgatttaagagccagaacgtttcctttgggctcctgacttcaggtgcagcccttttcagctcctgataatagcaggaagcggaaacgactgcatggagagctgtccctcccagcagcaggtctgtcatgagcacgaggccac

SEQ ID NO: 11776 - DNA, 1036 bp, Homo sapiens
gtggttcatgcctgtaatcccagcactttgggaggccaaggcgggaggatcatgaggtcagcagttcgagatcagcctggccaacaggcgaaaccctgtctctactaaaaatacaaaaattagccaggtgtggtggtgcatatgtgtaatcccagctacttaggaggctgaggcatgaaaaatcacttgaacctggaaggcggaggttgcagtgttctgagatcgagacagtgcactccagcctaggcaatagagtgagactctgtcttgaaaaaaaaaccaagcaaacaaacaacaactacaaaaataaaaaaaccccaaatacatcttattggccagaacatagtcacctgttcaaatgtaaatataaggaaagtagggaaatacagtctcttatcagggcagctaatactggggattctgttcactagggaggaggacagatcagatttggtaggcagcattagcagggaggaggacagatgagatttggcgggcaacattagcctctgccacagggagaatttgatcagaagcaaatagatgaacctgtacgcatcaagaggttctgagtacagcataactctaatacataacaatacaaagcagtcgtacttgttaataatgcaaattctgagacatcaagaaaaatattaaattacatgtaccaatcttctgtaaagaaagcaaagatgtggccgggcacagtggctcacgcctgtaatcccagcactttgggagtcgaggtgggcggatcaccaagtcaggagatcaagaccaacctggccaacatggagaaaccccatctctactaaaaatacaaaaattagccgggcgtggtggtgcgcacctgtactcctagctacttgggaggctgaggcaggagaatcgcttgaacccaggaggcagaggttgcagtgagccaagatggcgccattgcactccagcctaggcaagagagtgagactccgtctaaaaacaaaacatcaaaaaggaaggaaggaaggcaggcaggcgggcaggcaaagatgagtat

SEQ ID NO: 11777 - DNA, 1033 bp, Homo sapiens
cttgacctcatgatccgcccgcttcagcctcccaaagggctgggattacaggcgtgagccaccacacctagcctcaagcatctcttttttattctttatctgaatccttactattttaagaggctctaaaaaaactcttctcccaatctcatctgttagctttgccaatggttttctttcttgaacagaaatgcttaaatttgatggagacatttaagttatcttacccaatatattcctactaaacatttttattgattagctttatagtttctctttaacactgaggtctttaatccatctagagttcactgtttcatctagcatgaagtaggtggccaactttattctccatatggtatgtcagttttctcatacttgcttaattttgcactagtttatgactgactatctctccacataaatgtttctgatttcacactccctgttcttttcatatctgctccttcctgtgctagttaccgcactgttctgaggtgcactgtttggtttcgtttggtttatgactctgtattttcatgtctcacagggcagggttctcccatcttctcttctctttttgtttaatgttagaatagctttattcatccatatacatttttaaaaatttaatagaggtaagatatacagacataaaatttgctatctcaatcattttaagtctacagttcagtagtgttgagtatattcacactgttgtgcaaccaatctccagaactcatttcaccttacaaaactaaaattctatacccattaaactccacattctctccttcccagccgctggtaaccacctttctactttctgtctccatgaatttgactctaggtatgacaagtggaatcatatgtagtatttgtctttttgtaactcctccttacaaaatttaaaataaaatgaattcctaaaaaatactgtttgttttttttgtttgttttgttttgagacggagtctcgctcttgtcacccagactggagtgcagtggtgcgatctcagctcactgtaacctc

SEQ ID NO: 11778 - DNA, 1026 bp, Homo sapiens
tggtgggggttgggacttgtggctttaaagaaatcacttctgagtaggatgtatattttcgttggatttttgttgttatttctttagaaccctccacagcaacatgcaagaccatggagttaaagaaacccagagacctttatcaattaattgtactgtttgtgaatttgtataaataataacaaagatcctcttaaaacgtttatattcttacagtaaaaggttaaactgatatttatataataaaagaggaaatatgaagtatgtttttgaaaaaaaaaaaaaaaacaacagccttgtatctgcgaattatttttaaggcattgtgtgcttgggtacatgccaaggtaggaggtgttgtttgtatactctaagaggacgcaaggtggagtttggtgcatcctatgtgggggtgagtcaactcatgggtagaattttattctgtataaggtttactactgacatgttttgtttctagaaatgtgattagactggagatttatataatgtttggctttaaactttcaacaacgtggaaatttaaagaaattgaacaaaatgaaactttttaaaaaaccagatttgtatgtaagtcacagtttccccgagtggccagtttttctttgggtgaaaatgagatctagaggtgatgttgaaaagtggttcacgacgtgggcaagaaagatggattttttttaccctgagagtgggtgtggggaggatgtgaaggtggaaggactgaagccattgttgagaaaagttaaaagagcgctgtccttgcgtgcttgccggctcagtcatgcatactgaatctcccagtgtgagcgagggtccgggtggagaggaggagggcagctcaagccctctttttcacattcccctccaggcccggctgtaaggaagcactttcctgggggatggggagcttggccaggattttgcacatttgcattttagcacttccaatagccgaggctggccgctggatccactctgtcaagggtttttagactgaaatcggggcag

SEQ ID NO: 11779 - DNA, 1032 bp, Homo sapiens
gggcattgggctgactctaatcaatgatcatgttgctactatctgctagttctcttcttaacttttttttggatataattgtggattcacagttagttgcaaaagtagtagagagaaaaccagggcattggcatcggttggctattgttaagactacggaccttgttagactatggaccttatgcagctttcagtgtctgtatgcgctgtgtgtgtattctacgcaaggtgatctcatgtgtagtatcttgtaaccatctccacccctgccattgccatagaactgtctcgtcaccgagtggaactcacctcccttgtgattctccttttgagactcatccccacacattgcccgtgtgtccttggcagccacaaatcccttctctgttctcctccatctctagttttgtcatatggaggatgttatgtacatggaagcgtgtagtgtgtaaccttctgtaagactggcctttttcaccaagcttcctgctcttatgatcctccacgccgttgcctgtatcagtagtttatttatttttactcttgtgtggatatcctagagtttgttgactccttcaccattgaaagatatttgggtggtttccactgtgaggaataaagttcttaggaacatgcatgtacaggtttttgtgaacctgaattttcattctttggggtaaatgccaaagagtacaattgctgagtcacatgggaagtccatgtttgtttgtttgtttgtttgttttttgagatggagtctcgctctgtcacccaggctggagtgcggtggcacgatctcggctcactgcaagctccgcctcccgggttcacgccattctcctgcctcagcctctccgagtagctgggactacaggcgcgcgccaccatgcctggctaattttttgtatttttagtagagatggggtttcactgtggtctcgatctcctgacctcgtgatctgcccgcctcggcctcccaaagtgctgggattacaagcgtgagccaccgcgcccggcccatgtttggttttt

SEQ ID NO: 11780 - DNA, 1038 bp, Homo sapiens
aagaggccaggtttgaattgcaccttgaagaatgaggcagacataacagaccattacataacgagccaggagattgaatcagtaataaaaggtctcctatcacagacaagcccaggatctgatggcttcactgctgaattctaccaaacatttcaagaagaactaataacaatcctgctccaacttttcccaaaatctgggagaaaattatgaggccaaaaccagaggaggacactacaagaacattacaggccaagatccatgatgaacatagatgcaaaaatcctcaatctaatactagtaaatcgaattcaatagcacattaaaaagatcattcaccatgatcaagtgggagttatctcagggatacaagcgtggttgagtgtacacaagtctataaataggacatgctacagtcatagaatggaggactaaaaccataggatcatctctgtggatgcaaagaaagcatttgacaaaattcaacattctatcataatgaaaactctcaacaaatttgatatagaaagactgtaccacaatgcaataaggctgtatatggcaagcccaaagctaacatcatacagaatgggataaagttgtaagcttttcctctaagatatgtgtacccccaggtgcactgcagcactattcacaatagctgagaaatggaatcaacctaagcctacatcagcagatgaatggataaaggaaatggggcatatatataacaatggaatatgatttagcctttaaaaagaaggaaatcctggccgaatgcagtaactcacacctgtagtcccagcactttgggaggctgaggcaggtggatcacctgaggttgggaattcgagaccagcctgaccaacatggagaaaccccgtctctactaaaaatacaaaattagccaggcatggtggcgcatgcctgtaatcccagctacttgggagattgaggcaggagaattgtttgaacctggggaggcggaggttgtggtgagctgagattgcaagattgcacttcagcctgggcaacaag

SEQ ID NO: 11781 - DNA, 1052 bp, Homo sapiens
aaagtgctggattacaggcgtgagccaccgcacccagccccctgtgagagctctttgttgttaaaataatcttctttcttttatgctgaagatatttttctacttctattgtttatctctttactttcctttcttttcttttctgagacaggatcttgctatgttgcctagtctggagtgcagtggtgtaatgaaggctcactacatccttgacctcccaggctcaagtgatcttcccacctcagcctcccacctgtagctggaactacaggtgcatgccaccacatccagctaattaaaaaaaatttttttgtagagatgggatctcactatgttgctcaggctggtctcaaactggcctcagtgtcttgcagtgctgggattacaggcattgtttgttgtttcttaactttgtttatggtatctcttgccacagtaaaattttaaagttttatgtagtcaaatgtctctcttctcttttacagtttctgggtttccagtcttggttaagaaggtcacccgcaccctcagattgtatatgtagtctcctagattctctttcaggatttgtatgattttaaggttttcattttttttttaaagccagtcaaatttagcagttgggggttgtgtaccaactttagtgacaataatgtcactacccgctaccatcagagcagcctaaggttcttattttcatgcattaaatctttgtatacagtgtaagacaagcatgcaattttatttcctctcggatgaatgctattataattatgccactacatactacatacccgcatcttttacccccagaattgaactaccaacttcaacatacatcgtattctcatatttaatagattttaagacttcaaaacgacacaaagaggatcagaacccgtatgtgatatttttgtgcgtcctgtctggtgaccgttggttcaccttatctctgtttccctttcaggtgctgctagctgaggaggggatagctcctctttcttctgcaggaccagggaaagaggagaaactcctgtttggagaagggtttt

SEQ ID NO: 11782 - DNA, 1026 bp, Homo sapiens
agcccagcctgacagtctctccagtgctgtactgcaacttgtatctgggacagcagttaagtgcaaaggacactagaatgataaacaaatgtatcttttagattgtgactcaatcttattgaatccaggcaaaatcattaagaagagctccttaactacttcatgtgttactacctaaagtccatggagggtcttcaatgtagcactcaagcccacttttctgctacactcaacagccgtcctagatgccagcagctagagtggctaagtagttttatgaaaatgtcttgattaaaaaaaaaaatgctgtctgtgagcctcatgacccaagatgtcatctcctgtagcgtcacatagcatttctagtgggcaggggttttcctttcacttcattcatggaaagaccgagatgcctgtgagtcaacatagctcacgcagttggtcggtgtcagagccacaaatgaggtcttctgacgggtgctcaattccaagtcaagtgtgctttgttttcctcatggtagaactctttcttttttttttttttttttttgagacagagtctcgctctgtcacccaggctggagtgcaatggcagatctcaggtcactgcaacctcctccgcctccaaggttcaagcgattctcctgcctcagcctcccgagtagctgggactacaggcatgcgccaccacgcctggctaatttttttgtatttttagtagagacagtgtttcaccatgttggtcaggctggtctcgaactcctaacctcaaatgatccacccgtctcgacctcccaaagtgctgggattacaggcatgagccaccacacctggcccctcatggtagaactatgttttttttttttttgagatggagtctcgctctgtcacccaggctggagtgcagtggcgcgatctcggctcactgcaagctccgcctcctgggttcacgccattctcctgcctcagcttcccgagtagctgggactacaggcgcccgccactacgcctggctaattcatggta

SEQ ID NO: 11783 - DNA, 1045 bp, Homo sapiens
agtccattctcatgctgctatgaagaaatacacaagactgggttatttataaaggagagaggtttaactgactcatggttcagcatggctggtgaggcctcaggaaacttacaatcatggtggaaggggaagcaaacaaggtggcaggagagagagaagtgccaagcaaaggggggaaagccccttacaaaaccatcagatctcatgagaactcactcatgagaacagcatgggggacccgcccccatgattcaattacctcccaccaggtcccacccacgacatgtggggattatgggaactacaattcaagatgagatttgggtggggacacagccaaaccatatcaagagggatgtgcatttggtctgctcggggccatggtgagtgagacaagtcaggatgaagctgtggtcacccctcctagctgcccatctgcagctcagggactctagatctactgtagcccaggcaccgcacaacttgcttcctgggccaagcagcttcgtgtgggtcagcagcccaattggtaaaatggacactaaactgagcattaggattcttgagttctagctccatgcttcccctggctagttgtgtgactgtggaaaagtcacttttctctgggccttagtttctccctccagaatataaaaggggttgaactcgattccctcctcccttccttcctccctcccttcctttcttccttctttcttccctcccacatgtaggactccattggagacaccaagatgaataaggttttatcaagaggctaaaagaggacacacaaggtagcaaataaaacaaataggcagtgatgagtataattacaaaaacatgggcaagacatggagctggtacagaggacagaatggtttgctgaggagtggggagagacagctccaaggaaggtttcccttggatactgagctgggtttggaaggtgattttatgttcctttccagctccacccctcggtatgccccatgagattctgctcttgttataagggtagatgggatggggaagacagaggggg

SEQ ID NO: 11784 - DNA, 1044 bp, Homo sapiens
atcccagcactttgggaggccgaggcaagtggatcacgaggtcaggagatcgagaccatcctggctaacatggtgaaaccccatctctactaaaaatacaaaaacaaaattagctgggcgtggtggtgggcgcctgtagtcccagctatttgggaggctgaggcaggagaatggcgtgaacccgggaggcggagcttgcggtgagccaagatcgtgccactgcactccagcctgggtgacagagtgagactccatctcaaaaaaaaaaaaaaaaaaaagaatacattgggtgggaattgaacaatgagaacacttggacacagggtggggagcttcacacaccggggcctgtcatgggaagggatagcattaggagatatacataatgtagatgactagttggtgggtgcagcacaccaacatggcacatgtatacgtatgtaacaaacctgcacgttgtgcacatgtaccctagaacttaaagtataaaaaaaaaaatacaatgttattaaccatacagagtcccgacatgcaatagatctcttgagcttattcctcctgtccaactgaaattttataccctttaaccaacatctcttcccctccccacttccccccaccaccattctacactctatttctatgggatcaactttttagattccacgtatgagtgagatcatgtggtatttgtctttctgtgcctggcttatttcacttaacataagatgctactgtgtatttatccaaaggaaatgaaattagtatgttgaagagctatctgcattccatgttcatttcattactgttcacaatagccaagatacagaatcaacttaagcggccatcaggggatgaacgggtaaagaaaatgtggcatatatatacaatggaatgctatttagccttataaaagaagggaatcttgttgtctgtgacatgtggatgaacctggaggacgttatgttaagtgaaatatgccagttttgtttgtttgcttgtttgttttcagaaacatcaggcgccccaaaagccctcccctgg

SEQ ID NO: 11785 - DNA, 1070 bp, Homo sapiens
ctgagaacagagacgcatgtgggcctccagctccagtctgggtcctaaacccaagcctgggaggctgctgggcctgcagtgttgtctgcttctgcctggcttcctgggggactgtggatgttgctgtcagcctcatggttacccagccctctggccttctggagtttctgcaaggcaccagcctccggctactggctggaccagcttggatggacagcagagtgacagggaagacccccttcagatgtttctgtcctagctccaggtctgaggagcagagcagagctgatctgaaaggactcccattgtaaaatggttacaatggtaacttttatgttgtgtgtattttatcccaataaaaagaaagaaatggaaaggggttgggaccaggttggaggtcagcagaagctgaatattgtctatgaaatgaagggcttctccatggtcttggaggccaccttcagttctaaaagtgtcttgtgagtctgtgatatggtcccaactctccccacattttaaccataaacaagtgtggagtgatgataggcaattgaagaatggaaaagctgctggctgcctgttggtctcctagagtgtccaagcaggaattttgtggtcccagctttggggtcggtggcggagggagacagtggtcagaggagcttaaatgagtggagaggagcttaaatgagtggagaggggcttaacacaccccttcaaccagaggggctctgctttatctttttgatatatcgaggctctacataaaaacttatttgaaagaatctactagaacaccaactttctcattgtacagataaagaaactgaggcacagagggaggtggtgacttgctcaaggtgctggcaagtagagaaggcctcctgaatctagaccccatccccaacacctgggcctttgcttgcccctgcgatcgtgtcctctgcctttataaacacagcacatcagttagcggacggccctgtccctagcatcactttggcaattcccctttctttgatcatcatgggaagtgaggacttcctcagcccctgcccctcccctgggat

SEQ ID NO: 11786 - DNA, 1026 bp, Homo sapiens
aattgtgagttcatctagaatctggggtatatccctggggcttgtgtctatgcatgcaataattttttttttttttgagacggagtcgctctgtcgccaggctggagtgctgtagcgtgatctcggctcactgcaacctccaactccctggttcaagcgattctcctgcctcagcctcctgagtagctgggattacaggtacgcaccaccatgtccggctgatttttgtatttttagtagaaacggggtttcaccatgttgaccaggctggtctcaatctcctgacttcatgatccacccgcctcggcctcccaaagtgctgggattacaggcatgagccaccgtgctcagccagtatttcttaaataaagagatcataaatattttgttcaaaatatcttaggcctgatactggaaagatgaaaataactgctgaacacgagttcatatttgtacaatttgaaacagtgccagaattttatcttagaactgaagcaaagggagtcattcgttgttgttagcaatgtcttatttttaaaatgtattcattaattttaaaagggataagaaattaacatttactttacaccttccagatacagaagctatgctgggagcattcgtaggtatttgctcatttattcctcaaaaaaatgctcatataagtgacactgttagatgaatttttaagatgaagaaatcaagactctgacagattaagtaatttgattgaagtttctcagatagcaagagatggcagcaagataccagtataagcatgtctgactaccaatctgtaactttttcaacaacacactgagaaaatccattttcagcttctttgtttttcatttcttccttaatctcagatctttcacctagattctgtctttttctgtttgatgtctatcttttaaaattttcattttcagtgagagtctccatgtggccaactcccaggttttttttttgtcagataatgtctttatttctcttgttcttaaaggatatctttttaagtataga

SEQ ID NO: 11787 - DNA, 1046 bp, Homo sapiens
agtggttggtattctgtgggtggcacagtgaccttatttttgtctgttcttagacacaattatgaaatgaccttgttttgtctcattttattgtggtctcagaataaccttgtcagaggttggttttctgtgagatagtttaggttcatcagaataacatgccttagctgtgagtaccaggccagtttctaaatgtcagaggctgttctttttgttctcaacttgtctaacttttgtttgggctacttttcttcctcctgggaaattgtaagagaatgtatttactcattcaacaaaccagcaagtgggtacctgtactccataccaggcacgatcctaaacacaggacacagtagtgaaatctctgccttcaaggttctccaagtcttggataagaagtcttggataaaattgtgtttcagttaaccgttttgctagtttaaatgccttcttcagctttcccacaagtattccagcttgtactggatactttcaatgattaggaaatactacatgctgtagacaattctgaatgctagaaaattggttcttaccttgatctataatttctttttcttttcttttctttctttttttttttttttttttgtgaaacggagtctcgctctgtcacccaggctggagtgcagtggtgcgatctcggctcactgcaaccttcgcctcctgggttcacgccattctcctgcctcagcctcctgagtagctgggactacaggcgcctgtcaccacctggctaatttttttgtatttttagtagagacggggtttcaccgtgttagccaggatggtctctatctcctgacctcatggtccgcccaccttggcctcccaaagtgctgggattacaggcttgagccaccgcgcccggccttgatctataatttctttcctcgtatattccactgcttgggtctatatctatacattaaagacactcagaacgagttccctgcatgttctctagctgtttacgtagttgacccacgggcaatgtaggtgaactctggattttcatgattccttgc

SEQ ID NO: 11788 - DNA, 1084 bp, Homo sapiens
tttagttcaaagtattcagcatgccaaagtgtcatacttcggggtagtattttctgagccccaacacaaccctcagagagtgggatctatttgccaagagtattcttctgttgttatggttgaaactgcctggtaaggtggcagatgtatggtatttaaaacttaggagttgactggaaaaatggtagaatcacatttcagcaagttgttggactaaatacagtcgtgcgcctcctaacaatggggatatgttctgagaagttcattgctgggtgatttttttcattgtgccaacgtcatagagtgtactttcataagcctgctacacacctaaggctatatggaatagcctattgctcttaacctagaaatctgtacagcatagtattgtactgaatactgtaggcattcgtaacacaatggaaagtatttatgtatctaaacatagaaaagatacagtaaaataaagtgttaacaatctttgggaccacttgtatatgcgatccatggttgactgaaagcttttatgcaatgcataattgtgtatgaaacataagaaactactcctatgctgagataactgcataaatttactttaataacccctaatttccatatttgcaataatttcctataatcagtattcttcccctctcatttctggaatatatttccagataagttagaaagtttatcagtacatttccctatgtttttaagttaagtttttatccagtagaaactagtctgttggtctggatttggtagttgcacattatggttccttcttgtgcatcatataacaatagtcatcatcttagtattttcgattcatacgtataatactctcttcaagctgcattagaggaaagtaattacttgtatttgattttagcaaaaataatttagaataatgagaatgtgctctctgcttatatattcagtttcactatctgtcatcaacaaccttcattttgtatttatatctttatgtagctattattccctttttgttatcagtccttcttaatttttccataacaaaccctttagccacccaagtatatgtcttactcaaggtttt

SEQ ID NO: 11789 - DNA, 1032 bp, Homo sapiens
tattgaatgcgaaaaataagaaataaagccaaactatttctcatcttctgctaaggactgtgaaacttattaacacaagtgtttcaagtacctcagaggcacatacttgagaagtaaagaataatcttggatattccccattggagcataaactcagataataattcttatatctgaattccaagacatacagtgaagacttcaaaagaacatactggctaactctgcagttcagccttaccctaatgagaggattcaagttgagtaacagtgagctttagatagaaggcgttgtctcagttatagtcagaactgagatttcaatttcattttcataggtttagaatcttctttgcacatgtcatctaaagtgtgacagtagggcccaatttttggccagttataaagtctatagtgtttcacctgatccttccagcttcattggatttctctaacagtgcattctcacaggcatgttactaagatttagtcacttttccattatttagaacttatgatcaaaaactttctgtactgttacctggcccactatgttgtctataccatctattatatcatatatactaagatttgtttccagaagtgagctccttgtgaaactgctgaccacaactcatggtgacattgaataagtcattcttctcatgaccttattgaattctaaagctcacagtttactttttctaagtacccaaagccattctttttaggtgctggttttaatcagagacaaaaggacaggattaaaaaaccttgcaagcatctatcttaagctaacggtggagtctctatggaggcacatggaagatttgaaaacaactcagacgtatgtgtgtgtgtgtttgtgtgcgtgcacatgcatatacaggtagctgtctagtttcctcttagagtcatacgctgctaagtggcattaagttaaagtatactgaatatgagagtttatatcatctgagaattaaatttatttttaaaatatgtccgtcacttcaaagatttgctagggtcctg

SEQ ID NO: 11790 - DNA, 1050 bp, Homo sapiens
ctactcgagaggctgaggcaggagaattgcttgaaccagggagtcggaggttgcagtgagccaagatggtgccactgcactccagcttggtgacagagtaagactccatgtcaaaattaattaattaattaattaatttgacatcttgggcatgtacatcaaaataaagatgagtactcatttgatttatttactacttggtggtcacttcataccaatttatgaacctattgcataattggctattgtctcttattttcattaccttctctctgagaattgaagagcagtaatcacagttgcttcctgaatccagtaaatgtttgggatacacccctactagttcaacacattgattgcccattacacttacttataaagcccattgatgaatgtgacttacttaggcatttggtaatcatgattgtatttattgttcacaggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggtaagcagatagaaaaatcctgtaattttatgatttacataatcataatattgatttaacccccaatattatataataatccactttacatttttttaaactaatggatttttgcatctccgatctggttagtagaatcgagtgaaatataatacaaattggtgaataatccttaaccatttatgttcagagagctatagcattgtcctatagtaaataaactagaaaatccaaataatacttagctttggataaggcatgtgcccctacacctctttctcctcctttttttcctcctcttccctgtcttccttctcccctaccccctcttcttacccctctttcttctttttggcttaagtagcattagatttacatacacatagatttggcttaggctgcca

SEQ ID NO: 11791 - DNA, 1052 bp, Homo sapiens
taatttatcttggaggtcatttcgtatcagtccataaagaccatcctcatacttttatgctgttgcatagtagtctgttgcaggatatcctgttattaatcagtctcctcctaatagacatttgatctattgcttattttttgttactataagtagtaatgactactaattgtaaataaccttgcatatgaataattgtgcatgtgtgtgagcagtaagcatatctacagaagagattcctaaagataattcctgggttaaaggacacatacgtttataattttccgtagtattggcgattactctgtatagtatttctaccagtttatattcccactaaagggaggttttgctgtggcaatatgtgttatatataacagagccagctgagtattagaaaatccctatagaagtatatcctaacaaaacctttcagaaaatctcggtataccctcttattcttctaccaattgttattacttttatcaaccctcgcaaaaagaactcatatccatattacgtaaaaatagcttccttcttctcgtacaaactagcaataatgtgatcagaaacattttaaccttattcttagtagtgactaaaagcatgaagattgagatcatgacaggtgtggaaggaggaggaggattctaagtatatttatgagagatagaaagtgtgcagtcaatgacaggaagtttttaaaccacatacggctaaggcagtgcgtgtatatcatgattttattttgttcttgttcaagcaactactttgtggtttcagtgagtcagtgatgcaagtaggtttataaaagactttcttaaagctgcatgttgttatagaaggactttgtgaaaataccttctccatctttttctgtgcacgcctacatgtgtgttctgcatgtttacatcctgatatgcaattacttgtttattctaagacattccattatttttcttactatggttgttatattaacatcttcatatttctgtggtccatgataaaaagccaaaaatgtttatacacatttatatacatttaaaaaa

SEQ ID NO: 11792 - DNA, 1489 bp, Homo sapiens
cacatataggtcatgatatatattgtttcacacagatatatgtatatgacatatatccaccaacctatatatttatgcatgtatgttggtctatagtttgtttgtttgtttgtttttcttacaacgtcttcatttggttttggtgtcaggttaatgggggcattgtaaaatgagttgatctgtggtcatcggtctgatacgatgttttgatttctagaatttccaattgttttcgctctttgctaaaattccttgtgtgttgtctacctttccactagatcttttaacatgttggttatagttttttgaaagtccctttcttttcgtcccaatatctggatcctttctaaatctgtttctgttgattgctttatctcgacagtgggttgggtttttttcttgcttttctggttgtctcttcttttttcttctcctccccggccccgagacagagtctttctctgtctcccaggctggagtacaatgcctacaatgccgcgatcttggctcattgcaacctccacctcctgcgttcaagcaattctcctgcctcagcctcctaagtagctgggattacaggcgtatgccaccacacctggctaatttttgtatttttagtagagacagtgtttcaccatgttggccaggctggtcttgaactcctgatctcgtgattcgcccacctcggcctcccaaagtgctgggattacaggcatgagccaccgcacccagcctatttttcttcttttcttttttttaactgattactggatattgtgggtattagaagagactgaggttaatagtatttatgtccagaaatgaacaatattaatgtgaaggttgtgtacatcttatcagcagttgaggtaggtttggtttccttttttttcccctttgcgttagactttatttattagcttattcactggaacaatgcttggagaaatctgaaaatgcatggcaagtttgttagagatcttgctttcatataatttgtagactttatggctttatttttaaaaaacttttaatttttttatttcagtaggtttttggggaataggtggtgtttggttacacaaataagttcttgagtggtgattctaagattttggtgcatccatcacccgagcaatgtacactgtacccaatgtgtagtcttttaccccacttttatcccagcttggtttcgtgtctgtcagtaccttcaatgtaccaccggcttcattttctactggtgctactttgtgcttagaacggcacttgggggtccaggaggatttttctctgtctctctgctccatcccttgctttcagcagccttcgcatgccagagctgcagagtggagtctgcctccatacttttgctctgcctcccagcagtaggcttgttacttgttacttgaatctaggctcatagttgggggtccggaaggtcactttgttcaactcttctccatctttgttgtctttgtccactcccggt

SEQ ID NO: 11793 - DNA, 1018 bp, Homo sapiens
gagtttgcattttatcctgagagcaatggaatgtcatagaaagtttttaagcggatgaacaacatgatcagataagtatattccttttttaaaaaggaagattactataacttcagtgtagaaaataatgtaagaactgatttgatgggagaaagcctagccataggaagtccagttacaaggctgatgaataaataaatctttaattgatgttgattcttactgcctttaactagattttcttcttccttagtagtgtctagtttgcctttggggtgtgggccggaagtggaggtcctgtactctctcttttctgtgtatcttcttcccacatggaaatctttctaacactttcttactccccttcccccagtcggatctcatgaccacaacctctaagttctccaggatcactccttggtccctgatctgcttctttgactttctttttaccaacggtttcttaagctttgtatttccccacccatgaactctccctaagaattctctctgctcttctctccatggtccttccctattattgagaaccctgccttggaatataaagtactttatggccataattttttttcttaaatcaagtttaaaacaaagtgtctttttttttttttttaaagaagcactttgttttcatcatgaagatggaagtacagggataaacacttgggaaaaactagaataattggctcatagacaaaatctcttgaatggtggaatgttttcttagaaatgggacagcaataatgaaacataatttctttatggacttataacctactgcttttttgttagttctgtagaaatcctgtcaaagaatatgaagaaaaacagagaaagattctgcaatagagagagagaatttgtatataaatttaaagtaggaagtcagtgcttagaactgagagtgccactcaaatttcctgttcaagagaatgccagtcatttgcatggacgtctgatgctgctgcacagtttaccgtgctttatagaaaaaggt

SEQ ID NO: 11794 - DNA, 1033 bp, Homo sapiens
gggggaggcctcgcaagatgaactgacacatgggatggcggcagggatagggatggggccctggggagagagcgtggcaagttctcagcattcgtccgggaagtcgatggtgtgtcatttgtctaggtgaggagatggatgaattccgtctggggcatgttaagggtcagggaaatggtcatgtggaagggtgcgcctaccaagctggaggagaggtgctgcaacttctttctgcctttgtatcattcagacacactgtgttcactcatcagtggttctcaaaaggagaggagcacaccagactcttaagtaagggtgtgtgtgcttgtgtgtggggaggtggggggatggtctgaaaactctcccccggagataaatatattcctaccaggggtgctgtctcctcacctccctctttgggaatcactggcttctactagagtggaagacagatgtatcattagatcgatcagttgatccatatttatctgctcccagtctggaggtctggttctgggagctgagaggacaccaggggaggataagacactttctgaccaagacattttttgatctctcatcttataaggttcgtggtcactttggggagatcatatctgtcacccaacataaccatattatgataagagccaaaagtagatagggtcagttcacgtgcttcgagttcacagggactatgggtctaaggagccggggtggaggaaacagacatcgtcaatggtggcttcacgggagggagatgggatctcaactgggcccttggaggagaagctgccacgacctcccccaacaccttgacattaaatgaacagacacatgaatgagggggaaaggaagactaattgggtccctgcaaggtggctggatcggggtcagaccacaaggccgatctcagcgtcgcctccccactctgcagccccagcacaggaagtcacactttaaagcctcctctggcggaaattgtgggggagttggaggggtgttgggccaccccctcaactgtctctccaca

SEQ ID NO: 11795 - DNA, 1053 bp, Homo sapiens
tctcccgccccccaaagtggttgatcgttggaacgagaaaagggccatgttcggagtgtatgacaacatcgggatcctgggtaagacttgaccttcgacgtggtacacaatttcagaatggcaattaggctgtaacgactatcttttcctcctgtgtagagagtggtactgtgctcaatagtaagagcaaacacttatgtagctgtttacattgtgtttggcactgttctgagtcccctcgtataatttttacttcataagtaaaaataaacagtttttccaaagttaataaatggcagcatcagaattttaaccccaagcagtctggctccagagtctgtgctattgttctgtactgtaatgttccttgtctataggtgctgctcagcaagatgcaaccgtgggttgaaagcttagctggtgtaggatgagttctcttgtcttggatctaatgtgttctctcacattacacaggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaatttgatagccacatacttttgttttcctctagatgctgcctctactcatgtagactatgaagtcttgactcatcctagatcttaggatcttaggtttgggcttcacaccacttgccttttacagtctagctatacctaattcctttaaaaagaaaagttggtgagaatgttattggcgctttttgacataatgctgttatgttaatagtgtttctaaagagccttccacactgaaatgaaatataagagaaaaatggagtc

SEQ ID NO: 11796 - DNA, 1110 bp, Homo sapiens
agtttaccagatcacagatcagcaggctttctttttttttttttcccataaatgataatattttattatagaaaaagcatcccaaatacaggatttcgtaaacactggtaggtgaacaagtgcaattttagaagtaaatgcaaagtaaagaggcaaaacctacaagcattttgccttcagaagaagatgtagtgttctcctgcactagtgatcccacccagaacacaaatgtggctctgtctcccgtgaaagcatcagatttgctttctgagctcagtatgcccatttcaataattgcaaagtgatggcaagaagtggcgttgaacacatgactacagacccttgacttaaaatattgagacagggacttgctctgtcatccgggctggagtgcagtagcgtcatcacagctcactgcagcctcatcctcctgggctcaagcaatcatcctgcctcagcctcttgagtagctgggactacaggtgtgcactaccatgtccatgcctggctattttttttttttctttttgcgttgtccaggccagtctcaaactcctgacctgatcagcaggctttctgagcttgagtcctgtcctcgtgctggcttccttagttgtggtccatgttatgtgtccttgggagtttcagttgtcctgaaatcatcgttctgccacccagaaccagcctgctctgcccctgcaggagttaactacgcgctcagcagtggcacaggcacagttctggaatacatccataaccacaggaacaactgctgttctcaggagcattttttttttaaactgaaggagcgtttgtccttggtccagctgtccaggacaggaaggagttattccttggggactgattagctcatcgctctgcagcacgctgctgtgtagagagccttagctggattcggatggtgcgtgatactggcagtgactcttcttcctccctagattccctgccctcattctggtctctttatagcaacactgtaactcctgtcttctgcctggaaggcctgggatggcttgagcgctacactgggaggtagctaaaggcctcctgcgttctattttcagctcccctgccttgtgcgtgaccttt

SEQ ID NO: 11797 - DNA, 1031 bp, Homo sapiens
ccatttcttcactccttgaatctcttgtgtcttttcagggcagccaagaggagattgggctctgttgaagcccctaagacaaataagtctcctgaggccaaaccattgcctggaaagctaccaaaaggtccgtgaaactaagagctggatgctacatgaggagtccctttgggtcctgggtagggaagaactcgctaaacatttccggagtgaaaggaacagccaaaggacattctgaggggtagaaagtacaggctcccagggtgtggggccagggaatgtgtggctgccattagtccaggactcttcaaacccttagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcggtgagattcatctttttgggcattcatagaaggatccttgctatttagtttctttcccagattcttgagactgtttcttagtggcaaggataagcctgactagaggaaaggggtttttgtgctccatcactgtttccctactgccttatatcctcccagtgcactacaagtttgaaagagctgtaggatagagcatttaaaaaaatctagaaggctgtcttggtgtaggtatgggaaggtggacaatggtgtgctccactgatgggcacagaaatgcactttttataaagcagttatctcagaactttgaaaaatttgttccttttggctgggtatggtgcctcacatctgtaatcccagcactttgggaggctgaggcaggaggattgcttgagcccaggaattggagaccagcttgggcaacatagggagatcccgtatctacaaaaaattaaaaaattggcctggcacagtgg

SEQ ID NO: 11798 - DNA, 1045 bp, Homo sapiens
aacatgtttttgaagagtagttgataaagagtagatgataaaaaggaagatgcttaactgtgtaactaaatgaaaacataatatgggtatgtatatagtatgatctcagttatgtaaaaaactatgcacaaaaaaacctaaaaagaaaaatatcaggatgtatttctagaaggtgggattatctgttgttaaaaatttttgatattctattttctaaattgagtttttatcgcttttgtataagagaacctaaagggtaaagagttttaaaaatgaggacattgaaaaagggaaagaaaaaagttacaaggcaaagttaaactacttgggtgtgggaatgagctgtccatgaagttcttcataggttcttattaccatctgaaacaatgagaggtgagctgagaggccagtcagaagtgagtaaagtgagttatcagtcgaactcccgtttcctcttatcccttgtccagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaaggtagccagtggctcccctgcctcctgccgattcggcctccctgatctgactgcatcctaatgtacatatatttgttttcaaactttcagagctcctttgtctgggagtttaggaggtgctagggatctttgccatccttgggaggttagtatcttagaggcaatcaaggacagtagttctttgcctttttttttttttaaagagatggactcctggccgggcgcggtggctcacgcctctaatcccagcactttgggaggccaaggcaggtggatcacgaggtcaggagttcgagaccagcctggccaacatggtgaaaccccgtctctactaaaaatagaaaaattagctgggcatgtggcgcaacgcacgcttataa

SEQ ID NO: 11799 - DNA, 1030 bp, Homo sapiens
ggaattggagtagggacggaactcacaaatggctttatggagaagatggcattggaatgaagttttgaagaatgcgacggagatttttttggtagaaacagaagggtatctgaacaaagggattaggttgggcaaagatgtgagccagcaaagcttagtatgtctggaaatagcagatagcccagttgagctgtagggaaacatttgtgttgggtgatggtgggaggtaggttggaacgagaaaggtggacgggctagaggtcagtaggtgggttcttggcaccagataagagagtttggactttacgctatcgttaatgggcagccactgaaagtttgtgagcagagttttgataggaccaagggaaatggaaacagcattcataagattataaaactgtcatataatcatgaggtgttaagggtctgggctgtgatgctggttgtggaaaatgaaaagggtaaagataaaggaaacaacaccaaagaatttattggacttagtgacttactgtaggggtcagcaaacctttttttctccccccaaaccaaaaacggttaataaaaccctttttttttttttttttttgagacaaagtcttactcagttgcccaggctggagtgcagtggcgacatttcctggctcactgcaccctctgcctcctggcttcaaccgattctcctgcctcagcctcctaagtaggtgggattacaggcatgtaccaccatgcctgactaatttttgtatttttagtagagatggggttttgccatattggccaggctggtctcaaattctggacctcaggtgatctgcccgccttgtcctcccaaagtgctgggattacaagtgtgagccactgcacccaaccacaccttttctattaaagggccagatagtccctttgtgggacatgtagtctctgttgcatatactcaactccatctttgttgtgtgaaagcagccacaggggatacataaatgaataagttaggatgtgtttcagcgtttcatctatggatattaca

SEQ ID NO: 11800 - DNA, 1473 bp, Homo sapiens
aattgcagacatttagatgtgggtctatccaattggataatagtgtgcaacagaggagaatgttcttcctttaggtatagtctcaataacatttcttcccctaggtgctgctgatgtagagaaggtggaggaaaagtcagcaatagatctgacccctattgtggtagaagacaaaggtgggtgtttggagaagttgattgtggttcagaagaactctaaaaccagaagcaaggactgtatctgccctgcctccctgtccatactcatctagccattttatcccaagataaaagactgtacctgtccccacatttagttgtcagtgggccaatggcaccattttctgggtctgagagacacccaggtggagaaggggtgtaggtggatggattcttgtagcatacagtgttctgggtaagggcgatggtgctgggctttggctggagctgacatttttcttccccatattctgtagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactggtatggaaatgaggggcccaccagggttagaaggatctgatgtgaaattggggttcttgtcagaaaccacggtacagggactttacctctttacctctgtttgatgagggaatgccaaactgatagtgggttctgtggagaaagccagaagcaaattatatgaaatggatccaggggtaggggatggtgggggacaagaataagtagctttttcaattctcacagatgtttgcttccccccacccccaaccttccctaaattcctcctcagagttgcactccctttggcagaatgaagagcgggcagccacagttaccaagaagacttatgagatctggcatcgacggcatgactactggctgctagccggcattataaagtatcctttgcctgaatctgtactgaggcttttggtgaaaggttctgaaggtcttttagtttgaggttcttactttccttgttttgtttttcctgagcacttttccaatagccatggctatgcccggtggcaagacatccagaatgacccacgctatgccatcctcaatgagcctttcaagggtgaaatgaaccgtggcaatttcttagagatcaagaataaatttctagctcgaaggtttaaggtgagcggttggggaggaatatattgcttaagtgacaaacttgaaagtgcgtaacgtcctgcagcagagggagtctgtccatccagcgcactgttctcactttcttcattctatggaaggctttgctcccaagtaacttacacattagggttgaagacacacagaattgaaagttaactaactgtacatgagctgtaggtgactatgtgtccaatcagtgacacactagtgcagag

SEQ ID NO: 11801 - DNA, 1100 bp, Homo sapiens
tctttacacagggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggtgagccctgagcctcttgccattgtttctagggggccaggcgcagtggctcacacctgtaatcccagcactttgggaggctgaggcgggtggatcacttgaggtcaggagttagagactagcctggtcaacatggcgaaaccccatctctactaaaaatacaaaaattagctgcacgtggtggcgggcacctgtattcccagctactcagaaggctgaggcaggagaattgcttgaacccgggaggcggagactggaaggccaataggaaaggagcctgtagctggaattgggtcttcaacttcttgtcccattgctacaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctggtaagtctgcctgtcctatcattttctgtccctctctttttgtcctggcctatttttctgctcccctgtgctcagttctaacagggtagtctggcaggacacacagcaattccctctcagtttaggagggccgtcctaagaatagggctggctcttaaaggcacgagaggacaatttaagatgagacaaactgggaagaaatgaccttctctctgatctagtaccttcttcctaattgattgtcttttattgttctgcagaagatgggataaaaatagaggaaaatagcctcaaagaagaagagagcatagaaggagaaaaggaggttaaatctacagcccctgagactgccattgaggtaagagatggggtgactgaatgccatactaaagacaaatgtgtaagtccagtcttccttttagttgctggcctgtctgcttcatctgttttgttttt

SEQ ID NO: 11802 - DNA, 1347 bp, Homo sapiens
tgactggaacccccataatgacattcaggtgagcagaggcagcaggcagccttaataagtaacatgttatgctagaaaggcatagtggcctctatgagggctccaccatctggaattaggtttttaagtgagaaacaacagattctttttgtgttgtttaccttattgtaagccagagtttggttagctgtgatcctattttgggtaacatgataatagagggtggtgtctggaggcaggggtgcaaaaggaagtttcctatgaatgtaggctgtggaccttgccttgtactgaatttagaatattatgtggaagtcaggataagagtggcaccaggaaaatacaatttctggctttatttcctgttcaactccaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggtgaggtagtcaggaacttacgttttggtgtggggcttggcctctctaaaggttagggagaatctttgataccaagggtcttgtgggacttgctttttccactgcagctgctgaaactgactttggggatgtgggcccttgattttttataggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggtgagtatgaatccaaggcaatcctgtgcttggtaattggtctgaaaattggcattgagaccaaggtggtatttgagacaagtggaaaatatctgtaggcaaattcttatgttgatgaattgatcctcttcctttgaaaacaaagctgataacatgactaatcagattttcatctttgccttggttgtcagaaaacttacaaccaaatatcatgctcacaacagttattttggctctttaccagaatgtcattttctcctatgtgttttattaaaccttacaaatgaaattttgaatgctacctcatctctctagagaaaaggcagaagatcctaggtaatctatctctttgtgttttctggtttttatttaagagacagggtctctaccaggtgcagtggctca

SEQ ID NO: 11803 - DNA, 1044 bp, Homo sapiens
cccccactttgggttttttctagtactaccaattcattaaggggaaaacttgtagatggagaggagaggggaaaattgtctctgccttccttccttgtatgtgacagcccttggtggccaggcctttaaaaagaatgtgaggagtgggatgcttaactattgggcagtgaaaaacttgaaattttgtagagatttgctagagctctgttttcattggatttcacctttctccatctgcttcaccagttcttccgggtattgaatggttactcactccagcacaagctgttgctgactgggacaccattacaaaacaatctggaagagttgtttcatctgctcaactttctcacccccgagaggttccagtaagtatgtgtttatctgtaatcggctcataattgtgcctctcattcttcctgttgcccatttcctgtatcacttttctttcttcctttctccttctccaataacttttttcctttttctttctgaagcaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagtgagttgggagggacagaagcagactccatttagacatctgccagtctgcagagtgtttcctattcctcccccactcagcttcaaggcatctggtgacaggagcaagcaaggcctgaagaaacctgatgctagggcgctggagcgcatagttcttacttattttaggttatacctttccttatttaaaatggtggtggtggtagtgcttgtgcgttaggtgtccttagttccaaagtgggatgtgttggaagaaagatctcagttgttggcactgcattattagtcattgaaaggctctcaagtctaacctgtctttctaccttgcccatgtaggaaatactacaagtacatcctcactcgaaattttgaag

SEQ ID NO: 11804 - DNA, 1055 bp, Homo sapiens
tcttccacatcccctgacttgggctagtgggcagaggaatgcctgtgctggggccaggggttcagggaggagtggatggcacagtgctgtcatcccttctcctcccctctccccactcccggtgctgaggctgcatcagaccctggtagggaggggtgccgcagccactaacggtatgtgctctccttcagccctctcccttcggagggacgtggtcttgcccactgtccttttgcctccatgctgaggtcggtgctgtatttcagagggagggtccttttcattctccttgctttgtatttaaggactggggcatagcatgggggcagtcccccagacctcttcattccccctcctgtggtgagggctaggtgtgatcaacacttttcttctccattcccttcctgcttttttcatggtgggggatccaccaggtcatctaggctctggccctagttgaaggggcaccccttcctctgtgccaagaggattcatcctgggagagggggcaaggtggaatgcagataactcacatgtaaaaggaacttgggtaggtaaataaaagctatacatgttggcctgctgtgtttattgtagagacactgttttagtaaacatgctgagcattcattttgcgtcctctgggttggatgcaatgtgagaggatggcatgccagaattaggacacgacatgaaaccagagtggtgcctctgtccgagaacttgtaagttctcaacttgggaaagacagaggtgctggagggtaggcctcagaccagggggtctccaaaactttgtaaatcatgcatcttttctccataaaacatctttcacttaatttccaataaatgatgtatttgtgctatacatacgtactgctatactatacattagcttgacttctttttttttttcctttgaggcgaagtctcactctgttgccaggctggagtgcagtggcgtgatcttggctcactgcagtctccgcctccgggttcaagtgattctcctgcctcagtcttacaagtagctgggactacaggcacatgctacca

SEQ ID NO: 11805 - DNA, 1034 bp, Homo sapiens
aaggacacttggtaggcaaccctggagaaaaggggggtaattacctggggatgtaggaaaagctttacagcggaggtgatgtttgaatagggtcttgaaggttatttgccagtgaggagagaaaaaaggaattccaggttggggaaagcatccgcaaaggtactgtgatgggtttgtggcaaggtcaagggtgtttgatatttatgactcagaggtcagcgtatttgatatttatgaatctaaggtaagaaattgagaaaggagactggagaaagaggctgaggctagattggacaaggtcttttaagccaaacgaagaagtttgcattttaaagtagagtatgatttttatagaggaaaatgactaatatatggtaaattggagcatgatattgttgataacagagatcaattagtgataacattccaggacagagataagaacctgattttagggagttacagaagtatttaggagttaaatatgaaaggactgactgaatgactgagtggttgagagagaaggaagaatctaaggtggcttcttcctgcttagaaagtgaggtagacaggctgggcacagtagctcatgcctgtaatctcagcactttgggaggccaaggcgggcagatcacttgaggtcaggagtttgagatcaccctgtccaacatggtgaagcccagtctctactttaaaaaaaaaaaaaaattagctgggcatggtggcatgtgactgtaatcccagctacttgggaggctgagtcaggagaatcacttgaacccagcaggtgaagattgcagtgagctaagatcatacataccactgcactccagcctgggtgacagagaaagactccgtgtccctctcaaaaaaaaaaaaaaaaaaaaaaacaaaggctggtggccaggcacggtggctcatgcctgtaatcccaacactttgggaggctgaggcaggcggatcatgaggtcaggagatcgagaccagcctggctaacatggtgaaaccccgtctctactaaaaataaaaaaaat

SEQ ID NO: 11806 - DNA, 1030 bp, Homo sapiens
gcctgtagtcccagctacttgcaggctgaggcaggagaatcgcttgaacccgggaagcggaggttgcaatgagccgagattgtgccgctgcactccaacctgagcgacagagtgagagacttcatctgggaaaaaaaaaaaaaaagagttttgaccctgtgggccccctgtgaaggtcttagtgttccctaaagatccccatgcctcattttaagaaccactggactggtgagacgggcataagctgtcttgggatcctggtatgtgctacatgaggtatgcttccacccttagcctgtagcttctcaagtttcatttgaaacaatttctactttcttcagatagagggagaagctgggaggcctgacacctacctttttgctttccatcgaggtcaagggggcaggaggaaagagtacaatgtattcattctggtttctcccaattttctcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagtgagtgctccgtttcttctctccttcctcatagtcctctaagagtacagtccacttcaccccattttctgggtagagatctgttgcagtgaataccctgcctccctagctccaacttagcagaacaggtaaatattcagaaattaattagacccattctgaggaatttaggggatgcctgatctcctaatcctatagagacgcataagctgtaattcttcattttacttaaacataaggcaaaataaagccacttgaaattttgaggggagctggatttcagttaggcattttcttcttcttttttttttttttttctttttgagacacagtctcgccctgtcacccaggctggagtgcagtggtgtgatctcggctcggctcactgtaacctccacctcctgggttcaagcgatt

SEQ ID NO: 11807 - DNA, 1050 bp, Homo sapiens
ggtgtaccccactttatacaataaaagtgttcctggaaaatgtttccatcatatcatattataaaggtacctgacaagtttgattcatttaaaggcattctcttatatatcagttcataaaattaaaatcccttttaagttatcgtatagaaatctagatttttatgtgtttgtttaaaatgaggccattgtgagatggagatacatctatatacaatttgtggaagtagtagaaggatcctttaacactctatagagcccttctaatggatcagggtcctctcattctgccctttcttcactgtgacccacattaaagctatctctggactttccaaactgtatatattaaaagaaatgcacatatacagttggaagaaagcctcatggggcttttcacacattcagtatttttggaattcctgaatgaccatccacccaggagactacaaagaactttgaaattgaagggagacttattgtatcctaggtaaacagaatttcttcagaaactcagaactcttgacattccaaagaaatttttttttttttgagacggagtctcgctctgtcgcccaggctggtgtgcagtggcacaatctcaactcactcttaacttctgccacccaggttcaagcgattctcgtgcctcagcctcccgagtagctgggactataggtgcgccaccacgcccagctaattcttttgtatttttagtagagacagggtttcaccacgttggccaggctggtctcgaactcctgacctcaggtgatctgcctgcctcggcctcccagagtgctgggattacaggtgtgagccactgtgcctggcaaaagaaatctttttatcacagtgaatttctgttttgatgcatgtgtgggtcagccataccctcttcagtggtcagtagcatttgactggctattggggcagttgggttctgttactctggtcaagtcaacgtatctcccactctttgttcccatatataaaatgggaagatcagccatgccttcatctgtcttgtagaaatgttttgaggcaaag

SEQ ID NO: 11808 - DNA, 1058 bp, Homo sapiens
caggctggtctcaaagtcctgacctcaagtgatccacctgcctcagcctcccaaagtgcaggaattacaggcatgagccaccacacccattctctccatcttaattctctacttaattcccaccatttatcaccactcttatctcttgtctgtcatttctttccactagaaggttagacagggattatgcattgagacttgaacccctagcattgtctgcaaaatctatatgtaggtagtctaccgttgttcaattcattaaatatgtaattgtgtcttaggtgataaagtcgtatgttggggatatttgtaagatacagatgtaaaagatgtgattgctccttcccaaaaagtttggcaagattgaattctcttaaactgtgatctgattgtatcttgattctgttgcctgaaaacgtgagactcccatctttgctttgttttgttttttgtttgtttttgagacagggtttctctctgttacccagactggactgcaatctctactgacttcagcctctgcctctcgggcttaaatgattctcctgccttagcctcccaagtagctgggattacatgcacctgccaccatgcctggcaaatgtttgtattttttgtagagatagggtttcaccatgttgcctatgctggtggactcaagcaatctgtccacctcagcctctcaaagcgctgggattacacacatgagccaccgcaacttgcatgttttgttttgttttgttttgttttgttttgttttgttttgttttgttttgttttggagttggggtcttgctctgttacccaggttagagtacagtagtgtgttcatagctcactgcagtcttgaactcctgggctcaagcagttttcccacctcagccttccaaatacctaggattatgggtatgcacgaccgcactcacctctttttttttctttttcttttttttttttcaatttttttttttttagagacacggtctcaaatatattgcttagcctggtctcaaactccagacctcaagtgatcctcctgcgtaggcctgccaaagtgt

SEQ ID NO: 11809 - DNA, 1012 bp, Homo sapiens
tcatctagaacggtgtcgtcggcgggaggaggggagagtatgctaccggccagagctttgggaagaggatggctctgagtgggggagggaaaaaccgagagggttggaaaaattttccatggccctaattgagaaagaggtttgaagagcccttccctccctagagggttgtgtggaacacctggagtagggtctccctggagtttagggggtcagttacaggatttggaaaggacagtgctctgagagtccccacactgagtgggtgtgcaaaaccctggccacctccaagtatctgagcttccatatctttccagtgtggagccccctggagctgagatcaggatgttccgcttcatgagggacgtggagcctgaggatcccatgttcctgatgtgagtattccctccccctcaagctctcccactccaggtctctgagcagttcaggcagacatcggggttcccattgctaggaatggttggaactggctggatacctagctcctacctagcaggaagtaggcatcggtgccactgttgctctgtgcgtatttttttgcagggtggtggagggattgacagtttggcgcttctgccatccatactatgtgctcactccacagggatccctttgctattcaccgtcagcatatgagccgtatgttgtcaggtggctttggatatagccccttcctcagcatcacagatggcaacatgccagggaccaggcctgccagccgccggatgcagcaggtaatgatgctgagacacacctgagacccaaagaaaggttggaggttagttaggaaagcacttaattttcttgcactacagccaactgagcaagtgaaatgctctaggagttggggaaagggtcaggaaaaagggctttgtgactcccttttgagaggatggaaaaaaattgaggccatgggcctggtttgggattgtaaagagataggatgtggtctctaatttctgttcctcatgtgttcctgtaggctggagct

SEQ ID NO: 11810 - DNA, 1033 bp, Homo sapiens
cgtcccaacatctccttcctcccagcacccagctgcgcacccccagccaagatagggtttccctctcccctcctctctctcttctttcctcctctcccctcatcctctcttccccagtctctctccctccttcccttgcctccttcccttttctttccttttcccaaggcctcttccctcctccgcccaccagcatccctcacctgatcaagaagggttttaagacatttggaggccagtttgacagcctggtcctcttggggctgctgcggtatcaccagctcaggctggatttggtgcaggggtgggagtagtggggaagggaaccaggcaggaggtatcctcatccccacctgccccactcacatccgaacactagcaattgcacctcctccttctggtcctccacttcacagatgtaagtatctgagtcttctatcttaagattcttgatgatcaggggaaagtttccttggtcccaaaggcttcttcttgagtcagcgcgatcattcagcttggatggacctgggagcagaagacatatggggggggactgaggcgccctggagacagggcacctctggcaagagaatgcccacggctcttctgatatcagttgctaatttcctgcaacatctgctcctcgttctaatcagagaaacccggtctggcaaggaggtctcatcatatccatttacctggctgggacagtagctcacaaatacaaataaaatcatatccttatttggagagcaccaactcctacatgccaaatactttacaggcatcatctcagtaatctccacaataattccgagaaatagatactgtcaacactgttttgtttattttgcagatagagaaactgagactcagagagattaggtaactgcctaaactctcacatattgagattaagtaattacccaactctcacacattgtaggagaataaaccagtacaatttctttggatggtgatttgtaatctatacagaattacaaatgtatatacaaaaccaaatgtccatcaa

SEQ ID NO: 11811 - DNA, 1043 bp, Homo sapiens
aaggccgccagtgctggggaatcggttttatgtttgggcatatccatatccagggcactctggagagagagaagctgtggtctggctcctgggctgtgtgtgtgagtgcatgtgtgtgtgcatgtgtgagtgtgtgcatgtgtgtgcgtgtgtgaatggtgtgaatgtgtgtgtgtgcgcgcgtgtgcgcgtgtgagtccatgtgtgaatgtgtgtgcgtgtgtgcatgtgtgtgaatgtgtgcctgtgtgcgtgtatgaatgtgtgtgcgtgactgcatgcatgtgcgcgcgcgtgtgtgcacatgtgtgaataatgcgtgtgcggatgtgagtgtataagtgtgtgagtgtacgtgtacgacagtgtgtgggtgagagtatgtgcgtgaatgtgtaagtgtgtgtgtgcatgcatgtgtgagtacatgtgtgtgtatgagtgtgtgacagtgtgtgagtgcatgggtgtgagtacatggggtgagagtgtgggtgtgagtgtggatgtgtgtgtagtgtgtgtatgagtgtgtgcgagtgtgtgagtgatgtgtgtgcgtgtgtgagagtgtatgggagtgtgtgcatgtgtgtgagagtgtatgtgtgtgagtgtgtgtgtaagtgcgtctggatttggagaaaagccaggagccagggaggggggctctcggtcaggtggaccccatccctaggctgtagacctgagggagtgggaacttgtagaattacaactggcagcctagagcccaggaccacaacccacctcacttcatcacttctatgcctccttttggggcctccaaagcaccctgggaccacagaggacaccatacccataaccccccaactcaggcattgggaggccgggactctgggtggtctctgccaaccacaggaaggtcccgcagcccaggaggcagaggccttggaacctgggtccttacccttgatgttggattccagcaggacctgtcccgagtcactcagcagacactgccacatccccgcctcagggttcagcacccacaccgccttctc

SEQ ID NO: 11812 - DNA, 1064 bp, Homo sapiens
gggctaggtctcacccaggagccccactcacaaacactcccatgatccccacaatcctcgccctgtcagcaggcaggctgcccccaggctcaccccagtgctcagcattgcatgatggacccagctgagggcagatgtagagggcaggggaggagactgagggtcagcagaggcaatcctcagctttcatactgggcggggccttccttaagcatccctgcaattgatggggcaggcaagctggctactttcccaactatgaggctggctggggggttctggtccccatgctgggacttccaggtctcttttgcctctggttcttgaccagtcaggaatcttctggatgccccagggatttgggggtggggctcagccccctggacaggctgcaagggaaagatgagatgtgggagggagagggcaaaggtagggcctgggctggtctccaatcagcctcctgtgccccctttcttgaaactataggcatgactgattactaaggccctgagggtcattcagaacattcctttgccttaactctgacagctaaacaccccacacagatgagagccgcactcttccagacctctagggaagaaggtattcccacctccctgtctcctttagcccttcctcctcccgctggaactcccaggttccttcttagaacatcccctgctcagcactactccacccctatcttcaagtccctaaatgtctcttcagaactactgatgggagacacaagactggtttcctcttgagggttcacagtgaactgggatatggcatcacagccttcctcccctacctgccggtctcctggatgcaggggtcttggtgcttagcccctacttccccaaacctgggtgatcaccctccagctacccatatctgggaaaatgggagaaaggagtctgggaccgaagggggtgctagggaacctgaaggcggggaaaccgctgacatcagaagcatccagaaatggaaagagggggaactagggagaaggaggagagtttgagcagaagagaaagagggggcaaagtggtagtatctga

SEQ ID NO: 11813 - DNA, 1393 bp, Homo sapiens
ccagcattagaactcgatagcactcggtgttaggaagcacagaggaaaatggccaagtcttggcttttcctgcacctcttcgagcagagaggcttatgttacaggtttgcctgacaggaagctaaggcagtgcatgttgtattgagagtgaagggttaggggtcgcaaccttcctttcagctccccagtcccctcaaaccacccctcccttcccctcttcacccctgccctcaggtatccctgttgatccgccgggagctgacagagagggccaaggacttcagcctcatcctggatgatgtggccatcacagagctgagctttagccgagagtacacagctgctgtagaagccaaacaagtgggtgagtcgcaagagccgtggggtgagggcttctgagatgcaggaggaggaaagactccatgggtggggctcctgacccaggacagggtctccctgactctctcccaccacagcccagcaggaggcccagcgggcccaattcttggtagaaaaagcaaagcaggaacagcggcagaaaattgtgcaggccgagggtgaggccgaggctgccaagatgatatccttctgctggagagatctcagcccagcccctagggcacctgagttccccattctccttcatgggcaggctgatgagactaaggcgaatgcgactccgtgctctctggcccttggctccttgttgggggtggggactacagatgagatctgaaatcttagtggtagtacctgagccatgactccccactgtaaggccagatcaatagcattggtggccttgccttcatttctggtgctgcccctagttcctggcagcagcctgcagggaggcccacaggtggggtccacggtagggctgggcacaagccacctgagcgcaaccttggatctgacagcccagaggaggactggagcaagggagtgtggtaaggacagggccagggattgagacctgcccttgcgtgtaccttaaccctcctcaccttggagaagcactgagcaagaaccctggctacatcaaacttcgcaagattcgagcagcccagaatatctccaagacggtgagtgtgtcagcccagcgtctctgatggggctgccttgagaaagtgctttcagttaaggcacattgaggtgagggaattcgaaccttgcttgttccggtttctactcagattggcttctctggccggcgcggtggctcacgcatgtaatccccgcactttgggaggccaaggtgggtggatcacctgaggtcaggagttcgagaccagcctggccaacatggtgaaaccccatctctactaaaaatacaaaagataatgagcccgctgtggtggcgtttagctatattcccagctacgcaggaggc

SEQ ID NO: 11814 - DNA, 1026 bp, Homo sapiens
cggcctccgatcttgtttcctgcccctagtcggggccgcttgggtggcagagcatcccagtcctgtgcctgctccccaccgcttcgttcacgaggcttgaatccatcactgggcgcggccatcttgcaacaataccggaagttgcgctaacgctcttaaataagaacagcgcggcttctaatcacaaatttccttccggctgccattttgaaagtgggccaggaaatggagatgacttgctgtcttgcgctgccctccctgggagggcagccttccagaaaggggcgggacttccgtatgcgcgattcctgtgcgcgaagttcgggtccgtagtgggctaagggggagggtttcaaagggagcgcacttccgctgccctttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccggtgagcaacctccgcctgctcgccggacgcttccagtccctcccccaaaccccttgccctgtccccgcgcccctccacgggcctagcatttcctctgagcagcggcctggcctgatcaccacccatctccccacagtggaaggcgggcacagagccatcttcttcaatcggatcggtggagtgcagcaggacactatcctggccgagggccttcacttcaggtaatggcgggcagagcctgctgaccctgacctttcacccttgacgccgacccagcagtggctatagtcggacgtgcaacaggattcaacgctgctcttttcccaccctcctcatccctgcccctaggatagtgggtgctgcgagaacctccagcagcatacaaactgttgttttc

SEQ ID NO: 11815 - DNA, 1026 bp, Homo sapiens
catatggggccctgaccaaaaatattgaaccgtactactagaaatccccattctttagctaaaggataatctgacttcacttttaattcttcattgactattggtgctctgaaagaataggaaataatagcaaaacatgggaactcctagatagcatacatttatttttaaaatgtataccatcggccaggcaccatggctcacgcctgtaatcccagcactttgggaggccaaggtgggcggatcatttgaggtcaggagttggagaccaccctgggcaacatggtgaaaccccatctctactaaaaatacaaaaactaactgggtgtggtagcacacacctgtaatcccagctactcaggaggctgaggcagtagaactgcttgaacctggaagacagaggttgcagggagccaagatcacgccactgtactatagcctgggagaaaacaaacaaaaaacatatggtcaacttcccaagtaaactgaccaatgtcagtttaggttcagtcttactgtaggagtgcctgccgtaggccagcgcctctcaacctttccactaagtacattaagatcctaacagtaatcattgggaccccaggtcatcgtctcaacagaagctccagatttcttcaagtcttggccctcttgttttatatcaaaattttatgtatattatttttatattttcaaaaattctccccagatcatcaagtaatattgagatgctgacatagaaaaaagtagatttccagctggtatgatcagtgataaattggacttcatcaaaattaaaagcttttgtgcaccaaaggatactatcaagaaagtaaaaagctatcccacagaataggagaaaatatttgtaaatcataagtctagtattcagatgtctaaagaactcttagaattcaacaataaaaagataacccagtttacaaaatggatatgaatagacagttctctaaaagagacatatacatggccaataagctcgtgaaaagctgtttaatatctttagtcatt

SEQ ID NO: 11816 - DNA, 1831 bp, Homo sapiens
tgagggaagacagaagtcctgtctcgagtctggggcgctgtgccctctgaacctcttcatctttctcttcaacccctgccatgccctctggcctctcagtcgggcccccgccctcttgtgccaggctctacccttgctcccacgacctgtctttatttgtcgctctgttgagttccactgtctggccatgtgtcctgctctgtcattaataaccaccccgcacacgcgcgcatctcatcggtaggcatagggcccctaactttagccctttcggccttttcagccccatattccatatttcatattctgagcgcctgttttgcttattgccagcttatattatactttcgtctcttttctgtcccagtcctactattttctttttataccatgttgctttttttattttccaagccacctacctgtcatttaccctggaatatcattttaatgctggacttgggaaacaggactaacaacctccttaaaatcgatccatactattccaagcgtttattacacgtgtggttcaaaggatgtggtgtatctgaatttatgccacaacaagctgtattacaactggtttataggcttttttaccgcatcctcactccatggtttaatacatggaggtagcatagtacaatggaaaaaagtatgggttttgaaggcaaacaaatcagatccagccttgttgctgctcacaaactgaaggaccctacgcaggccgcaaaaccctctgggcctaatttccttatctatgaaatgaggacaacagtgcctaccacataggattgccataaagtcctgtagaagggccaagattgggaagtacctgtacatatatatacataaaatttaagcagttggaacgttttatgaaggttatagaactttaggagcgggtgagtgggaaggattaagcaaaagctgtaagtggtgataaggaaacaggactggggctagagcagagggttagaggtctgaaccatgagaagtttgagataaagttgggcaggtgtggaaagccttaaatgccagagagaagtttggcgtttatccagtattcagtagaaacactgatatataatatcaccagagggtgttaacccaatctagataatgggataggcattaattcatatttaaacaaccttgcctaatagcattgttactttcctattacatatcaaaccaagatcttcctttcttccaaataaagatcacctttttcttcctctgtggaatcgtaagattttaaagatggaatggaactggggttgtgcagtttgctcagtgtcacccagacatcatccaaatttatcagcaccctagtctaggcttatttgcactacaccagctttgaacttcctactctttcatccttgtttctgacccagttatttttgacattgtaattagcaattagtgtttacatttgacaggacgcagcggcttatgcttataatcgtaacactttgggaggccaaggtgggaggaacgcttgaggccagcctgggcaacattttatttgtctctacaaaaaattaggccaggcgcaggggcacatgcctgtaatcctggcattttgggaggccaaggtgggcagatcgcttgaggtcaggagtttgagaccagcctggccaacatggtgaaaccccatctctcctaaaagtataaaaattagctgggcatggtggtgggcacctgtaatcccagctacttgggaggctgaggcaggagaatcacttgaaccctggaggtgaaggttgtagtgagccaagttagctctactgcactccagcctgggtgacagagcaagactctgtct

SEQ ID NO: 11817 - DNA, 1099 bp, Homo sapiens
tctgacatcaggagttcaaggccagcctggacaatatggtgagaccccgtctctaccaaaaatataaaatttagccttttcgtactctgagcagcaccatggtgtttgttaagaacaagtgccttatgaaaggtggcaaaaagggagttaagaagaaagtagttgatccattttctaagaaagataagtatgatgtgaaagcacctcctatgtccaatataagaaatattggaaagacttggtcaccaggacccaaggaacccaaattgcatctgatggtcccaagggtcttgtgtttgaagtgagtcttgctgatttgcagaatgatgaagttgcatttagaaaattcaagctgattactgaagatgttcagggcaaaaactgcctgactaacttctatggcatgggtcttacctgtgacaaaatatgttccatggctgaaaaatgttcaacaatgattgacgctcatgttgatgtcaagactacgatggttacttctttcatcttgttttgtgttggttttactaaaaaacgcaacaatcagatacggaagacctcttatgctcaggaccaacagtctgccaaatccagaagaaaatgatggaaatcatgacctgagaggtgcagacaaatgacttgaaagaagtggtcaataaactgattccagacaacattggaaaagatgtagaaaaggcttgccaatttatcctctccatgatgtcttcattagaaaagaaaaaatgctggagaaccctgggtttgaaaggcatggagcttcgtggtgatggtagtagttctggaaaacccactagggatgagacacatgctaaagttgaatgagctgatggatatgaaccaccagtccaagaatctgtttaaagttcagacttataatagtggcaaataaaaagttctatttgtgaaaaacaaacaataaacaacattgaaaaaagcaaaattagcctggtgtggtggtgcatgcctgtaatcctagctactcaggaggctgaggcatgagaatcacttgaacctggagacagaagttgcagtgagccaagactgcaccatttcactccagcctgggcaacagagtgagact

SEQ ID NO: 11818 - DNA, 1046 bp, Homo sapiens
ttctgccaggacacagggctcacgcctgtaatcccagcactttgggaagccaaggcagatggatcacctaaggtcaggagtttgagaccaacctgaccaacatgatgaaactccgtctctactaaaaatacaaaattagccagcacagtggcacatgcctgtaatcccagctacttgggaggctgaggcagtagaatcacttgaacctgggaggtggaggttgcagtgagctgaggtcgcaccactgcactccagcctgggcaacaagggcaaaactccgtctaaaaaaaaaaaaaaaaaaaattctgactgcaagtttttgaaaaatgagatttaatgtttagttgccggtatagatttgcatttggaggtgcttttttcccctactgcaggactaggcaatttttatattatttcattagattatgagaacttctagagaaatggaatcatatacttaatggtgattattcttggccatagaatcacacgctgtcacattttgtctgggcctttgcttctcttggactgacagcactctaactggttttctaagagttaccagccccctttttcatttagtatcactactcatttttccttttcagggaatgtatcttaggaaacagctgacaataaatgcagaggttatcctatctgagtttttactatttcccagttcttaagtatagatgtctttctctctctacaggtttgcatcactggttgctgtttatgttgttggggggttcctataccagcgactggtagtgggagccaaaggaatggagcagtttccccacttagccttctggcaggatcttggcaacctggtagcagtaagtaacagggcagctggttgaatttgtagcctgcaaacaaggttgggtgaccaaccatcctcgtttgttcacactgagggggttcctgggacacaggacattgagtgctaaaaccacaaaagtcccagcaaacaagacagttgccctagtacagagtagtaagtggcacagcatccatttctggccttggtaagacattgctga

SEQ ID NO: 11819 - DNA, 1026 bp, Homo sapiens
caagcagcaggtgcattgaatttactcaattgtaaagtggcttggtgatccccaatttgttgtcattgatttgtagtgtaaaagacaactgtacttatgggaagtctagaaacccttgagatttgtgacctgtagaggccaaagaggtttcagaagactacatcaagccatcaaacagtaaagaggcaaggatggctccacccaagctgtcatcattcttttttaagttctttcatttccctcttcccaactttgtagtttgttctgaaagactcacctatacattagactacaagttacatataaatgaattttctgctgcagatgctcttgttacagagatattaaaatgtactatgtgttgcatatgccagagaatcttgtactttctggataattaaaataccatcgatttattacacattcatacgctttatctctttcctctctctcctgatcctacctgccctccccaacacacactctctcccaaaggatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaaggtaaatgagaagaaccttaaagagcttgagaaaatatttatgttaaagtcttttcttcttactgattttatttcataatgtgctctcttttatgacatagagcaaattctcagcccagtttttagttgctgtgtgcagttttctcatctttcacagaagtgtagctatttccaagactggatccaagagaccagcttgtagaaatttaaggattatttgacacctacatataataggactttagaaatatcagataaacatatttaggccgacacatgtcattataagtgtcaggaaccttcagatatataaatctgaagttggtccctaagaaacgagactatccgatgaaca

SEQ ID NO: 11820 - DNA, 1810 bp, Homo sapiens
ttatttaggtctgtctctcctgccagagtgtatacaccagttggacaaggacgctgccttattcatcactggatctatagtgatttgctcagtgccttgcacacaggcactgttgggtaaatattttccggctgcaggaaacagtgaaggactaacctcccccatccccgccccccaccccccgccccccgccccccgcccctctctgcctcgtgggaggaagagcatgaattgggagagcagagccaccacaggaaaccaggaggctaggtggggtggaagggagtgagctctccggctctcaggagcgaaagcttccaagttgggctctccccttggccccttccacccagggaagacagctgggtcctccaggaccaagaatccccaaaggggctgctcccagaggttgtgttgcagggactggagagaggacttcccagtacaggggctggccctctgatcaggtgggggtaggtggcagcagagcatttggtaggaggtcaggagctcataggagatgggattctgccgatgcctgctgaatgaatgagggagggagacggcaggaccagggactggggaattggtactaaggtgctgggtacctgccgagcaccctgtccatacatgatctcagttcagctctccaccttggaaacacaagaaaggatccctggctgaagagggaaacagaggctggaaacaggtacatgggcagggtggtggtggtgagagaattgcccgaatcaactgccaaatggtgcccaggttggaaaagcaaatgtgcacacgtgggttcttcccactctaaccctgaggaattcgaggcctgcgtcctagacagactgggcagtggctagtgactctaggtataggagtgtccaggccctgctcacccaggctagagcttagggagccagaaggaaggaggtgcatgttggggtgcaggacaggagggaaaaatactcgaattgcaaggtgagggcacagtctgtttatattgggttgaattaactcttctcccgatgccactaaagcaggaatcacactgcagatggcactgatttgattggcaagagacatgccaggaagaatattaagggaccaggcccctataattaggcctaatcatagcctgttgtttgaaaagggcatgagggacattcatccggcctggcactgtgccctagacctgctctcctgggtagtggggccctccattgcaacagaggtgtgggtgggcctgggtgagtgtggcaagaaatgcctcggaggctgtacttggccttaaagggctgtgtgaccttgggtaaactgccttctctgaatctctggtcctttccatttcccattctccaggctgagaactgcactctgatacacggttattcccaataataataatgtgtgtatcacacataatgcactgcacctcttcaccatgctggcacctactcctctgctccccctgccagcttcctcagccccttcttctaccctgatggttctctccttgcctcctcaggccagcacttcccatgatctgagatgtctctttccttttcacctttttctccagcagtgagttcctcctcctaactcaggcttccaggaaggatatcctctgcttctcagacctgaacctgcctcgaatactcatgaggacccaggagctactcctcacctcccacttctcctctgtcctgtcacataaccaaggcacggccaactgatctccaaccatctgaggaaccaatcgtgtgagaccacccacacctttcaaaaatgttcctcccctctccttctt

SEQ ID NO: 11821 - DNA, 1035 bp, Homo sapiens
agcttgttgaagagatcccacatcaattccctgccttggcttacggctctcactgcaataggaaagccacggagtggggtgtggggttcagtcacatttgacccccggctccgtgttcctgtcccctgtagtgtttttgttattagacccttttttctccttggtttaggaatgggggccccagggccacccttgtccaggctccctctaccgtagaggtgagaattccagggcgctacagtttgaaaaccactattttatgagccaagtagaacaagaaatgacaactattaaaaaaaataagggatttctgaccagctaacaaccccacagaaaatctgccagggatccagaaatgagactgaggtggcctcagagagcggctccctcctgaaggggatgctgctgctgtcatcctgcccggcaccttggactgcagtgggcggggcctggggtggggatgagggtgcactgaccagcaccgcagcagcttggggaggttggggtgctgttaacatgccatcgtataggtcggaagtggaaatgggagaaagtgtggggtgcctagggaaggaggtgactgagtagggagcctggctgccatcctaacacccagctcactgggcttgagagacttgagcctggtgccagggcagagtgggtgatgctggggcccaggctggcaccatacttgaggtctgccaggcaggtcaggtaggatggcacatcgaccttggggacttggcccaggtctggcgtgtagaagtagttctccgggacacacgggattaggtagggacatgtgagaggtgacagggacctgcaggagcagctagcgagacctcatgtgcaccctgcacagctgtggtggcataaggggttcaatagagcctctcctagagaggagcctggcaaggcccccagcccctgcccctgcccctgcccctgcccctccccctccctgtccacctgctgctccagctgctctctcattgatggacaaggggcactgaacagtttcttctctgtctctgc

SEQ ID NO: 11822 - DNA, 1034 bp, Homo sapiens
gcctctgaggggtcatggggccatgacgctgtggccttggtctacaggtgtctaacttccggcagcagctgctggcctgtgccggggtggaagctgagcgcgtggtggagttttcctgtggtgagaagctgtgcccagggtggggcaggctagaggtcaggttctggcccccgttttctgtgggtaataactcatactgcgaccaggcacagaggcggaggagaccccgggatgggagactcacccttcgtgcgctcacccaggctctcctgctttgctccctgctgcctgctgcgtgctgcccagtgtgactggcgatggtgggtgggtgagcgctgtcagtcgctgttcctgtgctggatgatggggcaggtaaatgccctctctgcagtgtcttacagcacacctgcatcttcagttttcggcccctccctggctcttaccaggtcacgtgatccctccagacaacatcctgccccttgtcatctgcagcggggtctccaaccagccgctagaattcacgttccagaagagagacctgcctcagatggtcagtcccagccagctcgctgcaccacagcctggcctccggcagcaaagggttttctggggcaggggcgctctggcccaccctgagtgttttcaggtgttggggaaattgcacagggacacccacttagagccacacagaatgagcggcgtcgatctagatgcttatggaggaaggtctgagcttccccgcccctcacgccttaggctgcgaaatatgtattcataaaacctccaggcatcctctgaggacgcctcactcagcagaaagctgctagttccctttggctctcttgccctttggttatatctgcccctgccgggggcagggatgtggggcttgggggcatctcctgtggtgtgcctggggtgtgcagcccctgattgtcattgtggtgcccatcaggaccctggacagaagaagggacgactcagtgccagggcaatagggaggccccccagggacgctagtgctgtgacatgtg

SEQ ID NO: 11823 - DNA, 1050 bp, Homo sapiens
atctatgagccttgtgatttggactattttctttctcaacttcagtttcctcatatgaaaatggagaggataggccgggcgcggtggctcacgcctgtaatcccagcacgttgggaggctgaggggggcggatcgtgaggtcaggagatcgagaccatcctggctaacacagtgaaaccccgtctctactaaaaatacaaaaaattagcagggtgtggtggtgggtgcctgtagtcccagctactcgggaggctgaggcaggaaaattgcttgaacccaggaggtggaggttgcagggagccgagattgagccactgcactccagcctgggcaacagatcgagactccatctcaaaaaaaaaaaaaaaaagatggagaggacagtatggtccacctctgtgggctggttgtcctagagattaaatggtgtttaatttaaagagaaagcactagcacttgtgcctcagacctggactcaactgtggaccccctttgctgggacgatagaagtgtctgttgggcttgcactcatctccccaccaatctgtttttccaggcagtctcagtcagagcaccctgaagtttttgctcctgaatccagctgtgcactttgcccaagtggtgaaggaatgccgggcagtggtcattgccggggggaccatgcagccggtaaggacacctttcccagcccctcgttccccaggtgttgggatgagatgggagcttgggagagatgcgttatcagtcctgttctctcctggggccgcaagccagaaagggtcagctcgagcaggcccagtggtgtccactgggtgacactgctattctctcactgctgtgccttttaggctgcaggagcagtggagactcctctgctgctccattctgtagccccaggatcacatgtctcccagagaaagctgttctgtggtttcaaactcaaggaaaaaaatcatgattccacttttaaaaggttcgttttgatgtatatgaatataatagtctttgtaggcataatttttacttatgtgcatagctgttttaaaaaca

SEQ ID NO: 11824 - DNA, 1069 bp, Homo sapiens
ccaccaggggccatcctgctcctttccccacaactttgtcctgctcgtccaggcctgggagacgctgggtctgtgacaggctgaaccgtgtgaggagcagccccctccctggcctggccggcccatcactggaaggcaaaggagaggtggcgggggcaggtccacgtgtgttggtaggatgtcatttagctggcaccatctctttgcctctttctttctcctttgttgcagaacctttgtgtaaatgaagacgtgagaagcctaggttctgtgcagcttatcaacaaccgctgcgtggacatgcagagaagcaggcacggtagccaccaggaccatggtgtagccgcaggtggtctggagagagtgaggcaggggtggcagtgactgaagaccattcagtgtctttcatagaaagaatggcagaggagaccccagttcctccctgagtcccctctccttgggaaaaagtgttcctactctctgggtgagcgtctggtccgaatcgttggcttggagatgattttacgggctctttctggagaacaaaagtaaaacgttacagtgttccgatgagacacagtaggcagtacttgggagggtcttatagaccccaccctgtggaagtgggtctcaacattacacaaccccctctcgggcccgtggacagttgctgtcctctctgttttctctctttgtgcctgtgcccccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccaggtgagggccctgcagggccagaaagccgctcttggctctcactgtggtctaggccatgaggggggtcctcatcacactgtagtttgggggatgccccccaccgtggtcaggttgatggcaccttaacccattctctcctgaggcgtg

SEQ ID NO: 11825 - DNA, 1105 bp, Homo sapiens
tgtctctaaatggtcttggggatggagtgtgggtggttgtttttgttttcaagaaaaaggctgtgcctcctgtcaaggaaaattgtcctgctatggagaaaagtgttactatttttcaaaagaagagaaaacttggaatgagagtaagaagtcatgccaagatctgggttctagtctcattaagattgatgacaaagaggagcaggtatgtttattttattaaccccgagtaagtgctttatgagacatgtgtgtgtcctgagttaggataattgtttgggctttcctctcatcttatttgacccatttggtggaggtacctttagtactggtgcacatttaccttttacctgcagaggaaggggagtaggtattaaagagacctggaagcactgttaattttaaacaagaataatagccctgatgtcctctcattgtatgtgttacatcttcatattttagtatacatcagactattcaatatttagcctatcagtgctaatgtaggacaaaagataaactgccttggatgatatgagtagtcgaaaagagatgacttactgtattaagctcacttctttcaccatcaatatttgagaaagatcaaatttctaagggaagatgatctcttactgtcatgtccatggaaaaaaataggatgaaaacaatgaagaatgcaaataacaatgaaaaatacacattgttctttatgtgcccataaaatctatgtgtgactttcatgctttaaatataaatttatttataattaatttactaataaattaatatacttctcatggatgtatgcatgcatgatcaaaagtttttggaaattaatggtgatgagtgatatttatctgattaagattttttattgctatcaaaatgaaccataaatctatataactacgaatatggtggttcttattcaagtgatatttcaagtaatgtgggaaaggacaatttatttcatgaaaattggttgtgcaatttggatagttatagaggcatagtatacattccttttatactatataccaaatatactagaaagcataaaaattggatgagaattagaaactataaaaatttttgaataaaatat

SEQ ID NO: 11826 - DNA, 1048 bp, Homo sapiens
atgtttctttttttaaaaaaagtattaagttctgggatacatgtgcagaacatgcaggtttgttacataggtatacatgtgccatggtgctttcctgcacccatcagcccatcatctaggttttaagccctgtgtgcattaggtatttgtcctaaagctctccctccccttgccctctaccccgcaacaggccccagtgtgtgatgttcccctccctaggtccatgtattctcattgttcagctcccacttatgagtgagaacatggaatatttggttttctgttcctgtgttagtttgctgagaatgatggtttccagcttcatccatgcccctgcaaaggacacgaactattcttttttatggctgcatagtattccatggtgtgtatgtgccacattttttttatctttatatgtcgttccttttaattttggatttagttcttgtttattctgattccttgaggtgcaatgtttggtttatttgagatctaattttttgatgtaggctataaatttccttcttagaactccttttattgtatcccataggttttgatatattgtgtttccatttttgtttgtcccactatatttttaatttccttttaaatatatttattgacccatttgttcttcaagttcctcctgttactaatttctacttttattatattatggtcagaaaagacacttgatatgattttgatatttaaaagaaattgttgagacctgttttgtgttctaacatataatacatcctggagaaagttccaagtgctaatgagaagaatgtgtattctgcagctgttggttggactgttttgtaaatatctgttaggtccatttgatctagagtacagtttaaacctgatgggtttattttggttgattttctgcgtggatgatctgtccattttaggaagtgggatgttgaagtctgctactattattgtattacagtctatctctccctttggatctaataatatttgctttatatatttaggtgttccactgtttagtgcatatatatagttgtttctc

SEQ ID NO: 11827 - DNA, 1062 bp, Homo sapiens
atggtccttttcactcctcaaaatgcatgcccattgtcttcaggtttgccatggaaagtcaaatgatttccacttcattatgcaagtacgctatcatcttcaggtcttttgtatgtaaaatgtttctgttccagttgtagaccttgatgattgtgcagtatgaaatcgtattgtaattttcttgcatttagatgtcaacctcagaaacaggaacaatcgtcttttgaacttccagtaggcccacagttgttggttgttcctcaaaacaggttgtggctcctgttgaataagatgatccattaaaaactgaacaaggttgaggagaaatagtgcttacgttgaaaaatctttaagtctttgtccccgttctctaacttccttacgttttcgtttatttagctctatccccactatctactagaatttctcatatttaaaccaagatgggagactaggtcattaggaaaatattaccgtctacaattttcttatactttgatctgtcttttatttgattgtaagttgctgatggacagtgatcattagaaactgaattttgtataatactagttttatatgaaactagatttttattgcgctcaggttatgttccttttacctccttccttaataaagagaccacttgaaataatcagactttttccaagtactgtctgcacctcatcccacctcttccccattcatgagatagtgcagaaccctagcacagtcttttccatatagtaggtgttttttaagtttgttgaattggttgctgtcttgctctgtccttagattatttgcctttagattatttatctttggtatttcattggtatcaggctgagtctatttgtatggatatttttaatgtaaatattaatgtaactgagatgatttatatattctattgttagactacttcgttttgatttgaaatgtgtgaacctatgagcatggactgtgctgtaagtttaaccactgacccctttaattaataactggattcctagcatgaatggataatgaagtcgaatagaaaattttaaaaatttaataaac

SEQ ID NO: 11828 - DNA, 1034 bp, Homo sapiens
attacagaggctcattttagaactatagtcagtttgctagccaagataatttcagtggcatcctatcagtttattatgcagatgtaatcctgatttttatgtcattaaaggcttattatcttgtctctcagtagaagttagcagagtatttcattgattgtccaaaaacttttaatccaacagctgtatataataatgcccaagttgtattagctactttgtataaaaatgtggatacagtatcagcaaatccaaaggaaagaaatccttattggattatgtcagcctcattaggcctatatcatctcactgtccttcttgggctcaatacttgggaaaaagatggaaaaaatccattatggcctaagtatgctttagctatcgatgtcttcccaagatctgtctctcctctgccccagggttttgtagcacatcccattttcttggtctgatcctagccacttatttttatttgtgcccattcccctcaaagtgtccccatagtgctcttacttttttctgtcaccctgaattgtaataacctatttgtctgctttactggtttgaatgtaagctccttgagaaccttgctgtatccacagagttagcatagtgccctgcacataatagatgctttcaataaatatttgttagtggaaaggagaaaggaatgaatgcatgataactattggacgcaaaatctgtgttcacaaagaccatccaaatgcttttaaactatcaaatttcttttcctacatttggtaagggtgtggcattgataccctactgggattataaattggtaatggtttttggaaagcagtttggtaatatgcatcaaaaactgttgacatttttcattcacctttggcctagtaatttcatttctgagcatctcttctatggaactattcctaaatattggaaaagctttattatgcatgaagatgctcattgaagtattatttataataggaaattaaccccagtgtctaacaaggagagaattattaaattaattaaaaattactagg

SEQ ID NO: 11829 - DNA, 1011 bp, Homo sapiens
gtttatgtccaaaaaaacattgcctagcctaatatgatggaccttttctctgtgttctcttctagtactttcacagtgtcagatcttacatttaagtctttaatccattttgagttgatttttgtacatggtgttctttattgagtatattatctatttttattctgaaggctcaatgttttgcctgctgtgtatagaaagcaaagaactttaaatcttttttctgaagaaaaacaacctgcttaatgatggaacaaaaaatgtgtccctatcgaacagaaacctgggtaccatgtacttgctatatatactgttaaaaactactccccattcccccttgtacttttagtattatagcttaatcctttatgccccattagtttctataggttatttttctataaaaatttcttgcagatccaatgctattttcatagatgaattagctacttatttattcaacaatcatatgaattctgatatatgccagacactgctcttggtgctagggatacagcaatgaacaaaatagctggtccctaaacttttattcccatgaaggtttcatgctttttcttcttcctttgccagttcatttttgtcctccccaccagcccaggctcagccagtctctagttctccaacatgctttctgaatttagatgtggctactgttctgtgcctacttctgggctgggctaatgagggacctaaagaagctgactgtgctctccaggaaattaaagtcttgttgggaagaaacagataataataggcaaactggttaagtactgaataagtaggttgggtattagatatcatgtcttggcatagtgtctaactggagaaagtgaaagtagaagggaacgaatgtgcacaaaggtaaagaagctaattacggctgggtgcagtggctcacacctgtaatcccaacactttgggaggctgaggcgggcggatcacctgaggtcaggagttcgagagcagctttgccaacatggtgaaacccca

SEQ ID NO: 11830 - DNA, 1033 bp, Homo sapiens
tagtttgtgttgcaactgagagtgcctaattttgtaatgaagcattttgttttttacttctaaaaaaaattctgaacatagctgtatgcactgtatcttatcccctgtgctgtgacactcactgtcagctctcattgcctctccaggctggtgagattggagagatgaaggatggagtcccagagggagcacaacttcagggaccggttcatcgaaatccaacttaccgcccaaggtaccgtaggtatgtcgcattttccactaatggccagttaaaggacttgtgtgcacaatggtagaatgaggactgtgtggttccgttttgtggatttattatatatctagaagatgtgaatgctttgactacatgccagagttttcaggtggtggtgtgacatttcccacctacttaatactagaatttttagttatctctgcgccaaagcgtcattttgtattctggaattataataagatgtaaattaatacttaatttttatcaaaataaatcagataaattattggtgggcaattctgtggtaatgctgcagatggaggaagaattgagtgtcagaggatatttgggatagtgactgttaatcactgaggcagtccagtagaggggttaaatcagggtatgatcaaatcgcctgaatttatcttcctactctacagttcattagatgtatgttcttggactgcattccagcctgcgcaacagagtgagaccctgtctgaaaacaaagagatattctatagttggggattaaaggtactaatgcagctaagataattagtgtggtacctgataaagtaaaggcctcactatgtattagatattattaccaccattgaggttaatattagtgaacgctgggttattctatttgtgctttattcctttggaagactgaattaggctagactccttccataagatccctttgaagcattttataatataagcctgcccattcttttatcttaccctttgtggtaagtggaaaagctacaacttcttcctgaatgatgt

SEQ ID NO: 11831 - DNA, 1030 bp, Homo sapiens
ttgcttcgctagtacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggtaaaattgcaactgagacttctcttcagcaatcctcacccttccgtccttctctgcctcctcttcctcctcctcctccaacatcagctgccagaaaccttgcttatggcttcctgatgctacaaaagctgaggcaaggccttcagtctgttttttcaaagcagtcattccggtaacacttctaaaagcaaaaccacgtgatccatgcctataatagggaacccttatggccaaagtttctagttgatagaagaacaaaagaattaaggtaacaagacaggtggaatgtgtaagagcttggactctgaagtcaggctggatttgaatcctgtttctgctacttatttgtgaggttttgagaaaaccaagttttagattaagttcatccattaagtgggggcattaaatgcctgcaccatagggttatgatgattaaatataaaggatttagcaaaagagatgcctgcagcataaataacatttttaaagtattggttttaaatgagacagtgctgatttttaaaggcaacctaccagaatggaggttgttgattattgattctcctttttcactgcagaatattagtacagctgttttgagtttgttttgtgcttaataaaccttacatcaattttgcagttcctagggaacttggaaaactagggatagatcatcatttttgttatcagtagccacaacttttttctcctcagtgtcgttggggtttcttttttttcccctcaccgctagatgttttgaccgaacattatgttcagtctgttctttgctacccttctcctgtcccatcat

SEQ ID NO: 11832 - DNA, 1019 bp, Homo sapiens
actcccaggttaattcaaaagcaaaagtggtagaaaaacattcagtgaaaaatttttcttaaagacttttcctgtccaaaacctgaaaattccaaagtcatgcatataaaagatatttagaaacaaaattgttaaaacgcttaagaaacaaaattgttaaaactcttaaagtatacataaatgagcttttttgttgtaatatctaagtcccaacaacttgttcagtatctctcaaaagagtgtgttcagcattgctggtgccattattatgctttgtaaaactcttaaagatttgattgtgtgaaatgcaaaagaggaagataagcccaagaagaaaaacagtttatgttgtctcacacttaatattttggtaagcattttctgtgcaaataaacgtttacataattgtgaatctcatctttggtagaggttttatgaagagtagaatgacttgattttttttgaagttagactagttgaggcttttttggagggggagtttggttgcacatgtggacttgttctggaagggtccaaagcttaaatacactcctgtaaaaaaaagtaatgggtcattattttgctttttttatttattcatttttaaaaactagttacttcccattaaagacatttgcatatcccctttaaagtaagacttgaaatcacagtctttgtaggatgtttggttttttaaaatgtaaaatggtagtatatgatataatttaaatagaagaaaaatataaaatgaatcggtaaattcctttgtgaatattaataagatctattatttagaaacctccaggattagggcttactaccatcaaagtatgattaaagctttactcctaaacatataaagggagtcatgccttaggtcagtggttctcaaacttcctgattttgggatctgtttatatgcttacatgttattgaggattctagagtttttgtcaatgtttatttatattaatattatattagaaagtaaaataaacttaaaatgttaattgattaaa

SEQ ID NO: 11833 - DNA, 1025 bp, Homo sapiens
aatttttttcttctgccttacctagtctatcgttgaagcttttgaaaatatttttttttttttactttattcattgaattctttactaccaagatatctgtttggtctttctcatgacatctaggtatctggtgaatttcttattcatattctgatttttttcagatttttgtattgattatctttgctctattatatttaactaagcttctatgatatcatatttatgaattttttagaagttcatagattttatttttgttgcaatctcctgctgaagaataattgtggtcctgtaggggtgtcatgttttctagcatcttcatgtttattgagtccctatattagtatatgcacgtctggagtaacagcctcttcttgattggctttcataggggaacactattttttctatagatatatctgtagtgttggttgcatacagcactttagctttgattctgggtgtatacactagcataatatctgtatggtttctttgtctctagtcgggatcagtggtctgtgatttcctcagttgctaagactgaggttgttagtaaaagtttttgtgaggttttgatgggaacaggggtactagatgggccagtctgcaacacatgttagtggcagcagtggaatgagcatgccggtctttgagcctccagacaacaaacattgacaccaatatccacagtttcagttgggtaaattattgtacctccagggagtttcctgtggtgctggaagttgcagtggtgggcctggtgagtgagtggttcttgagactttgtgcaatgtgcctggcatgggtgatagcaatagcagtagcaagacaaccctcaggcttccaggttgaatgtgctggtggtaatggtgatggcaatggcctatgtaggccagtcctaagaatccaaggtgtcacatgcaggtacgtactggcaatggtcttggcacaggctgtgtaggtttgtcctcagacccatcagagaagtacatgggtgccagcagtgctggatggaatg

SEQ ID NO: 11834 - DNA, 1066 bp, Homo sapiens
ttccacattttttggcatcaaaatgaacctaaactgatatgctgtaagatgtctgaataggagctatttcaaggaataatgaaaaataagacaggagtttcaaaacatcccctataagagcaaaatacatttttctaaaattaaagtgaaaacaaagagaaaatttatggttaagcttgcatgaaagaaggtaaaaccactgatgctttctgaaaagttcatatggataatggctgaagaaatcagcagttcacaagtagatatgttatttcaagaagggatgaaatggtgctgaacctcaagtctacggtgacagagtattcatatcaaatgtatcttgttgataccatgatagaagaggaatgaagattaagagtacaaacaatagccaacccttcatgttttttaattggttcatcttacatgattctaactgaaaaattaatgttgagcaaatttttcactctgtggatgccaaaactatggcaaccagagcagctacagacaagagaagaagcttccctgaaaatttaaataaggggataaagatcctgaagcatttcatcaaagaattgtgacagcagatataacatggctttatcagtacaatcatgaaacaaagcacaatcaaagcaatggctaccaagaggtggaagtggtccagtcaaagaagagtggatgaggaaagtgcaaaggtaattgtaagagtttattgggaagctcaaggcattttgcttattgactttctgaagggccagagaaggacaatatatgcttattctgagaatattttgagaaagccagaactctagtagagaaatgcctgggggagcttcagcagagtccttcaccacgacagagctcctgctcatttctctcatcagacagggcaattggtgagagttctgatagaaaaccattaggcatccacattacaccctaatttagatcctttggatgctttttgttttgtaatctcgtaacatctgtaaagactatttattattcttcagttaatgtaaaaaggacacaccaatagctggtatgttgaccaaaatgtatgaaa

SEQ ID NO: 11835 - DNA, 1152 bp, Homo sapiens
aacaattctttaaaacttttacaagaaaatcaaaataagactctactgcctttaatttgaggaagcacatgtcattaaggaaaagactgatgagttcacatttgctgataaaaataatataatctgtccatcctaagttaggtgtccaacaaatagttacatgtctatcctctcacctttcatgtcctccaacacttctctttaaagagtggcatagaataacatcatgaaagaatgaggaaactccagtgcaacaaaaaaattatagagtttataaatatctttttttgtttacaaatatattgtgtgagatagatttttccatcttaaatatgtgaagaaaaattaaccctgcaataattagtattgtaacaacaatattgcaatttgaaataagacaaatgtgtaacatacttcttcttccaaagtaaataagaggattaaatatagaattgaaaaagtaaacaatcaaacagagaaaataccaagaattgttttgtaatcttgaaagttgggaagacatgtttaaacatgatattaaaggcagagtacatttaaaatgaatgcatttaatagcatgactggaagaatttctgaatgcctcaagaaaataaatatagaaaggtaaataatagattaaaaactttaaagtctatttgcaatataaacagtagaaaaaaatttaatacttttactgttttataaaaaagataaaaataattttaaaaaccagattatcatatataaaaaattcagcctcacatttaaacaaaaacgtaagtttagtatagtactatggtaaaatgaataacaagtgctctattttgcatttcaaattggccacattttgcttttgtaaattgttacatagaattataatgtgtgcaaagttacgagcagtctcgtttaatgctagtgagagcttacattggtgcatgcattttgtaggggactttgtcaatattaataaaagtcttaaatgtttatatagattataacctgctttttggacttcacccatttctacgacttcatcttacaaataattggagatttcaccacagagttttgtcttagtccattttatgttgctataaaagaatacctgaagttggataatttatttttttttgcatttttgatcatgtggat

SEQ ID NO: 11836 - DNA, 1065 bp, Homo sapiens
ctagaaagtaaataattttaatttacataaaattatctcaacagatgttgcaaaaatgtttaatctaatttaactcctaatcaagataaatacccaaaccaagtttaaatagaagcaacatttaataacttgtatgtctactaaacaaatacagaagcatagttattagtgtaacatagagcttttcatttaatcaagattaagacaaagatacttgtttattgacaatttcgttaggtcatttaactaatacactttgacaaaaatattgttacatagaaatttggatggaaatttaaagaaattatatactaatagtagtaattccacctagataatttaaaaatcaacaggaaaacttttgaaataacacaaatttgataagcttgctgagtacaatatcaatatatatgggctaaaattacacctattcaccagcactggtccattaaaatgtggaattaaaaaaattccctttcttattacaaataagaactatattttgattatgactaagtctcagaaaagtgtttcatgatgttatatattgtgaaattacataactataatactttagtgaaggatttgaactatatagatatgcaaaaattaattttcaaagacattgattatgctcaaattaattcacatattcaatataattctaaccagaatcttaaagaaatttattttcaaattgacaaaacagtcctaaattacacatgaattaagtattcaaaaataattcagacaattcttgaaaaagaaaattaaggtaggggtatccagtagatagcaagacttatttaaattatttatttagtggctcatacttgtaatcccagcatgttgggaggctgagatgggaagatcacttgagttaaggcattcaagacccacttgagcaacacagtgagaccttgtctctaaaagcatcaaaaaagtagctgggtatagtggcaactgtagtcttagctacacagagaatcaaacaggaggattgtttgagcccaggaggtcaaggctgaagtgagccttaattgagccactccagcctgggctaca

SEQ ID NO: 11837 - DNA, 1029 bp, Homo sapiens
ggtggctcacgcctgtaatcccagcactttgggaggccgaggcgggtggatcatgaggtcaggagatcgagaccatcctggctaacaaggtgaaaccccgtttctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaagaaaaagaaaaaattcatggaaaagatgcaataatcatgaatttggacatacctaacaatgcattacgtaaatagataaagcagaagcctcacaaacagaaactgaagaatccacaaataataagaatgtaagacacacttaataaactgccatatcaagcagaagaaagaatgatatggaatattttaagaatgcaattagcaaaaattaattcaatacttttatgtagaaatctgtacttgacagaaatctggacacaaacattcaaatacacatgaaacatttacacacctaaaccatgtacactataacaaagaacagattccatggaataagtattacgtagaatgtaaagtagtaaaatgttaaatcaatcaaaaaagtttgaaaattgaactattctctataactgagaaaaagatgaacatttctacataaaagataaatgtttagaactcagcaacgaaaaagcttttcacaatcaaaatgaaaaaaccggctaaagctaagaatccatatccattagtacatgttttataaaaaagttttccagatgaatgaggcacatattcaccttcagttaagaaaaatgaacaacagaaaaatttaaagaagggtgaataagttaagaaggagctaatatgtaccttgcgcttacttagtacatggtactgttctaggtggtttaggtgtgctatttattttatatttattcctaaaaacagtctcattccctttggtt

SEQ ID NO: 11838 - DNA, 1772 bp, Homo sapiens
tgaacggaattgactgggtcaagatgtgaaagagatcttcgaatcctcacagctttgactatctccagaatttgtctgatttcggtaataatggtgagatggtttatagaggagctgtagttatctttacagatgagcagaaagaaagccagagctgcaaactcttgtggtgaagagaatacatcactagggggaacccatccctgggaaagaagctgttcttaaaatcagaagtggaaataacttagagtaaaataatcagatgcttgctatcacaatggcattaaaaattcgaagactaggccttttggttcctttgtgaataatcattttcttattatatttactagctggtcattgtgtaatcacaaagattctttagaagttgaattaataaacggctattgtattaaattttattttaattacaatggttttccttcctttccttttttacctgagtagaatctcttgttattttctggacagaaaaacagatctgcatgtggtggtaattttactccttccatttgaatatatgtatctctgttatgtgcttgtttatctaatattaaataaaattattcactttctaattatccacaacattgacaagctttttctttgtgcctttttattagataatttttcagggtgttgcagatacacataaggttagcagctactttgaggtacaccattttaatcatggtcagaaggctaatcaaaaaagtattttacaagaattgttttttaaaaaatatattaaatattatcaaagacaacgttggcatcttttgagatggtcatatttttttttcctctgctgacttcattatccaaaacaaataatgaacattccttaacattcctggaatcaagtctgcttggtcatttaactcatatatcactttaatttgttttaaattatttaaagtgagatttatagttattactgttagagtagtcatatcaaaaaattttttttcaagaacttggggtatttctcttcttttcagcattttgtataaatcagcatactaaaggactgcctgttaatgaggaatcttccatgaaggtgcttttgggaggagtgaattctctattaaatttcatcatattttacttagatattaactactataatgagtttaatatatttttaaggtcattttgtatataagtcactccatattgtatatctgtaaaaactgtgttcagtttttcatgtttgcttttcagaatgtaggaaaaactcatcttttaaaacacttgtttaagctttacctgattactctgaagattatctgtttcccttattcttccagaattttcacaatcttttgccaattttattggattttcaagaagttattactgttagttcaaaatttatgaatcatttcttctcattcatttaatcttttaaattttcattaattcttatttctgttctcccaagtgtattttgtctctcttttttaattatttgagctcattgcttacttttttttcaatactcctggttgcattataaagtcatcaatttctaaaatgttttctgactattgtgtaaatcaagtcacatcaattttcacacgcaattgcccttcaaattatgctgccgccttgatgaaatccattcaggttttcttaagaatggtaagaatcataggcagggacagaactgatcagtgataaaataggggaaaataggtctagtggcttctggggaatacaggcatagaaccatactcactttcctagaaaac

SEQ ID NO: 11839 - DNA, 1110 bp, Homo sapiens
acagtgaggccgtagtacaataggactggtgtctttataaaaagaggaagaaacaggcatctgtgggcacagagaaaacacaatgatgtatgattccatttatataccattctagaatatggaaagtaatctatagtgactgaaagcagatccatggttgcctggtaactgggggtttgataaagaatgggcagtggtaagttggaggaataacacaggaacataaaggaaagttttgggggtactatatatgtttgttacctgattatagtgatggtttcacatgtgatgagtatcacatggtgagacactcatgaaattgtacactttatatctgtacaacttattgcatgtcaagtatacctcaagtggcatattagaaacaactcaggaggaaaactgcacataagtatgcattcttagaaagcttctctttgcaactttggaagaatcaaatattattatttcctattcttattttttgatcttagcctgggccttatgtttactggaataaaatatgtaggaattcttgttgtcttatctaccttactggtttgtcttccccagtagtaagtttttaagggaagaaagctgcaggggtgtgtgtatgtgtgtgggggcggggtggtgggagggataggagagcaatagcagagagctcctctgaagtgagttctagctttcctggagcctaggttctgcttcatcatcgaatgccccatgaaaattcagtttcagagcctactccattaccccattttcattcttgtaggaattggtgtgttcctcagattcagctcaatatcctggaagatgccaagcctgtaatgtccatcctacctctgcctgggtcatgtgttggcgctcctatccttgaaagttttttcttaaaatttcccatttttgcctgcttaactcctcaatctggatccctccaaattcgaggatcatatagacaacattacagatctttgctgatgtagtttattgctctctattgatttaaaaattttcttgaagaaataagaatatattgggatttaactccaccgtgttgtttagcaaacctatacttacttactttggagtaagatttaacagccatag

SEQ ID NO: 11840 - DNA, 1049 bp, Homo sapiens
cacccaccatggtagtttgtctttctctttgtcttctttcccaacctcatctttattgcctggatatagcgaggccagggtaaccttcttgtctctatgtggatagtacgtttgtacttctagccttgggatttttccttaatatttgtccatgctagctgagtttgccttttcaatagctctcttgactaaatatacggtaatttccaagatattttggttttattttattttatttttgcttagctttgcttcaggggactgaaggtgagggatcagttcttcatagtggaacaccttacatctttctctgccatctttgacgtttatgaggcatatttttctactttgtttggtagctgttgctgaatttgtttcattggtgctttgctcactttacttacttttttagctattgaagaagaatgactgtatcatgctgctgatttccccgtcttggctagacagtatgtcatcctttatctacattggtccctgtagtgaggatcatggagtagatgttgctgggagagtgagtatatgtgaaaaaaatgtgaaggtatttggtgctgatgaagcaatatgccctactgggcaggggagaggcacagaataagaattcttgccatgtggatgaactcattcaaacacaatgactgctttatgagacaatagatagatttctacctcttctcacatgtacagagaaaatatttccaaagtctccggaatatttacatgtattactatttaatataaacttgcaagtctttttaaatgtgtttaaaactatcacagtactaaacatgaactagatgcataataaatgctgaaagtaaaaagcctgaattatttaagtgaaaagagaaaaagatttagatcccaaataaatgtatgcgtttgtgtgtttgtgtgtgtgcgcgcatgtttgctgggcatgtacttgtaaaaagtaaaataatagaaaagtattattcttggtacccagcattctaggaataatgtcttccacaagattattagaaaactctgctactttgtaggaggag

SEQ ID NO: 11841 - DNA, 1022 bp, Homo sapiens
atacactcccacccaataatagtgagtgacatcaacactccactgacagtattagatcatacaggcagaaaattaatgaagatatttaggacctaaacttagcattggaccaaatggatctggtagacctttacagaagtgtccatccccaaataagagaatatacattcttttcatagccacatggcacatactctataatcaaccacataattggatataaaacaatcctcaacaaatgtaaaataaccaaaatcataccaaacacactctcaggccacagtgcaataaaaataaaagtcaacacaatgaaaattattaaagcatacaattacatggaaattaaacatcatgctcctggatgacttttagataaatttaagtctgaaatcaagaagttctataaaaataataagaacaaagatacaacaaaccagaatctctgagacacaactaaggcagtagtaagagggaaattcatagcactaaatgcccacatcaaaaagtttgtaaggcctcaaattaacaatctaaattcaaaattgaaagaattagagaaaaaagaacaaatcaaccccgaagctagcagaagataaggaataacacaaatcagagctgaactgaaggaaattaagacacaaaaaaccattcaaaagatcaatgaatttgggagttggaattaaaaataattataaaataggccactaggtagactaattaagaagaaaagagagaagatccaaataaacacaattagaaatgatttaaaggaatgttattacttaccctacagaaatggaaacagccatcagaaccactgtaaacacctctgtgcagacaaactagaaaacctagaagagatagataaattcctggacacatacaccctccctgctgctggaagtcagagaccccaaacggagggaccagctgaagccatggcagaagaacataaattgtgaagatttcatggacatttattagttccccaaattaatacttttataatttcttatgcctgt

SEQ ID NO: 11842 - DNA, 1014 bp, Homo sapiens
tcggatcatacctatatgaagcagagaactggatttcctttcctggcagtctgactccaagatcctttcttagaaacaattatactgtaaaaactgagaatgaataaaacccaacattggagactgattttaacatctgttaatcttaaaccattaaataataaaaataagttaaaatgaaagaaaaatatccaaatattcatatacagagaagtcaatattcttcaatcgaaaacacattttttaagtgctcaaggaatatttacaaaaatgctgaatatttaattaaataattcatatttgtatatcaaattgacttaagagaatgacttccttaaaagcctaaggatgcgagatcagttcgataaatattgaaaatgggctgaaaattatgagtaggaaaatagggccatttcaacctgcatgtgacatccctaaaatttattttccattttggaaactgtaggacaaaaactattcccattcatgtggggtatatgtatatgtgtatgggtgtatatgtcttcccaagaaaatcttgaatgcttttgataggaaaaatttagattctgtttacatgtatctggtattgagaaaaataaattaacagcagtcatgatacaagttatgatcaagcttccttcagaaatttagacatccaatatatgatctatgtattgggtttaaaaatttccatagcaagtgatgttgctgaacacaaattatgactacacgaggaaaatattgcaaaacagtgaaagagaatatgtcttcatttgcatgcttgcaaatgagaaatcagcttttacttccaaattattatgaaaaaagcctatagcaagaagagacgttgtttaaatagtaggtaatttgagccgttttgaaaattacattttttccataaaggcagcattgaactcatccattagtatgccctagcgctttcctatttgacattggtcccagaattgaatttagaagaaccaagaattttactgcacattcagaaatcag

SEQ ID NO: 11843 - DNA, 1066 bp, Homo sapiens
actgataatgtagccaaatggttcaatagagaggaataaggctgattattcatctatatattcatatatatcattttaatatagcattgcagatattggcagattgatatgtggggaattttaattatatgatgatctatatataattagataatgatataagtgaagaaatacatagatagaattatggtttactaacccatttttgatttcttgcgttttgtacaatgtctcagtatctgttagtatcttatttcttaagtttttttctctatgatcaattacttatgagttaatttttgtgtacagtataaaataagggtctaaatttacgtttttttccttctcttttaactcccacttcttaggtaagttcatctactcatggccttacttattttctgtgtgctgatgatgccaacatttaatctttcagctgagatctcaacgctggtctccgaatcctttctctaatagactatttgacatcttcatttggatgcctaacaggaacttgaactaacatgtccaaatcaaaatactgctcttcccccaattgtcagatttgtttcttctacagtctttccctcttctgctaatgaccacttcagactttcagatgcttagactaaaaaaaaatggagtcaatattttctctctttcagaacctatctttaaggcatcagcaaattttgttgactctaccctcaaaaacctacagaatccaatcccttgtcatcactctgccatactagtctaaactgctgcatatcttgccaggatatttgccatgagtttctaattattctttctagttctgcacatccttttatcctgatgtattctcaaggtggcagccagagagaacctgtaaaaacgcaaatttgatcatgccattcttctcctccagatttttcagtggctttcatctaattcagagtaaaggccaaatccttacgaagtcttataatcatttgaatgatctgattttgtctgcctgtgtgccctaaaacacctggctcatcccatgctaacaacactggcctttgtgtcacttcttgaatat

SEQ ID NO: 11844 - DNA, 1050 bp, Homo sapiens
taaaatgtgatttttatataatatttttaatatcctttctaaatgaacattttaattgccatattataaaatcacagaaaagtgagtgaaaaataaattataccactgaatgaatatcttagctttggaggtctagaactagagccagtgtctgatattaaagtgataacatttctttggaaggtaagtccagggcagcaatggcagggacgcgtggaaattgaggcaagagcacgtggaaagtgaggcaagagcagatgtgaaagaacgtgttgggatgtattgtaacaatgtgttgtgtgtatgtgactctgttgtggcaacttcattataaggtgagagagacagcatggtggtcatcagatgcatgcacttggaccccagtacttttccggaaaggctacaaggggaataccacagccagcattagtccatggaagcgagagaggagggagaatgtatctgttcagctgtcttctgtcttccattttccattggccagggtttccctgaggcggaactaccatctctgctgttctgctttccatcatccagtccgttggtggctgttatgaaagacagacctcaggcccacagtgtggtgttccattcaaggaaggatggtaggatgatctggatcaggcaaggtgctggcctagagaataagtgacagttaagggaatctgaggaagcacatgtttaagtccaatactgtctactccttgtaccactcagatttgctcatgtcttccaatcatggctggctttatgggcatatgatttccactgttgcacagggtcttgtgcttagaggcgctcatgcttagaggggcaatcattagtcttcctgttgcatgctgtattagcagcaatgaacctggtttatttgggggatgctgccatcttctgattttatcattgttcgctgggcacctcttctcaatctcctttgctggttctttctcttgtctctaatcttctgcaactgctgttttgtttttgagacagagggcactcctctgctgaagagggaatggtcttgcactaatt

SEQ ID NO: 11845 - DNA, 1035 bp, Homo sapiens
cttctatccctgttttcccactcaaatgttgccttttttggcctgccccacccctcatcctatgcccataaaaccccaggctccaccggtagtgagaagtggctgaagatcgagaggagaagcagctcaatgttgtagactatggtgggacgttggagagaagtggcttgacttcagagggacaggttgaaggcgtgactttcgagaagagtctggctggagacagccggacttcaggggaagattaccttcctgcttcacattccctttccagctccccttcctgctgagagtcacttccatcaaaataaaatctccctcatttaccattctccaattcggttgtgcaacctcatttttcttggaagctggacaagagctcaggagccaggaatgcagatacgaaaagttgttacactgaacctctgcccttgctggcaagaggcagccgcctcaagcgaaaaggcaaagggcccactgagctactaacacttaagacgtctgcagatagcagagctaaaagagcactgtaacaccctccccctcgaggtttcaggggtgcgggcacccccccagatgctgctgcggggcctgcacagaatttgttcctgctggcatccaaaagtgctcctgcacctgttcacctgtgtgctccctcccatgagggctgggcgcagtgggtcccagcgagtggatttcacccctgccagccctaaagcagctggctggttctagcgtcagtgagccccagttccctcccatgaaggggtaagggaaatgtcctccatcaaaggtattatttcagtctaagccctgatgctgagaataatatgagaatcataaagccaggagaaagaataattgtgttatcccattaccctgaattgtagcacttagaaaaatgaatggtcacatttattagctagcagtctaccttgtagctatcatcatcatctctatctacatctatcccattaaataatttactttttgaaatatgtacattcataaattggataatgcctacgtaattta

SEQ ID NO: 11846 - DNA, 2004 bp, Homo sapiens
atattctctcttttttctttatcattgtggctagtgttctatctatcttaatttaaaaaaaaaaaactcctcagcccactgatcttttgtatgattttatgcattgcaatttccttcacttcagctctgatgttggttattccttgtcttctgttagctttggcattggtttgctcatggttgtctaggtctttttgttgggatgttaggttgttaatttgagatctttctaacttttcaatgtgggcatttagtgctacaaactttcctcttaacactgccttagctatatcccagaaattctggtatgttgtatcttttttctcattagtttcaaagaatttcttggtttctgccttaatttcatatgtacccaaaattcattcaggagagggttgtttaatttccatgtaattatatggttttaagctattgtcttagtatttacttacatttttatagggctgtggtccaagaacgtgactggtatattttttgttgttttgtatttgctaggaattgttttatgttagattgtgtggttcattttagattacatgccatgtacagatgagaagaatgtgtgttctgttcttttggggtgaactgttctgtggtggtctattaggttcgtttggtcaagtgtttagttcagattctgagtacctttgtcagttttctgtcttgatcatctgtctaatgctgtctgtggggtgttgaattctcccactagtgttgtgtgtttatctaagtcttttcataggtctctaagaacttgcattatgaatctgggtgttcctatgttggctgcatatatattcagaatagttaggtcttctcgtgaattgagtcttttactttacataatgcccttccttgtcttttttgatctttgttgatttaaagactttttttatgaaattagaatagtaactctgtttttttttttctattttttatttgcttggtagatttttcttcattcctttacttcgagcctatgcgtatcattacacgtgagatgggtctcttaaggacagcataccattaggctacgcttttttatccaacctgccactctttgctctttaactggggcaattagcctttttacattcgaggttagtgttgatatgtgaagatttgattgtttcatcatgttgttagctggttattatgcagattgggttgtgtggttactttatagtgttactggtctatgtacttaagtgtatttgtgttgtcagtgaagatcttttctttccatgtttagtactcccttcaggaccccttgtgaggcacggctggtggtaatgaaatcccttagcatttgcttgtctgaaaagatcttatttccccttcacttatgaagcttagtttgggtggatacgaaattcttgattaaaaattctttttaaaaaacaaaactgctgaatgtaagcccccattctctttctgtttgtagggcttctactaaaaggtccattgttagcctgatggggttccctttgtaggtgatctgtcctttctcttccagttgactttagcattttttcttttattttgagcttggagaagctgatgactatgtgccttggggatggtcttcttgtgagtttttagttcagtcagatcagtttggttccttcgttgattctttccccagcttgctcaattatgccgtgaatactttccattgtgttctgaaattcttgatgttagtttttcagttctgtcagaacacttttttttcttttttaaaataaccgttttgtatttcaacttctgcatcattttattgcattccttaaaaactttggatttggtttttactttctcctgaatctcattgatcttcattcccatccatattctgaattctatttctgtcatttctgccttttcagcctggtcaagaaccattgctgctgaactagtgtggttgtttggaggtaagaagacattctctggcttttcgtgttgccagagttcttgtgctaattc

SEQ ID NO: 11847 - DNA, 1033 bp, Homo sapiens
ctgatctccttcctcttgttatgtgccattttctttctattcctaatcgtttcggtttggagtcctaggaggctgcggaatgacccggttgtcatggttagcaaggctgttggaaacatatatcttgcattcgactcattcatcctaatttggagaaccaagaagctaaaacacacctttcttttgattttgtgtcagattaggtgctgagtaaaagacctgaaactctcaactctctagattcacaagtgggacattgtgtgtgtattctaggagaaaacaaactgatagtgtctggaacattttatactttttactgttttttctgtagtgtatgtttttgagtattttctgaaagcatacctagaaaagtcttttacctaaagttagtctaaaagtgtatctatgtgtgtgcatctgtatatgaaagacttaaaagacattgacaataacataatgttaatcatattttcacaagatgccaaattatagaaaatatggtaagaagtttttcagaatcatgaacccatgtatatttcacatatacatttcatattatcatgtttcacttgaaaactgtgtgatctttacttataattgttaagaagtgacacattatctcaaaatctttgctcttttccactgatttttaccacacatatgtaccacagtgtgcttaaacatctaaattttttgatagtaagcacactcaattctaaatcaataatgaggtttcatctttggggtagtttttatttcatcatgaattctaattttatgtttagtttatagccagcataattattttcagaaaaagatgcacagaataatattcaaggatgacaaatatatttagaacacattttgtatatgtctaccataaacagtactgaggaataatagacttaatacaaatatgtgaacatttgagaaaaaagtcatttctataataaggatgaagaaagaaacaccgtgatgacttatgttgtcataagtctcaacatgcagttagaaaagtcatttcttccagttt

SEQ ID NO: 11848 - DNA, 1986 bp, Homo sapiens
gaggagtcaccatcagtgacattaggcctgaattttttacttgcttttttgtttagacatgatgagttttctacacattgttttttccattctagtagtggttgcatttattcttggaaattttgccaatggctttatagcactgataaatttcattgcctgggtcaagagacaaaagatctcctcagctgatcaaattattgctgctctggcagtctccagagttggtttgctctgggtaatattattacattggtattcaactgtgttgaatccaacttcatctaatttaaaagtaataatttttatttctaatgcctgggcagtaaccaatcatttcagcatctggcttgctactagcctcagcatattttatttgctcaagatcgtcaatttctccagacttatttttcatcacttaaaaaggaaggctaagagtgtagttctggtgatagtgttggggtctttgttctttttggtttgtcaccttgtgatgaaacacacgtatataaatgtgtggacagaagaatgtgaaggaaacgtaacttggaagatcaaactgaggaatgcaatgcacctttccaacttgactgtagccatgctagcaaacttgataccattcactctgaccctgatatcttttctgctgttaatctactctctgtgtaaacatctgaagaagatgcagctccatggcaaaggatctcaagatcccagcaccaagatccacataaaagctctgcaaactgtgacctccttcctcatattacttgccatttactttctgtgtctaatcatatcgttttggaattttaagatgcgaccaaaagaaattgtcttaatgctttgccaagcttttggaatcatatatccatcattccactcattcattctgatttgggggaacaagacgctaaagcagacctttctttcagttttgtggcaggtgacttgctgggcaaaaggacagaaccagtcaactccatagattcacaagaggtgcattgtgtgttttctagcagaaaacaaattgatggtgtctggaacattttatatttcccacaagtttttccgtagtctatgtatttgagtaatttccaaaagttgacatagaaaagtcttttacctaagtttattatataaaagtatatatatataatatacatttgcgtgtgtgtgtatgtctgaatgtatatgaaaatttaatatttaccataacatacctttaatcaacttttcatataaactgttcagttataccaaagtaggataagaaatttctcagaattatgaacccatgtgtatttcacacatttttttatatgatatttcatttgaggaatttatgatctctatttataattaagaactgacagcttatatcagaaaatcattgctgtttttcgttgtaaaatcattgctgtttttcgttgtaatttgtatcacgtatatgtaccatagtgtgtttaactgtttaactatcattgtttgaacctctaattttttggatggtaaggacatttaattctaaatcgatgagaatgtgtctttggggtaggtttttttgttttttttttaatcatgaattctttttttcttttttttgagatggagtcttgccctgttgtccaggctggaatgcagtagcacaatcttggctcaccacaacgttcacctctggggttcaagtgatttccatgcgtcagcctcctgagtggctgggactccaggcatgcgctaccacacgtggctaattttttgtatttttctttttttttttagtagagatggggtttcaccatgctggccaggctggtctcgaactcttgacctcaagtgatccactgcctcagcctcccaaagtgctgggattatagacattcatgatgaattcttattttatgtttaatataaagcaaatacaattattgttagataacaatgcacaaaataaaattcaagggtgaaaaatatatctagtgtaca

SEQ ID NO: 11849 - DNA, 1301 bp, Homo sapiens
catatcaacaagaaagcatatatggggaatgtcttcattgctggcaaattctactttttgacgaaagtgtggaatatgagtgttaatgttacattcttttttccttttactgtgcatttaggttttattgctttccctacatatgttaggttcccgaataatgaaaatattttaaaagcagaaatattaagtaaattaatgaatataaaactaggctgaaacaatatattcttacatgtaccatcgtaattagagttttgctgaataaagaatacagcattatagtagtaagaaatagggataaaattttatacttttaaaaattaatttaaaaaagaaagatataagcaggaagtgtacatccacattcttaatgctaatcttaatttgaaacaatagattttgaacaactatattgcaatagacttttttcttgtttccaatttaattattcatgatacacgtttcaaattggcagcaattagggaatttttcataaggtacaaatattaaagtatgtaggactatagatattaagtgtataggacaatttttgctacatttatccctaaatgaaataattatactcatgttgttcccattcaaagatcacaatactatgcatgtgcacagcatatgtgttggggaaaatattttgttactataaatttttcaactgtattagagaagaaaacatagaaagataactgttaagctataaaacatatttagtgtaatctttgagtgtgcttgtgtatatgtagtattactttgactgctatagtaaaataacccagatttagtgacagtagctgagattgtaaataagcagttgagagaattttgcctgctaatgatactattaaaagataaaatacagtttgtatgctatataattgtatagaggatttgtatatatgaagttcatatgaaagtacagtgaaaattaaacagcccaaaggagaatactctttgttgtagggcacttttgtcatgattttcagaatgtggtaaaagaaaaaaaaatagccagtaaatcattggaaatacattggttttaacttattcttaatgaaatactgtctgaggatctttgtctgtgcctgatgctgagaataatataagaaacaagttcatgagcccatcaccctgaaacgcagcacttagaaaacatgattgaagtcacatttatagaagagcatggccccttttaactgacattatcatcatcaccaatcatcatctatatctatctcattaaatgatttatttttgaaatgtttacataaataatttggata

SEQ ID NO: 11850 - DNA, 1048 bp, Homo sapiens
gggaaatttttccaaaaatgatgaaatgtatatatttccatctctatatatttaggagccatcaaattttggacaagataactaaaaaatttaaaataaaatgacacaggacatcaaagaccaatagaaaatctgaaaagtagctagaggtgaaaggtagattatgttaaaaagagccacattctaaataacaaactgattttcaacagaaaatatgaaagcgggaattcaatggaatcatatcttcagtgtgtttccaaggaacagtagacttttatagacagaaattaaaaatgatattttttcagataaaatataaactaccaaaaatacaaaattgagcatgcaagaaggaataaaaattaatgaaaatgataaatatgtacataattataagtgaatgtttaccatctaaaataatagtatcttcttgttggactaaaggtgtaattgataagatatatgcaaatagtaataaagagactggagttacagaaataaatttagttaaagtattttttggacttttctatgtctgtgggcagaatttgtacatcttaatcaaggaccctataattctatacctaggcatatatgcaaaggaattgtagcaaatgtatatgaaagaatgctcatagtagcattattcataatagttcataaaagaagctgtccaagtatatatcaactaaggatagataattatagtaaattcataaaattaaacaatatagagaaatgaaaagaaataaatcacatgtacatgcatctgtctgattaaatttcagattcataatgttaagtccaggaagccatgaataagaacatataggattgcacctatacacagttcaaagcaggccaaaccaagctattgagtttagggttgcataccttgttgataaagtataaagaaaatcaaggaaatgatcatcacaaataatggatattgcttacctcaggagatatgaagaaaggtatagaggcttggaaagtgtcatggaggtggaactaggctgtttgcagtgttccttgtcttgccctacat

SEQ ID NO: 11851 - DNA, 1098 bp, Homo sapiens
agactgagggaagtttctgagcagcaatggaagtttattaaaaagatttagagcaggaaagaaaggaaagtacacttggaagagaccacagtgggcattttggaggtcaagtgcagtgttagacctttgacttgtggttttatatgttggtatacttctggggtcttgtgttccttttcccacgattcttcccttagggtcttgtgttccttttcccatgattcagccccttagggtgggctgctcacatgtgtggtggcctgctaacactttggaggtgagcatgcgcagtgtgtttactggagttgtacacatgcttgcatgaggcattcttcccttttttggtggaatgcccccagaaggttgttttctacccttttctctcttaacacgtatgcctcagcctactcgccctattcctgagctgctgactagcaattttaagcatctttacttattgtgaaattgcctctccctggtgcctgtgagcaattatcatttttagagaggcagtgtgacaactgccaggccatcacctgatggccacctgacattcctggtgggtggtgagagccttcttctgccccgctcatgcctgactaactatctactgtaagagccctatacctaaaagtctcagatggtgtggatgtgtgtcctttcctctgggtactgttatctgggaaatggctacaggtctttgagaaagcaccgtatgaatacgtcctgaatattcttgtggtgaattttcagcatccttttcaaggggacttacactttccttcaattattgaattcttgttctcggaattggctcagtcctgacaacaggttgaggttctttgattttccacttcaaaggctgacctcaggaatcagtttttcagcctttgaagtgaaaaggcttgctcttggtttataagtatttttcaaagtatgaagcctctttaactattggcttatgaactcattccaagaagctgatgctgtcatcagttcattgattctgacatttgcaagatcaccagagagtctatgttcccaaggttagtcatcatgttgcatgctctattagctgcattgaacttagtttattta

SEQ ID NO: 11852 - DNA, 1006 bp, Homo sapiens
taaatggataatttgatgtggtaaatcagtgaaaatgaagctcatcataaaatctgcagttgcttgaattttctattttcaggttgaggttataggctttttgaagaagaagcatttctcagagcaaaagtttggctagtccacaattctaggggaaatatcactgtaatatagctttgatgcagctatatcaggtgtgtgaagtagagacaaggtggaacgtcaaaattagatggcacttattctaatgctttttgaaaagcatattaaagattttggtatatttgcacagggtcagggtcacctgtgagtgccagctgctcggggctagcagaccccatgacaagaatgttagggaacttcccagcagctgccaaacacacttttgtttttagggaacgtctctttctccttcagtatgacttatgctgccttcaatgctttgctgatacaaaagaagtaaactcaaaagaagtaaaaataaaagctagcaaactttgcaactgattaagttggttggaaatgtacctaatcactttctactatgaatgatatatttgtattatgatattttctagctggttatcatatacacaaaaaggcatttcatttttaaaaattgagtttgtaaccagtcacctttcttacacattatttgtatatttttttagtatcctttctaaatgaatgttttaattgccatgttataaacgcatggaaaagtgatgcaactgaatgtatatcttagcttttggtgtctaaaactagagccaatgtctgagtttacagtgatgacatttatttgggaaggcaagtccagggcagcaatgaggggtaaatgtggaaactgaggcaaaagaagatgtaaaaccatgtgtcgtgatgttgatatgattttgctggtggccacttcacaattagtgagacagacagcatggtggtcatcagatgcatgcacttggctctccatacttttccagaagggttacaaggggaagccacaaca

SEQ ID NO: 11853 - DNA, 1083 bp, Homo sapiens
attccttagggaatgcggttattatattttatatattttgttgccagtagaggagaatttcagaggcttccctttggtcctgctataataatgtcctttactctacagttcacgaagaatgtgagtcctgccggctgccatacatatctatttcaattatactttcaggaagaggtagtaactacaaactgattagctccaccttggaatggacatgagccgaagctctaggtagtatctgaccttcaaaaactccccctgcaggctggatgtgatggctcatgcctgcagtcctagcactttgggaggcgaaggtgggaggatcccttgagagcaggagttcccttcacaacatgtggaaactccgtctgtacaaaaaatttaaaaaattagctggtgtgttggtgcatgcctatagttccaaatacttgggaagctgaggcaggaggattgcttgagcgcaggagttccaggctgcagtggactatgatcctgccactgtactccagcttgggtaacagagggagactgtgtctcagaagaagaaaaaaaaacaagtataagttctcaccggtatcttaaacatcaagtaaaacagtatcgagtaaaacaaaaaactaaaaactccaaaagtcaaaaacacttttaaaaagaacatggtgttaagagtagtttgttcagtttccccatagaaaatgatttatggaaggagaataaaagattattctgaacactaaaacaataagactgaaaaaatgaattatcaatattgagaatccaatagacagagttaaccagttggatacagtacaagagagaataagtgaattggaagatagctacacagaatgaagcatagaagggaagagatggaaatacacagagctagagggtaacacattgatgctacagacagaacacctaacatacttctggagttctgtaagattagaggagagaaaatagagcaagagaaatgttgcaaggatttttccaaaaggtataaaatgtatccctgaatatatttttagtaatctcaaacttcaggcatgataactaaaaccaaattaacataaaataata

SEQ ID NO: 11854 - DNA, 1071 bp, Homo sapiens
gatactttaatgaacaaataaatgggtggctaaaatggataagttgatgtggtaaaccagtgaaaaggaaactcacacaaaatctgcagttgcatgaattcccctgttccagtctcaggttaagattacaggcttatccaagcagaatccttctcctaaggaaaagtttggctattccacaattttaggggaaatatgacaataatatagtcttgatgcagctgtatcaggtgtctgagttggagacaaggtagaacaccaaaattagatggcacctattataatagtttgaaaaatcatataaacaactttggtctatttgaatatgtatttttttctattgtcaattatttgtattatgatattttctagttgattatttaaacaaaaatgacatttcatttcaaaaaattgagttagtaaccagctactttaccaaaatgtttttaatgtaatacctgttattgaagtgctaccatttatttagaagtcaagttcaagacaaaaatggcaaggacgtgtggaaattgagaccggaacaaatgtgaaacaatgtgtggtgatgtctggtatgaccctgatggcagccacttcacagtgaggtgagagagacagcatgatggtcatcagatgcatgtacttggcttccagcacttttccagaagggctacaaggggaaaccacagctggcattagtccatggaagagagagaggagggagaatgtatctgctcatctgtcattagtcttctatttcctattggtcagggtttccttgaggcagaactatcatctctgctgttctgtcttacatcatccagtcccttggtggtggtcatgaaagtcagacctcatgcccacagtgtggtgatgcattcaagtcccaaatagaaggatgacctggatcaggcaaggtgctggccaggggaattggacatagtgaagagaatctgagaaagcacatgtttgtgtccagtaccgccactccttgtgccactgaggcgtgctcataccctccagtcatggctggctttatgagcatatgacgtccacagttgcatagggttttgt

SEQ ID NO: 11855 - DNA, 1076 bp, Homo sapiens
gtggtgtatgaaacattttatatttcttactggtttttctatactgtatgtgtatgaataatttcccaacgtatacctagaaaagcctttgacctaatattagtctagaaaaaaaaatatatatatgtgtgtgtttatgtgtgtatgaaaacttaagaacattgacaataacatgctcttttctgtttttttcatacaaactgccaaattatacaaaatatgacaaaaatttcttagaattttgaagccatgtatatttcattcatgtattttatatttcatttgtagaatttatgatgtctatttataattattaagaagtaacagcttatcccaggataaatattgctcttttctattgttatttgaaccacaggaatacaccacattgtgcttagaattcattgcttgaacctcgaatttattggatggtaaagtcattcaattctaaatcaataatgaggatgtatctttggtgttttattccattatgaatttctattttatgtttagtaaaaagcaatgagaattattgttagaaaagaatgcacacagtagaatttgagtgagaagcatatgcagagtaaatttaatgtatgtctaccataagcggtactgaggaatattagatttcatatgtgaatagcttaggaaaaaatcccttctctaataaagggatgaaatatcatgatcatgatctggattggtatcatcagttatgcatatgcagttagaaacgtcatttcttccgcttttgaattaaagaaaagctgtttttgaagttgagatctcatgcaaattattttagtattctttctaaagcacttttaagcccctgaattgctaattatatccttaccttccatttatgaaattccttctaaacttcagataagagaactcaaatcctctctttttgaaaaataaaatcaatgtaaatataatatataaattgtggaaaatatttcagtcaaactttttgtaaatgttaaaaaagtatctatgaaatctgtgtattaattatgagatgagccttaacgttgtaattttgtcatcaatgatgaaatgaaagggtg

SEQ ID NO: 11856 - DNA, 1046 bp, Homo sapiens
agaaaatctggtttcctgtcttggcagtttgactccaaaatcctctcttagaaacaattatactttttaaatggaaaagaaataaaatccaagattggagactgattttaacatctattcctcttaatcctttaagtaatcaaaaataaattaaacggagaaaaatgaaaccaaatattcatatacaaagaactctagactcttcagtgagaaacatgtgtttttcaagtcacccaaaatagttacacaattgctgagtattttaattaaacaataaatatttaagtattaactgggctctagagaaaaacttagtcaaaggcctcagcatgagcgataagtttgataaatattgaaaatggtctgaaaagcccaagtggaaaagcagggctatttctacctggatgatgtccctgtaattaattttccattttggaaattagaggacagaaattccttctatccatgagggggtgagtatgtatgtatgtgtgtatgtttgtgaatgtgtttgtatgaatgagcttgtaaacaataagttatacaaaagtattagtagccaccaggatttaaggattattggcctttctgaggttcccaagaaaaccttaaatgcttttggtaggaaaagacgggattcattctacatattactggcgttgaaaatataaatctactttggtgatgatcctagttatgcccaagctccctttaccaggtaataaaaccaatgtgtcatctgtgtattgggttgttaaattgctgaacacaaattatggagagtttaaacaaggaaaaaattgcagaacatttaaaaaactcttcattggcatgctagtagatgagaattcaggttttacttcaacaacgatgtggaaaattttatcttacagcaaggacattgtgtttgaacaagagttaatttgagctgttttggaaattatcatattttccataaagagagcattgattacatccgttggcctattgagatgctttcctgtttgacattggtcacagaatttaaaaggaaaaacaacattact

SEQ ID NO: 11857 - DNA, 1050 bp, Homo sapiens
agaatttttggttctaatgtctcagcaataaccaagcatttcagcatctgggtgttactagcctcagcatatttcatttgctcaagactgccaatttctccaaccttatttttctccacctaaagaaaaggattaagaatgttggtttggtgatgctgttggggcccttggtatttttcatttgtaatcttgctctgataaccacgggtgagagtgtgtggacaaaagaatatgaaggaaatttgtcttggatgatcaaattgaggaatgcaatacagctttcaaacttgactgtaaccatgccagcaaacgtcacaccctgcactctgacactaatatcttttctgctgttaatctattctccatgtaaacatgtcaagaagatgcagctccatggcaaaggatctcaacatctcagcaccaaggtgcacataaaagctttgcaaactgtgatctccttccttatgttatttgccatttactttctgtgtctaatcacatcaacttggaatcctaggactcagcagagcaaacttgtattcctgctttaccaaactcttggattcatgtatcttttgttccactcattcatcctgactatgggaagtaggaagccaaaacagacctttctttcagctttgtgacaggtgaaatgctgagtgaaaggacagaaaccctcaactccatagattcacaaagggagcattgtgtatcttttagctgaaaacaaactgacggtatctggaacattttatatttccattcgtttttccttagtgtatatatttgaataatttcaaaacagatacctagaaaagtcatctatctatctatctatctatctatctatctatacacacacacacacatatatgtgtgtgggtatatgtgtgcatgtgtgtgaataacaacattgaccacaaattatgaagccgagtatatttcacatatatatgtaggtatattttatgatagttcatcctatggtatttcatgtgaagaatttattacctctatttataattaggaacttacagcttttatcaggaa

SEQ ID NO: 11858 - DNA, 1064 bp, Homo sapiens
aattagaagatagctacacagaatgaagcatagagagaaagaaatggaaaatgcaaggctagagggtaacacactgatgctatcatcaaaacacctaacatacttgtagagttctgtaagattagaggagagaaaacagagcgagagaaatgttgcagggatttttccaaaagtgaaaatgtatcccagcatatatctttagtaatcacaaacttcaggcatgataactaaaatcaagttaacaaaaaataatacaggacaccaaagaccagtagaaaatctgaaaagtagctagaggtagaagatagagtatgttgataagaattgcattctaaatacaacctgattttaacagaaaatatggaaggaggaattcaaaggaatcatgtcttcagtgtgtttccaaagagtagtagaccttcataaacagaaattgaaaatgatatttttcagatataataaaaattactgaaaatacaaagttgaacatgcaaggagcaataaaaattaatgacgaaaaataagtgtgtaattctaaataaatgttgactgtataaaacaatattgtcttgttggattaaacgtataattgataagatatatgcaaatagcaataaagagactggagataaaggtgacaggaataaatttagtcaaactgtgttttgggcttttctatgtctgtgaggagaatttgaatgtcataatcaaggaccctgtaattctacacccagctatataaatgcaaaggaattgtagcaaatgatatgtgaaagaatgctcattgtagaattattctaacagctcagaaaagaagctgcccatatgtacatcaaataaggatgaataaataattacaataaaatcataaaatgaaaaaacatagagaagtgaaaagaaatgaatcacatgtacatgcagttatgtgattacatttcagatccataatgttgagcacaggaagccatgaatacgaacatataggattgtatctatacagagttccaagcagaccaaaccaagctattgagtttagggttgcatacctagttggtaaagtataa

SEQ ID NO: 11859 - DNA, 1047 bp, Homo sapiens
aatgtcaaaattagatggcacttattgtaatactttttgaaaagcatataaaggattctggtatatttgcacagggccaggttcagctgtgagtgccagctgctcggggttagcagaccccatcacaagaatgttagggaacttcccagcagctgccaaacacactcttgtttttagggaacatctctttctccctcagtatgacttatgctgccttcaatgctttgctgatacaaaagaagtgaacacaaaagaaatgaaaaaaaaaaaaagctagcaaactttgcaactggttaagctgtttgtaaatgtacccaatcactttctactgtgaatgatatatttgtattatgatattttctagctggttactatatacacaaagatggcatttcgcttttaaaaattgagttagtaacgagtcacctttcttacacattatttatatatatattttagtatcctttctaaatgaatgttttaattgccatattataaatgcatggaaaagtgatgcaactgaatgtatatcttagctttgggtgtctagaactagagccagtgtctgagtttacagtgatgacatttatttgggaaggcaagtccagggtagcaatgaggggtaaatgtggaaactgaggcaaaagaagatgtaaaaccatgtatcatgatgttgacatgactttgccgttgtcacttcacaatgaggtgagacagacagcatggtgatcatcagatacatgcacttggctcccggtacttttccagaagggttacaaggggaaaccacagcaaatattagtccatggaagagagaaaagggagaatgtatcctagctgtcttttgttttctatttacctttggccaaagttattttgtggcagaactaccatctttgcttttcttccttacattatccaaccccttggtggctgtttgggaaagtcagactaaccaatacccccatttttctaagagatacttgttttgttttttttttaattttttgtctcttttcctcgcccctttccctatgtttcccactt

SEQ ID NO: 11860 - DNA, 1052 bp, Homo sapiens
gaacaaataaatgggtggctaaaatgggtaagctgatgtggtaaaccaatgaaaaggaaactcatcacaaaatctgcagttgcatgaattcccctgttccggtctcaggttaagattacaggcttatccaagcagaatccttcctctaaggaaaagtttggctattccacaattttaggggaaatatcacaataatatagtcttgatgcagctgtatcaggtgtctgagttggagacaaggtagaacatcaaaattagatggcacctattacaatagtttgaaaaatcatataaacaactttggtctatttgaattttttttctattgtgaattatatatttgtattatgatattttctagttgactatttaaataaaatggcatttcatttcaaaaaattgagttagtaaccagctactttaccaaaatgtttttaatgtaatacctgttattaaagtgctaacatttatttagaagtcaaattcaagacaaaaatggcaaggacgtgtggaaattgagacaggaagaaatgtgaaacaatgtgtggtgatgtctggtatggctctgctggcagccacttcacagtgaggtgagagagacagcatgacggtcatcagatgcgtgtacttggcttccagcactttttccagaagggctacagggggaaaccacagctggcattagtccgtggaagtgagagaggagggagaatgtatctgctcggctgtcattagtcttctatttcttattggtcagggtttccttgaggcagaactatcatctctgttgttctgtcttccatcatccagtcccttggtggtggtcatgaaagtcataccttatgcccacagtgtggtgatgcattcaagtcccaaatggaatgatgacctggatcgggcaaggtactagccaggggaataggacatagtgaagggaatctaagaaagcacatgtttgtgtccaataccatcactccttgtgccactgaggcgtgctcataccctccagtcatggctggctttatgagcatatgacgtccacagttgcatag

SEQ ID NO: 11861 - DNA, 1059 bp, Homo sapiens
ttgtctgttcagacatgataacttttctacccatcattttttccagtctggtagtggttacatttgttattggaaattttgctaatggcttcatagcactggtaaattccattgagtggttcaagagacaaaagatctcctttgctgaccaaattctcactgctctggcggtctccagagttggtttgctctgggtattattattaaactggtattcaactgtgttgaatccagcttttaatagtgtagaagtaagaactactgcttataatatctgggcagtgatcaaccatttcagcaactggcttgctactaccctcagcatattttatttgctcaagattgccaatttctccaactttatttttcttcacttaaagaggagagttaagagtgtcattctggtgatgttgttggggcctttgctatttttggcttgtcatctttttgtgataaacatgaatgagattgtgcggacaaaagaatttgaaggaaacatgacttggaagatcaaattgaagagtgcaatgtacttttcaaatatgactgtaaccatggtagcaaacttagtacccttcactctgaccctactatcttttatgctgttaatctgttctttgtgtaaacatctcaagaagatgcagctccatggtaaaggatctcaagatcccagcaccaaggtccacataaaagctttgcaaactgtgatctccttcctcttgttatgtgccatttactttctgtccataatgatatcagtttggagttttggaagtctggaaaacaaacctgtcttcatgttctgcaaagctattagattcagctatccttcaatccacccattcatcctgatttggggaaacaagaagctaaagcagacttttctttcagttttttggcaaatgaggtactgggtgaaaggagagaagacttcatctccatagattcacgagaggggcattgtgtatcttctagcaggaaacaaactggtggtgtatgaaacattttatatttcttactggtttttctatactgtatgtgtatgaataatttccaaac

SEQ ID NO: 11862 - DNA, 1032 bp, Homo sapiens
ggaaaatagggctaatttcatctggacaacttcttggaaactcattttttattttggaaattttgagaaaataatttgttccattcataagtggtgtgcacatgcgtgtatttgtgttcatatttatgagcttgtgaataatgaagttatacaaaagtattagcagcaaccaaatcttatggagtattggcctgcctgtggttctcaagaaaatcttagatgcttttgataaaagcagtttggattctgtgtatacaaatctggcattttaaaaagtccatattggtaatgatcttagttgtgaccaagctccctttaagactttagacatttgctatatgatctatgtattgggttataaaacttcccaaacaactgaagttgctaaacacaaatgatggagaggttacacaaagaaaaattgcaaactctgaaagagagtacgttcttatttgtgtactagcaaatgaggattcaggtttccagtcaatttcagtatgaataattccagcctgtaacaagaacaaacagtgaatgaatgagttaatttgagttgtttgaaaataagaatgttttccataaagagatcattgaactcattagttaacacgccatggtgatttctggcttgacactggtcacaacatttaaaagtaaaaagaatgacccagcagatttacaaattaggtgcatatagaatttaaggtcaggatattcaagcaatcacaaccagtgatattacattgagaggtgaagccagctggacttcctgggtggagtggagatttgcaagaatttggcttgctaatgatgctattaaaagataaactaaagttgatatactgtattattgcatagactatttgtccatgttagtgttcaaaaatgccaaaaaaaatcccaaaatagaatcctaattgttggaggtcgtgtttcttatcgaattttaaaatgtagtaaaagaaaaaaaagcaaataaatcgttgaaaatatgttggttttacattattcttgatgaaataccatgtgagg

SEQ ID NO: 11863 - DNA, 1061 bp, Homo sapiens
ttttcttccttcagcacttttaatatgtcataccactctctgcacttttaatatgtcataccactctctcctggcctttttccactgaaaagtctgctgccacatgtagtggagctccattgtacattatttgttccttttcttttgctgctttcagaatcctttctttatccttgagcttagggaaattgattattaaattctttgaggtagtcttcttcaattttacccagcattgttttttgagaaaaaccattaattcctatcaaattgcagtagtcccttttttgaaatcaattgaccatgaatgttggtgttaatttctggactctcagttgtgtttcattgttctttttgtctaccctaatgcgagtaccatagaatcctgattcgtgcagctttgaaggaagctttgaaatcagaaagtgtaatcctccaaatttgttattttttaacaatttctttttgtgatcttgtcacttggcatttccagacacattttaggagtagttttccactttctgtgataaaacatctgctgggatttgatagggattgcactgaatatataactgcaatctataaagactctccctgtgctggatttcagttcagctggtcattcttgcttgtacaactctgtgacaaattgaaaatataattttggccttttatttctcttatcttaattgtagcagaaggtatcatgcttttctgaaccttgtgcattctgcccaaaaatggaagttctcagccatgtgtggttgttcacacctgtatgcaagcactttgggaggccaagatgaggggaccacttgagaacaggagttgaagaccagactgggcaacatagggagactctgtctcaacaaaaaaattaataaattagctgggtgttgtgatgcatgcctgtagacacagctactccagaagctgaggtgggaggacacaaatgtttgagactggagtgagctgtgatcaagccattgcactccagcctgggtgacgagtaagaccctgtctttctcgctcccctaccccaaaaaagaaggtctcactgg

SEQ ID NO: 11864 - DNA, 1044 bp, Homo sapiens
tctgtgccttttaattggggtatttttcccatttacatttaaggttaatattgttatgtgtgatttttttcctataattatgatgctagctggttattttgcttcattagttgatgtagtttcttcatagtgccaatggtctttacaatttggtgtttttctgaagtggctggtactggtttttcctttccacatttagtgcttgcttcagaagctcttgtgaggcaggcctggtggtaacaaaatctcttagcatttgcttgtctgtaaggattttatttctccttcaactatgaagctttttggcttgctatgaaattctgggttgaaaatccttttcttgaagaatgtccccactctcttccggcttgtagggtttctgccaggagatctgctgttagtctgatgggcttctctttttggtgactcagcctttctttctggctgttcttaacattttttccttcatttcaaccttggtgaatctgactattatgtatttttgggtgctcttctcaaggagtatctttgtggtgttctctgtattccctgaatttgaatgttggccagtcttgctaagttgggtaagttctcctggataatatcctgaagagtgttttccaactttgttccattatccccatctctttcaggtacaccagtgaatcataggtttggtcttttcacatagtccaatatttcttgaggctttgtttgttccttttcattcttttttctctaatctcatcttcatgcattatttcattaaattgatcttcaatgtctgatatcctttcttccgcttgattggttcacctattgatatttgtgtatgcttcacaaagttctcatgctgtgcttttcagctccatcaggtcatttatgttcttttctaaactggttattccaggtagcaattgctctaaccttttttcaaggttcttggctcccttgcattgggttagaccatgcttctttatctcagttgagtttattacccaccttctgaagcctacttgtgtcaattcatcaaactcattctct

SEQ ID NO: 11865 - DNA, 1121 bp, Homo sapiens
ggagcatattgtttcatttccatgtgtctgtatagtttccaaaattcctcttgttattgagttctagttttattccattgtggtcagagttgatgcttggtaatatttcaattttttggattgttcaagacttgttttgtgatctaacatatggtctatccttgagaaaaatccatgtgctgaggaaaagaatgtttattctgaaacttttggatgaaatgttatgtaaatatctgtaatcaatttgttctatactgcagattaagtctgatgtttctttgttgattttctgtctggaggatctgtctgatgctgaaagtggagtgttgaagtctccatctattattgtattgaggctttctctttgctttggtctaatagtatttgctttatatatctgggtgctccagtgttgagtgcatatatatttacaattgcaatatcattttgatgaattgacccctttatcattatatggtgacctttatctcctcatagtttttgtcctgaactctattttgtctaatacttgtataggtactccactttttttggcttccattgccatgaattatctttttccatcccgttgttttctttctgtgcatgtctttatagacaaagtgtgtttcttagaggcaacagattggtgttttgtttgtttgtttgtttttccatttagccagactatgtcttttgattggagagtttagcccatttacattcaatgttagtattggtagttaggacttacttttgtcattttgttatttgttttctggttatgttgtggtctgctcttctttctttcctaccttcctatttttctttagtgaaggttattttctctggtgatataatatagttttttgctttttatgtttgtgtatccattctatgctttttggtttgagattaccatgaggcttgcaaatactaccctctaacccattatttcaagctgataacaacttagcactgttcgcataagcaaacaaacaagcacaaaaacaaaacaaatgaagactctgcaccttaactccatcttcttcatttttaactttctgttttcactatttatttcttattgtactgtgtatgtattcaaaggttgttgtggc

SEQ ID NO: 11866 - DNA, 1714 bp, Homo sapiens
gctattgtgaacagtgctacaacaaacatgggagtgtggatacctgtttgatacacttacttcctttcttttgggtatatacccaccagcgagattgctggatcatatggtaactctaattttagtcttttgagaaacctttaaactgttttccatagtggttttactaatttatattcccacctgcggtgtacagtggttcccgtttctccacatcctcaccagcatttgttactacctgtcttttgtatataagctgttttaactgggatgagatgatatcttattttagttttgatttgcatttctctgatgatcaatgatgttgagcaccttttcacatgtctgtttgacattcgtatatcttgttttgagaaatgactatccaaatatttcacccatttttttgatcagattgttagattttttttcctatacagttgtttaagctccttttatattctggttattaatcccttgccagatgagtagtttgcaaatattttctcctattctgtggattgtctcttcactttgttgatcatacctttgctgtgcagaagtattttttaacttgatgtgatcccaattgtgcattttttacttggttgcctgtacttgtagggtattactacttaagaaatttttgctcaaaccaatgtcctggggagtttctctgatgttttcttatgggagcttcatggtttgagatcttaatcatacatctttaatccattttgatttgatatttgtatagatatatgggcctagtttcattcttctgcatatggatattcagttgtcccagcaccatttattgaagagactgtctttttccagtgtacgttcttggcatctttttcaaaaatgagttcactgtaggtgtgtgggtttgtttccgagttgtctgttctgttccatcgttctatgtgtcagttttaatgccagtacatgctgttttggtttctgtagcctcagtagtaagtatcatatgaagtcaagtaacatgattccttcagttttgttcttttttcttaggatagttttggctattctgggtcagttgtggctctatataaattttaggattgttttctctatttctgtgaagaatgtttttggtattttgataggaattgcattgaatctgtagattctttgggtagtatggccattttaacaatgttgatacttctaatccatgaacatggactatcttttctttttttgggtgtccttttccatttctttcattagagttttatagttttcattatagagctatttcatctctttggctgagttaattttcaggtatttaattttatgtgtgacctttgtaagtgggattacttttttgattttgttttcaaattgttcactattggcatgtagaaatactactaattttttatgttaattgtgtattctgcaaatttactgagtttgtttatcaattctaatagtttttggtacagtcttcaggttttacaaatataagatcatattgtttacaaacaagcgtaatttgacttgttcctttcctatgtggatgctctttatttttcttgagtgattgctccagccagagcttctactattatgttgaataatagtagtgaatgtgagcattcttgtcatgttccagatcttagaggaaagccttttagtttttcccaatttagtatgatactagttgtgggtctttttatgt

SEQ ID NO: 11867 - DNA, 1023 bp, Homo sapiens
caaagcagaccaaacgaagctattgagtttagggttgcatgctttgttcgtaaagtacaaagaaaataaaaaaagatcattataaattatggatgtacttatcataagaggtgtgaagaaaggtgtaggggattggaaagtggcattgaggtaaacctagcctcttagcaatgttccatgtctcgccctacataatggttacatgagtgtttatgatacattgctatgttttccatttttgttttggcccatttctaagtgtgtagtctagttataaaaattattaattaggagaaattttccatgaaaattattattaccctgctcattatatactgaagggaaaaatccactatttgtatacattcatgtataactctaagagattttaagaagaaactttctgattttagttgcaacttttggaaatttgacatgatgtttcctgccaaccccagatttttcaacaggtttttcttttaggtttaattattgacttcatatgacaaaactttgacattctccaactatttttcccttgtatcctgaattcctgacacaacaagtgtggacatatttcccacacttttggtttagcagaatacctatgtcacttatgtttttctgcaagagaaaatcctccaaaactacattagatatttgtatctcatatgtctttggatttcatttttctaagctgggtttgatggatggctgtggtgattggagatgggccacgtactgcatcttgaagatagagtttggatgatttaggctagatcaggcagtggcattctgactccattagtttctcattcttcttctgggaacagtgtaatagccagatgatgtccttatggtaaatggaaaagagcaagaaactccaatgtggaagccatcttaaatctctgtgtaaagtctactaatttcctgttcattgaagcaagttacaggagtgcacacgcatatatatatgtgtgtatatgtgtgcatgtgtatgaataacaacactgaccataaatt

SEQ ID NO: 11868 - DNA, 1056 bp, Homo sapiens
ttgaggtttttctttttctttttcttttttttttttttgagactgagtctcgctctgtcgcccaggctagagtgcagtggcgccatctcggctcactgcaagctccgcctcctgggttcacaccattctctggcctcagcctccccgagtagctgggactacaggcgcctgccaccatgcccggctaactttggttttgtatttttagtagagacgaggtttcaccgtgttagccaggatggtctcgatctcctgacctcgtgatcagcccgcctcggcctcccaaaatgctgggattacaggcgtgagccaccgtgtccggccaaaatagttgagtattttaattaaataactaatatttaagtattctcaagagaataacttagttaaaggcctaagccttagagattaagtttgataaacattgaaaatgggctgaaaagcccgagtaagaaaattaattttcattttagaagttataggacagtaatttttccaaaccatgaggggtgtgtatgtgtgtgtgtgtgaatgtgtttgtgttaatgagcttgttaacaataagttgtacaaaattattagttagcagtaaccagttttcaaggaatattggccttcctgggcttcccaagaaaaccttggacacttttggtagaaaagttgggattcactctccataaatctggcattgaaaaaatgattcaacagtggtcatgattctagttttgaccaagctacatataacagtgtaggcatccaatgtatgatttatgtattaggttggaaaatttccctaacaactcacattgctgaacgcaaattatggagacattaaacaaggaaaaaattgcaaaatgatgattaagtgtatgacttgatttgcatgctagcaaatgagaattcagctttcacatcaacatcagtatgaaaaattttatcttataacaagcatatagtatttgaataggagttaatttgagctgttttggaaattatcctgttttccattaagacagccttgaactcattcaatagcattccccggtgctttcctgt

SEQ ID NO: 11869 - DNA, 1042 bp, Homo sapiens
gttagaacagtcatttcttccagcttttcaattaaagaaaaactttttttgaaattgagctcagatgtaaattattttagtattttttctaaagcacttctaagcccctgaattgctaattatatccttatcttccatttttaaaattctttctaaacttcagataagagaactccagtcttccgttttctaaaaaaaaatctgtcaatgtgaaaatagtataaaaattatggaaaataattcagtgaaactttttttaagtgttaaaatagtatctatgaaatctatgtattaattatgggatttgtcctagtgtaattttgttgtcaatgattaaatggaattgtcttgacatattcattaatgggaagttctattataagaaggaaatgtacagtcttgtttacagctaaattctacatgactgtattaattcttggtgttatgaaattttaacaatgttgttcagaccttaagataaatcatccccacacctgattcatgtattttttagaatcatgtatcttcctcagtacaatgtaagaaccataaaagaagagatcgtgtctgtcaggctttctgttgactcccaggacctagaacccagcacaaggaatagatggtcaaaaatgatattttaatgaacaaataaatgggtggataaaatgggtaagctgatgtggtaaaccaatgaaagggaaactcatcacaaaatctgcagttgcatgagttcccctgttctggtctcaggttaagattacaggcttatccaagcagaatccttcctcagaggaaaagtttggctattccacaattttaggggaaatatcacaataatatagtcttgatgcagctgtatcaggtgtctgaattggcgacaaggtagaacatcaaaattagatgccactattacaatattttaaaaaagcatataaaagactttggtctatttgcgtatgtatttttttctattgtgaattatatatttgtattatgatattttctagttgattatcatataaaaatggcatttcatttcaaa

SEQ ID NO: 11870 - DNA, 1199 bp, Homo sapiens
tttttccattctaatagtggttatatttgttattggaaattttgctaatggcttcatagcattggtaaattccattgagtgggtcaagagacaaaagatctcctttgttgaccaaattctcactgctctggcggtctccagagttggtttgctctgggtgttattactacattggtatgcaactcagttgaatccagctttttatagtgtagaagtaagaattactgcttataatgtctgggcagtaaccaaccatttcagcagctggcttgctactagcctcagcatgttttatttgctcaggattgccaatttctccaaccttatttttcttcgcataaagaggagagttaagagtgttgttctggtgatactgttggggcctttgctatttttggtttgtcatctttttgtgataaacatggatgagactgtatggacaaaagaatatgaaggaaacgtgacttggaagatcaaattgaggagtgcaatgtaccattcaaatatgactctaaccatgctagcaaactttgtacccctcactctgaccctgatatcttttctgctgttaatctgttctctgtgtaaacatctcaagaagatgcagctccatggcaaaggatctcaagatcccagcaccaaggtccacataaaagctttgcaaactgtgacctcctttcttctgttatgtgccatttactttctgtccatgatcatatcagtttgtaattttgggaggctggaaaagcaacctgtcttcatgttctgccaagctattatattcagctatccttcaacccacccattcatcctgattttgggaaacaagaagctaaagcagatttttctttcagttttgcggcatgtgaggtactgggtgaaagacagaagccttcgtctccatagattcacaagaggggcattgtgtgtcttctagcagaaaacaaactggtggtgtatgaaacattttatatttcttactgggttttctgtaatatatgtatatgaataatttccacatgtatacctagaaaagtcttttacctaaagttagtctagaaaagtacatatatatagatgtgtgtgtgtgtgtgtgtgtgtatgaaaaactgaagaacattgacaataacatgctttttattgttttttcacaaaaactgccaaattatagaaaatatgacaaaaattcctcaattatg

SEQ ID NO: 11871 - DNA, 1032 bp, Homo sapiens
tctagtagaattattcataacttcaaaaaagaagcagaccaaatgtacattaaggatgggtgaatcattacattaattccatgcaacggaacaatatagagaagtgaaaaaaaaccacatgtacttgcaactatgtgactaaatttcagaaacataatgttgagtccaagaagccacaaacaacaagaacatgtaggaatgcacctacacagagttcaaagcaggccagaccaagcgatggagtttagggttgcatacctagttggtaaagtgtgaagaaaattaaggaaataatcaatataaattatggatattgcttatctcaggagatgtgaagaagggtttagggggttggaaagtggcatggaggtggacctaggctgttttcagtgttccttgtcttgctccacataatggttacttgaatgtttatgatacactgcggtatttcccatttttgttttggttcatttctaagtgtgcattataattttaacataaaaagttttaattaggagaaacgtctcatagaaattattattactcgtctcattatatactgaggggaaaaataaactattggtatacattcttatacaactctaagagagttgaagtaagaactttatttagttgcaacatgaggaaatttgagatgattttatttgccaccccagatttttccaaaggatttcttctagccttaattatccacctcacatgaacaaatctttgccgttccccatctattttttcttttggctcctgaattcctgacacaacaaggttgtacacatttcccacactcttggtttagcagagttcttttatcagttatgtttttctgcaagagaaacccttcaaaactacattagatatttatatatcacatggctttggattttgtttttctaaatgggtttgttggatagctctggtgacttgagatgggccaaattctgcatcttggaggtcgttagagtttggccaatttagtctggatcaggtggggggcaatctgccttcattagt

SEQ ID NO: 11872 - DNA, 1023 bp, Homo sapiens
ccctgctttgggtctcatacttggtatatggctgtcatttatatatgcacattaataaaaacttgtgttttctcttatttatctattgtcagtttattttcaatgaaccctcagagcagatgaaaactttctcttggcttcttacaatacttgattctcttttaatgtatttcagttgaattggagtatatgctactgatgggagaattaaaagaattattgataaaaaacattttggcattgtttgattgtatccgtaaactgccaaagttggctgatgtatcataagatttatttgagtgactttattctaacaaatttgtctccagtattgagtatgttgaatactatatactatttttcaaaactcaaaaatattttatactatttttaaatattacttctttatttcaatattaaagtagaaaaaacattccactattttgctctggacacaaaccacttgtttcgctctcttgtttgccatttttttgggggtaatatctgttagtgagctcataatatttatcataattcacattatatgtattatattgttatatctacccattcataagatccatttctactcatatatctcaggtgtgtgttggtataaaattcacaaaatcttacaagtcttttggtctgaattttactttgtcctgtatcacattttgtatcttgtcatttggggcctgctgggaattgagtgttatcatatatttaaacataagaggaggcagggatatatatagagtggtatcagcattcctctgtaagccaaacagctcaaggtaactcattacaggtttttaaggcaagggaaggaagactaaccttctcagcgaggggaggaagagtgcatctcctggcaacggtgcaccagcagaatttaggggttcaagatcctccagattctttgggatctgccattacaggcccaccccaatttttaagttcctatttcttttttagcaaatttcctgactttaacacaggaagttgtgaagttgtaaatac

SEQ ID NO: 11873 - DNA, 1688 bp, Homo sapiens
cagcctgggtgacagagcaagcctgcgtctaaaaaaaaaaaaaaaaaaaattggtgttttctttgaccaaagtgtgggtaaaagaagagaattattggtattttcttgtcaagtttactaaaagtttttaaaaaatctttaagaatttggtattatgagtattttatttatccatagaaataacttacagaaatagagtgaaagtttctttctaccaccaaaataatgactgaaaaaattaatattaagaattcaatatttaacaatcaattagatttaacaatcagttagaaatggtagaataaagaattagtgaattggaagataactacacagagtgaagcataattagacaaagagatggaaaaatacaggctaaaggggaagagcattgaggctacagtcagaaaggcttaacatacttttggagttctggaagattagaagagagaatgtagggaagaagtaatgttgctgagacctttccaaaaataataaaatgtatcaatccatacattcgagaaaccaacaaacctcagacaagataactgaaaacaaattaacatataaatgctacaggaaaccaaagaccaatagaaaatttgaaaagtagcctgagaaaaaagatagattatgttgaaaggatcaactgtttgaatgacaactgattttcagcagaaagcatggaagctagaattcaatgtaatatattttcagtgcgtttcaaaggagtagcagacatttcataaacagaaattcaaaaggatacattttcagatagaaaaaagttactgaaaatacaaagttgaagatgcaagaaggaatgaaaataaaggcaatggcaaatgtgcgtaactaaaaggactattgactgtatagaacaataatatcttgtgttaaaagaggtaatgaataaaatgtatgccaataacatatagactggggtgaaggtgaaaagattaaatttagtttaattattatttaaccttttcattgtctgtgaagagagtctgagtatcaaattcaatgcatatactctagctatatatccaagagaagtgcattgaatgacatgtaaaataatgcccatggtagtattatttgtaattgttctaaaaagaaacagctcaaatacctataaattaaggaaggattaataattatagcaaattcatataatggaacaatatagagaaattgaaagcaatgaaccacatgtacatgcaacaaagtggatacattttatcaacataatgcttaaaaaaagaagtcataaacaagaagaaaatatattaaggttgtatttataaagagttcaaaaatgaggcaaactcaaatcaatttctgcaataaacgaatcatcttgaaaattgtatttacaacttcacaacttcctgtgttaaagtcaggaaattttctttctatatgtcacataaaattctagttttgatttttaacaactgacctaattggtttctaatgttctagaaaagacttataatcatttttccaggtttctgtaccttctctggttctctggttttcaagtgagaaaagctacacctaagcacccccatgaattatactggaaagttttccacctctcttttttgagcagagatttaggaaagttggcatttggatccaagtgacccaagctttagggcagaatgaaaattgcaaatcag

SEQ ID NO: 11874 - DNA, 1762 bp, Homo sapiens
gcacttttggaggctgaggcaggaggatcacgaggtcaggagtttgagaccagcctgcctggccaatatggtgaaaccccgtctctactgaaaatacaaaaatcagctgggcgtggtggtgctcgcctatagtcccagctactcgggaggctgaggcagaaggatcgcttgaacctgggaggcggaggttgcagtgagctgagattgtgccactgcagtacagcctgtgtgatggagtctcactctgtctcaaaaaaacaaacaaacaaacaaacaaacaaaaattccagttcaaactgaatgtccctaacctcagagaactatagtcaattcttcactgaagcatttgtatcttcctcgtctttaattctggtatattttgtttattctttttagctcctgtaacattgcatacaaattatttatattaatagttttaggacttgggtgaaattcttgaattatgaataattttagggacttatttctataaatcatattgcatcaacaaaaatgcttggtatgtagaaggatgttactgaatgagagacaaataattactgaaataaatgttatttctaacaatttctattcaaaatttaagatatttgtattcaagtggtatggctcaggggagatgaaaatgcaaattagtgaaaaatgatctctcatttttgcatgtttacatactcgacttcgcttctttagtcattaccatgaatggaaaattgtggctgatgctgaagataaatagacatcattagtgtttgttctagaaattatatagtagctgactgaaagtggtaagaaaggtattcatgaagctttgtatctcttaacaatttggtttagtaccggagttacaatataaatagaacaaactatttttttcatgaagatctctgaacatatatctgaatttggctatgccttctgaaattgtgatgaaaacatagatagaaagcatcataaatgcatgcccatctgcaactgtttgactataaagctgtcagtgaagtagaatatcggaaatattttcatagaaatgttcgttggaattaatattttctttctggtggtggcaacaagaggacttgtcttaggaatgctgggaaacgggctcattggactggtaaactgcattgagtgggccaagagttggaaggtctcatcagctgatttcatcctcaccagcttggctatagtcagaatcattcgactgtatttaatactatttgattcatttataatggtattgtcccctcatctatataccatccgtaaactagtaaaactgtttactattctttgggcattaattaatcagttaagtatctagtttgccacctgcctaagcattttctacttgcttaagatagccaatttctcccgcttattttttgcctggctgaagtggagaatgaacagagtggttcttgtgcttttcctgcggtctttgttcttatcgtttgtttacctttttatgtccaatgccattagtgagttgtgaaaaaaacatgactttgcactcagatacaagtaaaatagtctgtcttcaaggccttaggcttctcagcttgacatacgttattccctttcttctgactctgacctctttgctccttttatttatatccttagtgagacacaccaagaatttgcagctcaactctctgggctcaagggactccagcacagaggcccataaaagggccatgaaaatggtgatagccttcctcctccttttttttattaactttat

SEQ ID NO: 11875 - DNA, 1027 bp, Homo sapiens
ggtccatgatccattttgagttaatttttgcaaagggtacagagtctgtgtctagattttttttttttttttggcatgtggatattcagttgtcccagcaccatttgttgaaaagactatctttgctgtatcatattatcattgctcctttgtaaaaaatgtctctctatatgtctgtttctggggtctctattctgttctattcatccacttgtgtattctttcacaataccacactgtcttgattcctgtagcttcagagtaagtctcaaagtcagacagcggcaggcctctggctttgttttcctccttcagtattgtattattgattattctgggatttttgcctctctatgtaaactttagaatcagtttgtcaatccctacaaaataacttactgggattttgtttgggatagcactgacttcgtaggtcaaatttggaagaactgatacctttacaatattgagtgttcctgttcatcaacatgaaatatctatccttttatttagttcttcttttatatttttcctgcattttgtagttttcctcatatagatctttacatattttgttagatttatacctgtttcacatttttggatgctaatgtaaatgtaaatggtaatgtgtttttaatttctaatttcacttgtttattgttggtgtgtaggaaagctattgacatttgtatattacccttgttttgtgcaaacgtgctataattgcttattagttccaggagtttttgttgttgttattattgctctttcagattttctgcatagatgatcatgtcatctgggaaccaagacagtttcatttcttccctctcaatctatacattttacttactttttttgtcttatttcattagctaggactttcggtacaatgttgaaagcagtgatgagagaggggacatgcttaccttatctctaagttcaattaactttttatatttgtgttcaacattaggctttgcttaaaaaactatatccccattgctcttatccttatcccttc

SEQ ID NO: 11876 - DNA, 1046 bp, Homo sapiens
gatatccaggctgcaaagcaaatgcgagtctaaacttcaatgaggatcagttacatggggaatgagattaataattccatccagcaaattttaatttactggtgtcttttcttgcaataacaagtttcttttttagtttccaaaaattccaaggaggctccagaaggtttacttatgttttccaaagtgactcatttttgagattctaccagcatgaagaattttgactccaagggaaataaaatttaggactaagtagaaaccaggacttagaaagggaataaggttgcaacctggaatacaattccattctcgtgtactagtgcatgggcacagaaatcaatcgcatcagttcaaggtgttccatacctttctttccaactgatctcctgaatatttcagcagctcaacaattttggctagtatttgttcttcttcatctgtcggggaaaattccagttatttcttttaagagaagcaaaaaataatcttacatttttccagggacaatgaatgcttgtggcttggtaagggctggaggaagaggcatgctaattcttttttttttttttattttttattttttagacagagttttgctcttgttgcccaagctgtagtgcaatggtgcgatcttgcctcactgcaacctctgcctcccaggttcaagagattctcatgcctcagtctcccaagtagctgggattacaggcgtgtgccaccacgcctggctaatttttttgtatttttactagaaacccaggtttcaccatgttagccaggctggtctcaaactcctgacctcaggtggtccacccacttcggcctcccaaagtgctggaattacaggcatgagccactgtgcctggcaagaagcatgttcattcttatcaagtaaatcttacctcgcctcttctgcccagacacaaaccatactagggatttctcctacagccccttcctttccttctttccccttcttcctttgctcagtcccccagctctcactgtgaaattcatcgctgtagttaccttaagcttgttgt

SEQ ID NO: 11877 - DNA, 1024 bp, Homo sapiens
atctgtaacgcactttccctacagcagctaacaaaggcaggatgatggtatctgttctgaacgtttgaaacaacatcaccacttatctttacagatttcctcaggttctcaatggagggcctgaaaaacatcactgtcaaggatgatgctgctacattttatgagctggagacgaacgagacctctcctgatgcctctccagtcacaggaataatggttttgaaaacgtcaatgctccatctgccttgtacgttgtaatctcctgtagtccatctgaggccaacgtgcacaggaccacagtagacaaagagtattcctgatgacaaatctgatatttcagtctacttcttcatgtgatatcccaagtattttttcctagaggggaaaaataggttcttaaaattccaagttagatttactgttgaagtgaaaacatatggctgctaactctgctctatcccaggcgtgacccgaggctcaggagaccatgttagtttgggggagggtttggagaggtgactggcattcttggtatgcctgcaaggaagacatcagctaaggtcttacgttacacacccagagctaacaggctggatctttccttgaagatgggagggcttcaagggtgtatttaaaatgtaataaaagtgggtactgaaaggtcaatgactatgaaggttacaactctctcctttcaaagtgctacagaatgggtgaggttgcaggactgcagggtaactatgtgaatggtgctccacagagagcacaaagagccaaggagtaaatcagaatctcgtggtagcttgtttggcatgccttgtagatagagttgctattcattcatttgatcgattcattcaccgttctacaagtactggctgaacatctatggtgttatgtagaggaatgggagctatgggagattaaaggagccatcataaaaacatgatctcacccttacagatttgcagtttagttgggaagatgagatgtactcatatgaaatgtggaatactgagatagg

SEQ ID NO: 11878 - DNA, 2064 bp, Homo sapiens
tctttctgttacccactgtgaatgttaggctgttttcaaattatccacaaattattcttgtaatcacccaatatttttatgtgggtcctctcttacccattatggattaagatagtttaacaaatttaacaatgaggattaaatgagaaggcaaactgttaacttctcagctgtcagaatttgggtggaagggaataatggaagcctcttttgtgatctgcctgacctgctgtcatgtatggtactggggctgctacatcttgagctatcagggctgacctgtggaatgattctagcacttgctctgccaccttgccagaagttcgtttcctgctttttacacatgtgtagcacttctctgctaaaattgaatggttttaaactaatgtatttttagcttaagaggtgttggtcagttaattattgaattttttttttttcttttttaattctgtcttgccaaggcctctctgggtttcagggcccaagagaaaacagtggaagaaaggattcagaatttgggcaagggtgaagtaactgttcatgcaagttaaaaatacctaagtaaagtttttgaagataaaattgtggtttcagaataatgctgattgttggagactgtaagaatcaggtgcacttgattttgcatataagcaaatggtaaatctatcagaatcctaaaacagacaagcatgaactcttcccattgctggaactaagtgcccacagtgtcagacaaaatggacattgaacttggattctgtgatacacagggcacttgatgcttaaatgaagatggaaaggttagcaatacctgggtgtcagttagaatttgagaattctatatgtttacatatttaaatgtgcatcttgatctggtgggcttcccatgtggagacttgcactctaattaactaagaagaatattgccttgttggatctcagtccacgtgcttgcactgcgatggcaatggcctcttcttcaaaatactaatttgtgtgccaatttgtttaaaattatttgaaggcagttcagcctaatctcagtgttctctttctggggtagatgagatggattcttaatatttctgggagtactttttaatgagagaattgtcaaatttggaaagatttattgagccttaggttacatggacagttaagcttaagtaaactgtatattgattatcaaacacaagctgtaattggaaaagttgagaggaaaagcatgagatcacaaattagggggaaaaaagaaaagggatttttaaatttggtgtattaaattcattgtccaagggggaaaatgaataatgtttcattagattccttatatgcaaaagtatttattttgaacatgtgtcctaaaatatatgcactaactgatgtgattaaaattgtccaagaaataaacttgagcataacatactttgtgtgcaccacagtaagctattctgcattgaagtggtcttttataactaaggcctggactttgctccaacagagtcgtggtcttctgaatagtgacttaaggagttttgtttgcttaagtcagataatagcacattcacagggaaacaaagagagttggtggatagaattttctgactattaatttttcttccatgaaattttattatgcctttggcactttctgccactcttacagcatatcacaagatatctgtttagcagaagattatgtagttactttaattttaatataaaagtagcttgtgatacattaccaagagatctctgattctttagtaagtttgagaacacctattctacagagatgataggtacttagaaatgaagactttaaagtacattttaatctaatataggccagtaattgggggaaggggctttgagcagtacaattttaagatgattttgagggttgtatttctttatcatttaaaaatatcctaaagtcagtaatttatatgaaggaaactcattcattattgaaggtattaaaaatagccatcatctgtattaggtagcagttttggaggatcatctttttcttttgctataaagccctattaatgaaga

SEQ ID NO: 11879 - DNA, 1081 bp, Homo sapiens
tatgctcgtgctttcccttccccttcccttccttctcattgaactggttactaggttgatcctttctgtctagaagtctacaccttaaattctggaatgttttcttgtgttgtttctttgataatttatttttcattttcctattttggagctttttatttttatgctgaaccttcttgactgtagctgtatttttctcacctattatccatctctttgtgtttttgttatactttctgaggagagcttctcaaatttgtctcccaaccctcttgttgcatttttctttgaaatttttggatatcatgtttttaatttccaagggctcttttttgttctccaaatgctctgcccctctgaagacagcctattctttaggttttttgttttttttttaattggtatttatttgttttcttctgcttttgtgtctttttctccaagttcctttgttgtgtttgtcttgggcttcaaatttaaagatagaggttttctttaaatatttggtgatccttagctgtttgtatttagtatgaggcttaaaaatactgagaacattgctgtgtaatttcttacacatattttcaattagtactcctctttcagccccagccacataactcctacctttgttccattctaaaatacctggtgcttccactttctgagctaattaatttcattgttagcttcactggctgtaggcctttagctttctctgggctactgtgtcattatccctggtctatctattctccagcttccaaaatttatatcactttcctgctctcttctgttcttctgccttctttgtccttatgggtttataccttcaaaattattttctttttctttctttcttttttttttcctgagacagggtctcactctgtcacccaggctgcagtgcagtgtgaacttggctcactacagccttgacctccctggctcaaggaattctcccatctcagcctcctgagtacctggactacaggcgcatgccaccatgcctggctaatttttatattttttgtagagatggcattttgccatgttgcccaggctgatgtcgaactcctag

SEQ ID NO: 11880 - DNA, 1049 bp, Homo sapiens
ttccctttgatctggtgatttcctttgtagatagctgtcttagagaaagaccgatgtaagtgtataagggtatttgctgagcattatttgtgatagtccttcatggagaaatacattctatcagtgtatggaatattacagtcattcaaaagaataaggtagatctgtgtgcactaacatgaatgatttttaaaaattaaatttcagaaaaattcttaagatctagttttgtttaaaatttgaaaccgtatagtatatacactgtgtatacacagtgtatgtatatataccgttaagaaatgtgggaactcaggccaggtgtggtggctcatgcttgtaatctcagcactttgagaggccgaagagggtggatcacctgaggtcaggagtttgagaccagcctggccaacatggcaaaatgctgtctctactaaaaatacagaaaatagccaagcatggtggtgggcacctgtaatctcagctactcggcaggctgaggcaggagaatcgcttgaacatgggaggcggtggttgcagtgagtcaagacggcgccactgcactccagcctgggttatggaacgagaacgagactgtctcaaaaaaaaaaaaaaaaaaaaagaaaaagaaaaaagaaatgtgggatctcagatctcagatcttcagatctcaggttcttcaacaaagagagagagggaaagagagaagggggagggagggagggagggaggggagagaggagaggggaaaagaaacagacatacatgtcagtattttcctcaagaaataagcaaatatatctcaagtctggagcattagcatactaaaatgttgagactgcttactcctgtatcatgtacatttttgtatgtttgaatacatttataattattttaatctttttttcacattttttttaatgtcttcaggttcaaatgcctcccttccattatgtattctctgattccagacagttaggcacacacttacgcatgtatagttacacgcctggtatagtatattctttccctcatctgatctcctctgtctc

SEQ ID NO: 11881 - DNA, 1646 bp, Homo sapiens
aatggtagtataatggttacattcatttatatggtaggcatgatgacttgccataatcttaagcacctttagaaaattgaccactaattaagatctgtagcattgtggtcacagcttttccacttgattactgataaattttaaaagtaaagtcattctgctgttagtagaataaatttttggtgcattagagttttaaaatttctcccctgaattggcagtaaaacttgaagttgcatttattagagattgacatcaaatttttctgtgcttgcaagttatgtgaattttaataggaaatagtatgcctcttggcacttctggatcctcttgcccctgacaaaaaccaaaccaaaccttctttctggatagggtttagacttatgccatatgacttagttgttaatgttcttttgcagaccatcagcagagcctttatgaatggcagtgcactggaacatgtggtagaattcggcttagattatccagaaggcatggcagtagactggcttgggaagaacttgtactgggcagacacaggaacgaatcgaattgaggtgtcaaagttggatgggcagcaccgacaagttttggtgtggaaagacctagatagtcccagagctctcgcgttggaccctgccgaagggtaaacagctttacatgtgcattctttgcaactgcagtgtacatttcggggaacatggcatagttacagatgatattcttaatgttttaaataatacgtattaggaatctgagaactaaatgatagatgaacttttaaaaacactattgatattttgctgatttgaatgaataattattagctaattttactcttgtcgtaattaactttaggtgaagaaagaggggaatgggttaataaatgttactgatgagtatactgatatgttaagtatatataccaagaggtattatccatctgtagttgcttgcactccttcccagttatactagattccaagcctattgaagtaaacccaccgaaacaatgttgtgagctaagaaaaaactacatttaaaaagctttattttggagtatttattaattcaaaatggatagtttggtttgatcattattataaactggcagtagctttgttattacaagatagaataaactgttcacaacatgatgtttttcaagggcgagtgttcctttttacaagagtcagcaaattttttaaagccggcagctaagaaatctgaaatctaaagaaaaattccacttataaaagaagtcaacaggccgggcgtggtggctcacgcttgtaatcccagcaactttgggaggccgaggcgtgggcagatcacaaggtcaggagttcgagaccagcctggccaacatggtgaaaccccgtaactactaaagataaaaaaaaattagccaggcatggtggcatgtgtctgtagtcccagctactctggaggctaaagcaggaaaattgtttgaatctgggaggtggaggttgcagtgagccgagatcgtgccactgcactccaccctgggcaacagagcaagactccatcttggaaaaaaaaaaagaagtaaacagtgtgaacatataaatatgtttactgtatttgctacttaaaataatttccctgaagtgacattgattcca

SEQ ID NO: 11882 - DNA, 1048 bp, Homo sapiens
aaaacattatataatttcaaagaggatactgaatgtttccaacacagaaatgttaaatgtttgagattatggatatgctgattaccctgagctgatcacggtaccttatatatattgcaacattgctgtgtaccccacaaatatgtgtaattattatgtaccagttaaacattttttaaaacagagactttaaaagaaatagcaaatgaaaatggggcttaagactaaactatttttctgtggatgcacacttacaaaaagcaataaaactataaaggcaagaaagtgactaatagaaaatcagaataattgttacttctatggagagggagggattgggacagggttcatgcagggccttttgaagtcgtctgggtgattcacccagatcaagtttttttccttcatctgagtgaattcgtggttacaagagtgtttgccttatagtaacttgttaagctatatgtttgttttgtatgtttttctctgtattggctttattttttaaaaaagattaaaaatagtcttgagcatgatattacctgtaggtttttttaataaagggattttatcaggttgaggaagttcctttctattcctagttcatggacagatttaccatgaataattactggattttgtccgttcctttttctgcatctatggaaatgattatgtggttttattctttattttatgaacatggtgaatttcagtaattggttttcagttgttaaaccgatcttgcatttctggggtaagttctacttggtcgtggtttatacttcttttgaaatgttgttagatttggtttgctaatattctgttgaggatttttatgtctttaatagtgaaggatattaatccgtagtctgtttttcttgtgtttatttggttttgagattagcataatatcagcctcatagagtcggaagatatttcctctttctttgttttctggaaaagtgtgtgaccagttgatacaacttttcctgccatctgggcatggggatttctttttgggaagatattaattacaaattcaatt

SEQ ID NO: 11883 - DNA, 1046 bp, Homo sapiens
catgacttgatttattttttagggttgaataatgaagggattatccattagctttggtacatagtggcatgcaaatacttttattcattactaaaatcttgttaggttgactcactcatttgtaacattttatttcaccataaactagacactgagttacaaagttaaatgcttagattagttacagttaggaaacctacctaaattatattgtacaagaaagacaatagcccttattgcattttctgtctttatagtgtgcaaattgcttctggtcagcccagcctgtgatggcaacatttcaaactttgtatcacgtaatctcaagtaatgcatgttgcacacacggcgcagagtatagattagtagatattgcagtgagagtaacttcttatttctctacacttgtttgtttaaagatactggtagttttcattttatgcattaatagagaaaagatgggaggtggctaatgaagtgtgctgtggacttgtttttaactgtattactctatcaagatggaaatatcaattgatttgtgtattaaagatatcctgaggagaaatctagttcatatattataatagacataggcacacaaaaccatttcactgtttctggctgtccctatgcttaggttattaaccttttgtacttctttctcttcttgtagcatctcatgtgtcttcctttacccatttcagtgtgcactgagttgggggttagaggagaaattgaaaatggaaagcacaaggtctggattcatctttatttaaaaaagaatacgtgcaatgtgccagtcattgtgatgtggtagtgacacctagtctttacctttgagttctttatagtttatctacaaactctgataagtactatagtatataacaaaacctgccaagagctcagaagagggaataactttgccttagtaagctgggaaaggtttctaagaaaagttacctttgaattaacttcttgaaatagtttatgtttcttattcacgttttaagcaactttactgagttagaatttacatgcaaaaa

SEQ ID NO: 11884 - DNA, 1043 bp, Homo sapiens
ggtgggacagaatggttagaggaggctggagttaagtatttctcttcttctgtgtagacggggagagggaggtggagctggatattttccttcccccaggttggttaggctgtagtaagatggattttcttgagggcagaccttaccagtactatagctttacaagaactctccttgcacaggcagcagtgggtatttttctcaggtctctctctttttttttttttttgagacacagtctttctctgtcgcctaggttagagtgcaatggtgtgatctcggctcagtgcaacctctgcctcccgggttcaagcgattctcctgcttctgcctcctgagtagctgggattacaggtgtcctccaccatgcccagctaatttttgtatttttagtagcgatggggttttactatgttggtccagctggtctcaaactcctgacctcaagtgatccacctgcctcggcctctcaaagtgctgggattacaggagtgagccaccacactggcttggatctttactgtgagaacctggtagagctcctggaggtaaaaccaaaaaaagtgtccctagagtttttaactttcagatttgtctatactaagcctccagcaagtcatcaatcgcaatttaggttttcctactcgggtgctggctcctgtagagaggtttttgtctgtggatttctgctttgataaattatgatcctttgttatcaccttgtctgtctatccaattgtgggggcagtggtttgccctgtgaccttacttctctggtggatctaagaagagttgttgatctttgttgttgttgttgtttagctttttactcactattaggatagagtaacgatttccaagcttcttccccactgcgtccaccccggccaggtggagtctcgctttgtcgcccaggctggagtgcagtggcgtgattttggctcactgcatcctcccatcctccacccactgggttcaagcgattcgcctgcctcagcctcccaagtagctgggattacaggtgcctgccaccacaaccggct

SEQ ID NO: 11885 - DNA, 1021 bp, Homo sapiens
aaaaaaaaaaaagaaaaagaatagggtacctttatgagtataggctgcctgcacttggggattttgtctaccttcgatgtattccagagttgatgactcttcagaaattacaatgaatctttaagattttggaaggaggggtttgtcagctaatttgtgaactaggaataaaatatgactgtttttatttttgtaacaattgatattgatactatatttcttttagaaattttcacttaagcttattgagttttgtactgtttccattgtcctaccacttggaccgtgcctttccttcctccatcagctctttaaaaatggaacagtttaaaagtgcattattttctttgttctttttctgagatcatatccgtttccagttggcttttgcatagaagcagatagccaattatttaaaatctaaagctttagactggatcttgctttaaagcactgtccctgtgtatgaaggatcttggtgtaaacaacttacagttttgaaggatgttctgttaaattgggaaggtctgttttctatcccttgaatcctagaactggaagggaatcttaaggatcctctagctaaatgccttccttcccttctttgggtgaagaaaccaaggcctttgaccaagataaatgagagggagctatattcttagttgaaatttttgaattccgtgtttggtgctttttttctttgtgaaaggtatcttactgaagccattgttttttgttttttgtgttttttttacgagttgaattactttaaaaaattgaacatggtagctttgtttaaaggaccttttaaaataagtttcatgtttttaggtttactcagtgtagcaatttcttattttaccattgctttttgcatcccagttaatccatttggattcagcttccttttgtttgaagtatgcccttcagtgtttctttcaataagcgtctgttaatagtaactcttggtctttgtctaaaaatgtatttattttgccctcattcttgaaatgataattag

SEQ ID NO: 11886 - DNA, 1019 bp, Homo sapiens
gcctggccaacatggtgaaaccccatctctactaaaaatacaaaaattagctgggcatggtggcatgtgcctgtaatcccagctacttgggaggctgaggcaggagaattgcttggacacgggaggcggaagctacagtgagccgagatcatgccactgcactccagactgggggataaagggagactctgtctcaaaaaaaaaaaaaaaaaaaaaaagtctggacacaatggctcatgcctgtaatcccagcactttgggaggccgaggtgggcagatcatttgaggtcaggagttcaacaccagcctgacaaacatggtgaaactccatctctactaaaaataaaaaaagtagccaggtgtggtggcacatgcctgtagtcccagctccttgggaggctgaggcaggagaatcgcctgaatctgggaggtggaggttgcagtgaactgagatcatgccattggcactctagcttgggcgacagaacaagactgtctcaaaaaaaaaaagacttaggcagcaagtaattgctgttcaggcctggtgtatgaactttaagccttgactgggcacggcggctcatgcctgtaatcccagtgctttgggaggctgaggtgggcagatcacctgaggtcaggagttcaagagcagcttggctaacatggtgaaatcccgtttctacaaaaaatacaaaaaattagccgggtgtggtggcatgcgcctgtaatcccagctactcgggaggctaaggcaggagaatcgcttgaacccgggaggtggaggttgcagtgagctgagatcgtgccattgtactccagcttgggcaacaagggcaaaactctgtctcaaaaaaaaaacaaaccacggaactttaagccttaggcacagttatactaactgtaataaatatttgtcatgtttttgcacctgcccagtgtccttcccctttcttctgttaacactatcctgtgtttttgttgagggtagcgtatgggacagtgaggagatggcggaaaag

SEQ ID NO: 11887 - DNA, 1144 bp, Homo sapiens
aaaaccacctcaaatatttcctccaagtctgtggtttatcttttcattctctttaacggtatcttttgtagagcagaagtttttaaatttaatgaagtccaacatcaaatttttctttcatggagtgtgcttttggtattgtatttaaaaactcatcacctaatctaaggtcacaaggattttcttctgttattttctagaaattttatggttttatattttacatttaggtctgtgatccatttagagctaaattttgtgaaaggtgtaaagtatgtggctagatttatttatttattcatttttgcaaatggatatccagttgttccagtaccatttttggaaaagactgtcctttctccattgaatcccctttgctcctttgtcaaagatcagttgactctctttgtgagggtctatttctgggtttactattccattccattgatctgtttgtctattctttttctaataccatacttttttgattattgtagctttacggtaagtgttgaagtcaggtagtatcagtcttccaactttgttctttagtattctggactgttcttggtcttttctgcatttccatgtaaattttaaaatcagttggttgatatccaaaaaataactttgggcttttgattaagactgtatttaatctgtagctcaagttgggaagcactgatacctttttttttttgagacggagtctcgctctgtcgcccaggctgcagtgcagtggcgcaatctcggcttgctgcaagctccgcctggggttcatgccattctcctgcctcagcctcccgagtagctgggactacaggcggccgccaccacgcccagctaactttttgtatttttagtagagacggggtttcaccgtgttagccaggatggttgtgatctcctgacctcatgatctgcctgcctcggcctcccaaagtgctgggattacaggcttgagccatggcgcctggccaggaagcactgatatgttaacaaaataaagtcttcctatccatgaacatgttatatctctctatttattagctcctctttgatttctttcaccaggattttgtagggacattctaaaatctattttggtaattatatttcactataactggcttcctttggaatc

SEQ ID NO: 11888 - DNA, 1007 bp, Homo sapiens
taaaaatacaaaaattagccaggtgtgggtgcctgtcatcccagctacttgggaggctgaggcacgagaattgcttgaacctaggaggtggaggttacagtgagccaagatttcgccattgcactccagcctgggcaacaagagcgaaactccattttaaacaaaaaataaactaaggggaaattagtgagaggtgacagcgcactggcagccctcacacccctcactcactctcagcacctcctctgcctgggcttccactttggcggcacttgaggagcccttcagcccgccgctgcactgtgggagcccctttctcggctggccaaggcggagccggctccctcagcttgccgggaggtgtggagggagaggtgtggagggagaggcatgggcgggaaccggggctgcgcacggtgcttgcaggccagtgcgagttccaggtgggcgtgggctcagcggaccctgcgctcggagcagccagctggccccaccgcccgagcagtgaggggcttttagcacccgggccagcagctgctgtgctcaatttctcacagggccttagctgccttcccacagggcagggctcaggacctgcagcccgccatgcctgagcctccccgaactccgtgggctcctgtgcggcctgagcctccccgagcgccgccccctgctccacagcgcccagtcccatcaaccagccaagggctgaggagtgtgggcacagggcgtgggactggcaggtagctccacctgcagctctggtgcaggatccactgggtgaagccagctgggctcctgagtctggtggggacttggagaacctttatgtctagctcagggattgtaaatacaccaatcggcactctgtatctagctcaaggtttgtaaacacaccaatcagcaccctgtgtctagctcaaggttcgtgaatgcaccaatcaaccctctgtatctagctactctggtggggccttggagaacatttgtgtctagctcagggattg

SEQ ID NO: 11889 - DNA, 1130 bp, Homo sapiens
cacatacatacagagtagtagaatggcaagagctaattattctcaaacacaaattcttaaagataaatgtaaaatttttttttaatttttaaatttttttatttttatttattattatactttaagttttagggatctgtggggttttaagccatggttagtgatagcatgtcatttgaagatgtacccccttaatgacttacaggctcatagtgattttttcttttttgttgttgttatttagattagatttgggtaagtctccgggttggttggaaggactcaggtttatgtggagttttgtcttttagttaatgtgccagtaacagagtttgcccgtttgtgctatgggatactcatgaggtgcccccaaacccagctggctacatatacagcctcttgcttcctcttcactgtctcctgggctcttcctccagctctcctcatgccaaactcgtgactgcatggacacaacatagggaggtgattaggaccatgtattttggaggcaaactgtctgtatttgagtcctgcctaccctggttattagtgaagtggtttgagtaagttacttcaaacttctgtgcacttcagtttcttgatctggaaactgaaggtaatatacctaccttacagggatattgtgaggattaaaatagataatgtaaaatgaaaaaaaaagaaaaaaagtaaaccaaaaagataaaataaaaataagtaaaatagataatgtccattgaacaccttgtaaagtacctgactcataattggctgttaataagtattttaaaaattgttatctgaagttcctccttttttctgtcctttgagctggactctgtaacacctcttagtattacttccttctttttagcttttgtaacttctcatcctcactgcatctttgcccttttcatttgcagttctctctcccctttcttaacctagattttagccttaattgcggtaatggccacctgcttgtttccagttttcatcatcattgccttctcgttctttattcagaaacctgaagaggcttcttagttttctgcgttaaaaaggtagccttggccaggtgcagcgtgtgtaatcaatcacagcactttgggaagcggaggcgggaggat

SEQ ID NO: 11890 - DNA, 1084 bp, Homo sapiens
ttacttttttatctttttgtttgaaaataattttaaatttacagaaaaaaataaaagaacagcatctactattaccagtttgccccctttgctttattacttgctctctcttcatatttatatatgatacatttttctgaaccataagttgtacacatggcccactatcctcaagcacatcagcaggtctccgaagaacaaggacagtttcctacccacagtacagttgtcaaccccagtaaacctgacattgatttaatacttctaactagcccacacgtgtatttcagtcctgtaagttgacacaacgacattcttcatagcattgtactgtctagtacagtcttagtttgcttgggttgctataacaaccttagactgggtagcttataaataacaaattgacttcttatagttctgaaggctaaaagtctgagatcagagtgccagcatgatctggttctggtgagggccctcttctgggttgcagagtaccaatttctcatcgtatacccaagaaagagagctctctgggggtcctttttatatagcatgaatcccattcatgagggctccacctcatgacctaattaccctctaaaggccccagtttcagatactatcacaatggacttagggttttaatttaagaatttagtggggacacaaatatttggtcttgcatacagggtccaattgaggatcgtgttctacatttacttgtgtctttagtttctttacatctggagtcatgccttggcctgcctgccctttttaaaaatgacagtttattgagatacaattaatataccaccaaatttaccatttaaaaaaagttgagatataatttcagtcgtaaaattcgtctttgaaggtgtgcaatgcagtggtttttggtatattcacagttgtgtagtaatcactactatctaattctaggacattttcatcacccccaaaacaaactctgcacattaggtcatacaccatttcccactcctcccagcccctggcaactgctgatttacttcctgtccctatgcatttgccctttctgggtatttcttttttttttttttttttt

SEQ ID NO: 11891 - DNA, 1050 bp, Homo sapiens
acacgcatctaaatcaataaagtaacatgtccatcttagttgatgaatttgtcagggagaagggactatgttagtgtgtaggatgagccatgtggccagatactattatgggtggaaggtcatataacatcagagcgtgttggataaagggtagacagaagggaagagtcagtgagagcactttataacataaaaaagtgaaaatttgctctccctattttttttttttaataaaaaagcactgtggccacatatatacacacatatctgttcatacttacttattgtattcaaaatccagggtactgagttattttttttcttgaatgacagaatgggagagatggtaacatatgtgagaggagaacggactgctcttggcagtcatttgtttcatccaggtggggagactgttatttttttcttttgggagagctaagggatggcagaagataaatgaaagaagaatggtaagagtgaatggagtaggcattagtgattatggaaatagctataggcaaaatgaggctgtggacagagagtggagctaagcatggagggcacggaggaagactccaggatcagctgggctcccccatgtgctgggcctggaagaatgggactagggaagtgcgggggtgggtgcaacaggagtcatggagatgcacatataattgaaggatttccatcaaaacacggttaaaataactatactagatagtctgccttttagcaacttaccagtattccatttctgttagtaggaattgtgtattcagttacacaggggaaagcagcagtgccactttttcagtcatcttgatgactgggttgtatccctaataatgatgtcgatggtaaagaggctaaagctaaaattaggttttgggttttgggcagttactcatatttcattgaaaatgaaagactaattgtatttttattttaatagagaaagatatacatatgtgtgtattgtctgtaattaaagtacactcagtacagtgttctcatttttttgccctaggggtttttcagcttggggtctgt

SEQ ID NO: 11892 - DNA, 1043 bp, Homo sapiens
gcctcgcaagtccgggaggcgaggggggcccgaggggagacgccgtgacaactttcgtttccctctgagggaattgggaggtcggcggccccaaaagtaagtggccttggcgggccgcgcggggtgtgcgggcgggagggtgcggggcccggggcgccctcccgcccggccgcatggacgctccgcagcgcgccccgactcccggtgccgggcgccgcgctccagccccgccgtctctgccttcccgggcgtaccggccaccctttcgggaggcggcgtgggggcgaccgcggccgggggccgcaggagcgtttgaagcgggggtgtaggcctggccggaggctggccggagcgggaagggggcgtgcggccgggcgcggggtcgcagtgggtgcgctcccggccgctgcgcggcgcttggaccgggccccgccgagaggagcggccgccgcgggacgcggcacctttgcgggcgaagctgctcacttccaggcgcgactgttacacaacacgcctgccaagtggggccctggcctgactgttcccattatccccagttcgcctttggtgtaagcagcgaggccacctgggtggtgacggtgctgctttcttcaaccaaccaaccgaaaaagccctcaattttcggacaggggctcgggtcttggcgttggggggcccgacgcctagtgacttctttatttacactagctgcaaaacgtgagaaataaaaaagcccagggtctgtgtatcacgtgtagtttcatgtaatgaaacaccacagagggaaatattttcagatgctgggtttatttcctaaagaataccaataatgaaccagagaaaaggcaagtagatctgaaaatgaatggatactgcaaaatcctaaagaagtttaggaaacatcaactgcaaggattcttggcgttttgaagtcgtgggtgtctcagattggagaaagcacacctctaaccagcctgtgatgaataagctggggaggaaaaaaacctgttgcataatctcatttgccgtggggtttgctgtgc

SEQ ID NO: 11893 - DNA, 1078 bp, Homo sapiens
tttgtagttttttagtagagacagggtttcaccatcttggccaggctggtcttgaactcctgaccttgtgatccacctgcctcggcctcccaaagtgctgggattacaggcgtgagccaccacgcctggccatcatttgttttaatattttgttagaatctggatccaagtcagattttgtagtactttctttttgttgttgttgttaagagacaaggccttgctctgttgcccaggctgcagtgcagtggtgtgatcatagctcactgcagcctcaaactcctgggctcaggtaatcctcccacctcagcctctcaagtagctggtactacagttgcacacaaccacacctggctgatggtacatttttaagcttttattaatctgtgaatttctttaccaacacaactttacattcttcctttccatctgtggatcatttgtcttcttattatctgtactggattttgctgattatatttccgtgacattttaccacatccctctgagccccgtattgcctgtaaattagtagttgaaactaaagactagatcagattcaagtttttgaagttttggtgagaatatttcctacgtggtggtgtttacttccttcaggggcccacagtgtctgattgtccctgattgagtgatgttggtgaccatagttcatcattgcctagatgtcttgttccattagaggccataaaacgataatgttctctgtttctccttcttcttttattacctgcaatatttcagtaaagagaaacttcccctcgtttactatttggcttcctttatttcatatagaaaaagccagatacatgcttacttgataccttctctttatttaccagttttcagaatgataatttcattctgtaacatcctcaaggtaaagtggtctgcatcttcgttttttgagtgtaattataaacatatgaatttaaacatatttgatacgtttcagtttgttacagatattattcttattgatgctctaattgccccactgttggccagcgggagcctcttcaagttggtttgttggtccttttgacacagctccagtagt

SEQ ID NO: 11894 - DNA, 1002 bp, Homo sapiens
gtgacatttgattaaatgtaaaataagaaatcccttgaaaattgtttagaagagaaaataaatatctcattactgttaagtgattactgtgggggtttttttgtttttgtttttttttttaacagacctccaactcgggcagtttctatccttcctcttcttggacatggtgttccacgtttgccccctggcagaaaacctcctggccctccccctggtccacctcctcctcaagtcgtgcagatgtatggccgtaaagtgggttttgccctagatcttccccctcgtaggcgagatgaagacatgttatatagtcctgaacttggtgagaagtgactgttcttttgcttttataactatcattttttatgttggccctgtttaacatattgttcaccaccctcagaacttagaaagtaaatgagagggtatcatgtacataactaatatacatacagttggataaatcataggatcttctcaagtaaaagcatcatacataagtatagaaatgtttatcgtgttttaaattaggcttttcctggagatgtcactcttgctgctaatcctttaagacttgtatatctggttcccttttagctttattgtcatcagactagagcgtcattgtatacattcactgactgtgtatgtgtatacaaacatgattgttgctaaaggaggaaatgggttttcaaattagaactctttttaaaaaaatcttaaattaccaaaaagaagtgtttaaaattattggcagaggaaaattttgttagactgtatgagtagctatatatacaagaattttttttttttttttttggtaagaattaagttgttacagtctgagttgaatagcataattttctgtatttctgggtaccatgtagtggagggtccaatcatactacttctccatgttcccttcccacttttcagcccagcgaggtcatgatgatgatgtttctagcaccagtgaagatgatggctatcctgaggaca

SEQ ID NO: 11895 - DNA, 1026 bp, Homo sapiens
tttttttaggtggtttaactacctaaaatatcttatgagggagactggtgttacatttttatttcttctctcctaccccccctctctcttctctttcttgagacccaaagtattattattatccagataaatgctagaaaaatcaaaagcaaaataaagaagaggccaattgataagtcgccaccaaacaatccaaaattgatgcttaaattacagtgcatgagccatatcaaccatgtagctatattaggatcatgtgtataataaataagcaaaacaatctttgatgagcttttaaaattagtttatttccaaacagagagaacaaaataaatgaggtataaagtgaaattttcctataaaatactccagtgtgctacatggaaacattgacctgtacccatgtttgtatagctgttagattttggttttgtctgacaatttactaagaaatttactcttagagttgctagcaagagaatattcctgtggcatttgtgttgaaatgaacataagattggcaaagtgaatctgaagtggaatcttctaatttgaataaggtaatgactcttggattattaaggctaaaagataaaatatgtaaatatttgagcctgtgaaataatttttaacacatttattaatggagaataatcaatattttgtgattaaatatatatgtattaatcagatatgtgttcttgcacattctttaaagttaagcgaatatgagtaacttgaagaagttagaaacaaaccaaataaaactaatagtaaaatgttaaatgcttgtcaattgagttctacttctagacctacagtgtcaatgatggtaagataaattcctctttgtatcacacactttaaaatgctgaaatatatataacacatggctgagccaaaataaatgtgaaaaaatattgaagacgcaagaataatagctggataagggagctctagaacattactggaacagtaagctggaacagacttctaatttcagccttgaaatggaacgagcttgta

SEQ ID NO: 11896 - DNA, 1053 bp, Homo sapiens
gactgctttaagtattttattggcccaaatataggaagattgtttgtggggaataataataacaattcattctttcattctaatacagtattgaatacattaaaaatatttctaagccttgaatgctaaggggattagcaactcagtttctgtcccacctaactccttctcttactctgagaatcttaccctttactccctccttccctcctgtcctgcctctctcctccttgccctccttcttccctcagcatctaccagcattataaacactcctttcagatatacttccatcctttcataatacgcttcccacttccttgaccccatcccactggtcagtgagtagtagagcgagctgaaaagaatgagggctccttcccacaccggtttccacaggtgttagtcatttgccgtgaagtggactgatgaaggttgatgtgttgtttttgagtaatagtttaattaaaaagtgatgtgtctgtgtgtggtgtgtatttttgtttttgatctctgtggaaattgggaggactctgttaaaatcaatactacctgatatttgggccattttagaatttaaaagtaaatactgttctaatcaaaggaccagattaccaaaaggtctttttgcatgtaatatgctaatcctaaattagaataattaaaattgtgccagtgcagtatctaaactttgccttaattacaaataattgtcctgtatctttgattctaaaaagaaaatgtgccttttgagaatttggagactctcacaatgcattatctattaaaattattttacttagatttaaagtgttaactattatgtgtgttttaaatagggaatatgcacaaatgctgttttataagtatgcctaacaatcatgattttaaaattattaaaaagcattttgtcacacctaccttttttaatacaaatggccacaggtccctttctagtattcgtttgtaagttgcaatcataaacatttaaagaccataccattaccctcacaaccatccaccccgtgacatttccattttaacaagggaaat

SEQ ID NO: 11897 - DNA, 1422 bp, Homo sapiens
tatactcagcagtcattgagctaataatgttagggataatccaccacaacaccaacttctctttgttagattctaattgacagttcatcttcttgaatatataaggtgaattatcacaataaattttgtaaggaaaaaaagtaatttttatatactttttctttctatcaccaaaatggagacaatggggctttccaaaagagtcattttagtccttaagtcctttaagtactttagtccttaagtacttcaaataatgcaggctgttctttggaggtaaaatggaccttgggtagattcaccataatgataccttacctactgtatactcataaatgtcttcttagtgtaattcctgagaatcattcaatcaacactatgttgatgctgagttaattatcagaagtagaaaaattttctttgttgaagtctagggaacttctttcgtagaatggcttttatatggaaattatacctttattttcttgtacatgacagatacttgatgatcggaagcaatggtggaaagttcgaaatgcaagtggagactctggatttgtgccaaataacattttggatattgtgagacctccagaatctggattggggcgtgctgatccaccttatactcatactatacaggtgagcatgatttcttagtaaaatgtagtatgtacacatttacgaagttatcactcttaagtaggatttaaacacctttgtgtattgatcattttgagatgtagttggttatatattttttctagagtaattggtgggggagtggcaatggtgagagacacagggaagaattacacatatgttttctgatttacttctagaaattgttcaagatgtttagcagtaggtacctgattctctgaatgctttttttccccaatctgtagtatttctgacatttgaagaaatggtatttctgtctttttacccacagctctgctatccaccaggggcttcctcttgatagaggatggcactgatatcacggcatggtgtccagcagttcaccttcaccagcccttgctttcagtctcttaaatgttctgccactgaccagccttgaacttgcactcatctcaccttacactaatacatgagtacctgttcacctggattacaatatttttcctctcttgattttaagattaaaaggtacttaggatatagattagataggtcaggctctctcttcttgttcattgaaggcccatgaaggtccattcttatggcccatgccacattttcaggatttcagtgaccctggtcagctcattcaccctaacatctgaattaacttgctcttaaactccggaattttagacctgtgccaggctctctagagttaggtctgtaaacaaagacagaatggatggactctctcaggtacagccagtgaacctg

SEQ ID NO: 11898 - DNA, 1049 bp, Homo sapiens
taaaaggtatccatcatatgactgttcttgtcaagtgggccctatgagcgtggcatcatttcaccttggcattctgtttaaaaacaattataacatagaacttagtgttactttttatatgttagaatattttactagaatctgaaatgtttataactaaaaaaatgccttaaaatatgtttggtctagtatcttcattttaaggacgaataaattgtgattcagcaggctccaatctgatgaactctagagcctcattcttttgccgctactccagtggaacttcttaacttcttattctttatccagtaaagtattattcacacagggtatctggcactatagttaaacgatataactcatttccaaaaatgagtcacctcggactctactttggatgtgcagagtaaaagttggactctgaagcaagacctgatatgtctacctgtgtggtcttgggaagttatctctctgtacttcggtctcatctctgaaatggggataataattcatgggttgctctgaatctgaaagtaaataatgtttatggtagtacctactacaaaatagtaagcataatttgtggttttcattttgccaaattgagttcattttctttctgaattgttttctattttgtttaggtttcttgtattcttaaaggttttttcagaggttgaaatgtaagccgagctaccaaagatatgaaaaaaagaattctttgatgcatttatttaaaaaaaaattaattaacagagatatgtagtttaattttataacagtttccgttttcataagttatgtaaatttgtattgatctgctttgtatttaaaatgtgtttaaaagacagtaatttattgtattctatactttttgtgtacttatggtgtttttgttgttactgtttcgatgaagagggtctgaagtagaggaaggataagacaagtttacagacattctgaacaaacctgtaaaaatatatgttgaacctaatatatataatatatattatgtatattatatgttgaaccatatatatatgtgtgtg

SEQ ID NO: 11899 - DNA, 1049 bp, Homo sapiens
ccattttaataacttgattttgccatttttaaattaccatacaagaaatttctgagccagcatgtgaaagactctgcatcattattgtcactgacaccgtaacacttacttaggaagataaatattaatttctctctcctccagttataacagtaacattttacttagctactgttatcagaatactggaaattttatatttttttccaactaggctgtttgtcaaagcctttaagcactaaaatttaaaattgtttttaagggaaataattgtaaagtatattaaatattcccttcgcttgggtgtggcagctgtaatctcttcttggggacaaaggatcatgcatatgcacattagcttatgcactgtgaaactcagggactgcactccttacctttacaccaaatcattcagattcatctcctttttgaatatttagggctgctttttccatgtgactgggtctcaagcctgtcccttttccatgttgttataacacgtgagcttctagcatggcttctggtatctgtaggctgggaaactagataaaaaatgttcttagtgaataggttctaagtggggacttgagagtcttttttttttttttttttttttttttgagatggagtcttgccctgtcgcccaggctggagtgcagtggcgcaatctcggctcactcctgggttcacgccattctcctgtctcagcctcctgagtagctgggactacaggcgcccgccaccacgcctggctaatttttttgtatttttaatagagacggggtttcaccgtgttagccaggatggtctcgatctcctgaccttgagatctgcccgcctccgtctcccaaagtgctgggattacaggcgtgagccaccacgcccagccgagagagtcttttccactagagtctgtatgttaaaatatgcacgtgttaatgtatagacatggtggcatctctaacaaacgctcagaggacttcatttatttaagtgtgggtattattctatgttctgaatagatagactttccagaaagctaacttctc

SEQ ID NO: 11900 - DNA, 1058 bp, Homo sapiens
actataaatgatccttttgatgtctctctgccccattatactatatatttctaaaagtcattatctttcttttttgttaatttttttttattggtagaaatgggaccttactatgttgaccaggctggtcttgaattcctggcctcaagcaatacccccaccttgacttcccaaagtgttgggattacaggcatagtaaatcactgtgcccagcctctcttgccttttttggtctagtcattctttcagggagattttatcctctagatccacccctaatctagttgcccttgaacttcacactttgctgtcttctattgcctataatgtggtcttttcttaaagatgctttttctttcccctaaaatttctttataagcagtgaagcttcaaggaaagtttgtcctagcttttctgtgagttggatgaggtgctagagatttgttttcttagtaggattacctactgacaatctggcttgttttttttatattcagccaagtgtagacagttagtggaactgacttttttgtttggtcttgactcttctttattgcatcactttctagcagcctattaggactgcctctattcttgaagataaatgaaaaatactattttgaaaagagtgcatttttatctttgtgggcaaaatgttaagaggcataggataataggaagaaggaacagttaagaattgagggttttaacttacctgcttagtcgtgaacttttcatagacataaagttatacattttgctcttgatacagtctgatacctagaaaagtatacaacgtattctgttagaaagcaattacattcccccatataatcattctgctggccattggatctgtaaaaccatgtattactaaaatagagcagacaaattgaaacaatggataatccttgataagatataatacctctgtgttcccttatcaaaacaatcaatgttagaatattatggcaggcaggaagagaggaagttgagataagaaatagtgactatcaataaaatatatgagaagtagtttgggggtagtgtaagtatgt

SEQ ID NO: 11901 - DNA, 1028 bp, Homo sapiens
aatctggcaagtacttttgtgttctctttattgcaaatcatattctttttcatctttaagaaatgttgtttcttagtaaacagtaggtcatttatttgacttctccaaaaaataattgactatttaaagaaaaatagttttaaggaacatttaccagttgcttttttatgtagatagtgagtgtaggatgtagcagataggccgggcttcatagtcttcactgtttagttttgggcatgcatgctctctgagccttaaatgttatagttgtaaaaggggtgtagtgttgggattgttaggattaaatgagatagtgtatataaaatgcctcgtacattgtggagcacaaagaagttcacagaataatgtaagtattgttattactgatatcttctcctcattgttgttgtcattatcaccataattatgtgggaaaacctaaagggagttttgtactaatgggctcaaaatggaatgcattgttgatgaaggtctcgatacagtagatcaccttgacaaattgtgtgtagtcatagtttctttgatacaccattcatctcgttaagatgagaatgtccagccagccctagagatatgtcaacatttctggctgagattaatatagacttatgaaaatgggttaattggtcactaatgagctgcattactgggaatagggttagagttttatgaaatgcgtagtttcactttagacttacctactctcaggagtaggcagttatttaagtagtagccagtttgaaagaaaaaaatctaccttttcagtttgtttcctttttatggataaaatgaaaaaattccatcctgaaatcagattttaaggaacagatatatatagtgattaaccacccagcttccttttgcctacacacacacatgcacacacacactttatcttctgtttttcattcagaatatgactgcacaagctgtaggggttagctaacagcacactgaacagctttttgctgccagtttgggggatgattgaaattattgacccttac

SEQ ID NO: 11902 - DNA, 1076 bp, Homo sapiens
tgatgcttctttttctcctataaaggtgttcatagaatgtgcaatcccatgtaaaagctgtgtgttaaagaaaatggtgtaactcttcaaccctcataaggctttgtgagattttatggcatgatcgcatttattgtcatgatagtaattcagtttaataatgttaactagtttcatttggacaacgtatttgccctggtcattcatcctttgttgttttaaacttacatgtactgggaaaccacatataatagctcttgatgtttctactaaaaggcagagaacttgagctattatctagatagtctatgaaaattttaaagatggggcagtgtctttgtttaatttctctttgtgtatttccaaggatttgaaagtgaacaatgggaggtctatattttgctagcaatgattgctacactcacctgacaaaataaaagtgatttctttttctgtggtttaaagaatttttttttttttttggatacatagtcatagatttttggagtcagatggggactgtagagactgtctaattcagggataatacctggtttccatttctatgctgactttataatttagtagtggctgtttacagcaatgttgagaattcccacatctttgggttcagcttggcattaaagagtgtaatgataaattattgatgttttttatgggaacggggagggcccgcacaaacgtcatgtacttgctatcctgatctactctagttcttttgtttttcaggtgaggaaactaaaatctactgaacttagtctataataagcagttaggttgtaaagtgttcttttatactcatttctttgaaacaggtagagtttttctttacaaataatgttaaaaataatggacaattggccaggcatggtggctcacgcctataataccagcactttgggaggctgaggtgggtggatcacgaggtcaggagatcgagaccatcctgtccaacgtggtgaaacccatctctactaaaaatacaaaaattagctgggcgtggtggcacatgccagtaatcccagctacttgggaggctgaggcaggagaatcac

SEQ ID NO: 11903 - DNA, 1021 bp, Homo sapiens
caggctggagtgcagtggtgtgatcatagctcactgcagcctcgagctcctaggctcaagtgatccttaagtcatgggtgggtggatcacttgagtccaggagtttgagaccaatgtgggcaacatgacaaaaccctatctctacaaaaaatacagaaattagccatggtggcatgtgcctgtagtcccagctacttgagaggctgatatgagaggattacttgagcctgggagtttgaggctgcaatgagccaagatcatgccactacactgcagcatgggtgaaagagcgagaccctagtctcaaaaaagaaaaaaaaaaacctaattaaaaaaacatgaaaattacaaataattgtggcactggaactattttgggtattattcaactgctaagaataaaatcagcataactgcagaatacatctgagaaataataaaacatgactttggtcagaaagttcaggaaatttttgtactgtgtccaatttattttgctctgtgatcagattctcgtgaatgctagtgttagacaaaagactgaaaatagagttactatatagagatgttcattgtttggggagaaattcaatagagtcttgaatattctcgtgatgtgcagaataattatatagagattattttaaatcataaatacatcttatatcttaacatcttaaatgttttgctttccagatatactcaagatatttctgtgaaaatgttttttcttaatatttgccaacaagagcgtcttatatttgtgtaatttttccaaagttgagtaataactgtaatgctagtttgcttatttttcataaaactctgagtgattttctttaatatatccttgaaaatgcatttttcatttattttttcttattcttgttgtatgtatatatcaagtgtggcatttattttgagagtcttgataaaattggcaaaagtagagttacaattttatgttaataatgaaagaatgacatataatatttgcctgattgtatctcttattttttgt

SEQ ID NO: 11904 - DNA, 1016 bp, Homo sapiens
tagagacggggtttcaccgcattagccaggatggtctcgatctcctgacctcgtgatccacccacctcggcctcccaaagtgctgtgattacaggcatgagccaccgcccccggccttcccctttcttttgtattgaaattagctctcaatactgccacaaagaattctttgtaatgagttagccacaaaaatagttcagttctaggaagaatttcttttctttttcttttctttttttttttaagagacagtcttgttctgttacccaggctggagtgcagtgcaatcctacggagaatttctagcccattagaagaacacatccatgaccccccttctcctttacctgccatatgcaactgattgccagattttgctgctttcacattaaagttaaccctcgcctttgccccttctgttcagtttttcactgtttcaaggctatatgaccattttcttaagctattccctcctgaatgtctctgtatctgcctctgtcctacttcaattcatgttaattactactttcagatcagtcttgctaaagctgagttcagatgatgtcagtccattgctttaaaaactgctaacaaaggtttccttttcaggcttttcacaacctggtgactttctttaattttagcctcactacccgctttcctataaattactcattagccaaagtgaggtactatacactttcatctgtatacttcagttttcccagtctgtgcttcagtgtccctcttgtctatatttggaataactttttaatttatctctatatacaaatcgaatccatcagttaaggtctactttatctgccattgtagaataatctaccttctttggtacctctcccacttaatattttttttctcaggatcgcctaggcacttattttctttcgtgaactgtaatttatatacatgtgtgttacctgataccaggtatcaagctcctctaaggtaggctccatatctgatttttacttttggacaggccttaaagcctg

SEQ ID NO: 11905 - DNA, 1098 bp, Homo sapiens
acctaatgtctaattttgaatattttgcttgtttgtgatcaaacttaaagatttattttgtttttatttctagctttttcctgctttcaaggttttatcaatactgattcttttcagataccagttcttttctatgctatggcataggcttgctactctctactttgtgtttattacattccaaatcctagttattttcttacactctgtttcacaccctttaccctactgctttttattcttctctctactcccttcttttacatacctcttttaattctgcagcaggtcacttgaaccaaggtttgtataagaaaacatagtatccagaataggaaatgataggtttttaaaagttgtctctttaaatacttgaagttctattggatgaatattttaacactgatttatgtaatatttatatacaactcagctttcctgagttgtgtgaaacatacttggtagttacacggatcatcacaaaacaacataagttaatgataaggtacaaacttttggacatctgtagaggtatgtcgggggaaaaagtggaattttaattaaagtattctggctatagtaaatccctcctgggaattattaatactacatgaaattgtttgcagctgttagtgattgaaaatatttttgtaagaaaaattctgcattggaatagttgcaaacattttaagttgaatatatgcaagaaagtttaagggtcttcagtgcttcactacaaccttttcagtattttctagatgtattcctaaatgggatttaaaaaaatagaccttatttctcagaagttttggatttacaggaaagctacaaatacggtgtctatatacccccataccagcttcccctcttattaacatcttgtattattggtatttgttactattaatgaaccagtatcagtacattagtattaacaaagtttatactttatttagatttccttagtttttaatgtcctttttctgttccaggaccctaccatccaggacaccactaaatgtatttcctcgtaatgtctccctaggctcctcttggctgtgacagtttgttagacttccttgtttttgatgatgtttg

SEQ ID NO: 11906 - DNA, 1032 bp, Homo sapiens
gatacagaaagaatattttgaaatatttaatctcatgagaaaactgaatagctggatttttaccaaggtgcttgctttgttttttttttttttttgtaggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgc

SEQ ID NO: 11907 - DNA, 1043 bp, Homo sapiens
agtagcaggtgttgtggctcccacacttcctcgtgaagatctggagaagattattgcacactttctaatacagcagtatcttaagtatgtacaaactcattcattattctttcaggttgtctttatggtttttttttaaaaattgcaacagaataaacggttttgcagttattttgtgtgaacttttaaatgctatagaaagtaatttacctaaaacactcaaactttaatcactataaataaaaaaaagtaacgaaaatattttctttaaaggctttatttgcattcttgtaaattttattatttcaagtcaatgtgttaagaattactgcgcatatagttatttcttttataaatttgttttccgtgattccttcaaaagctttcttattgttggcctttattttctgcagagaagactacagttttacagcttatgctaccatttcgtatttgaaaataggacctaaagctaatcttctgaacaatgaggcacatgctattactatgcaagtgacaaagtccacgcagaactctttcagggtaaatggctattaattttcagttttatatattttaaaaagtatattaaagcctatgggatgcttttctgtcatattcccctaggtccagttgaacatgagaaaagtcagttttctgattagatttctgggtatggaagagagaaaatatagttttctgtaaagatgtaagtgaaagaatttagactggccttttaacataaactaggggtttccagtttcttggaatgggaggactccgtttgaatatctaattttgttatgcactctgctcttatttggttgtgattactaatagttgagaagtctgtttctgctgttccagtggttagaaaccactgttttaaaccaaatactatcaagtctgcaaaagcatgtcaagtcaagtgccattgtgtctaaggacatttgaggtctttagaacttctctcacaacgtagccccttttattcaaaatagagctcatatttgaatagaaatttgtagataaaaaactagacc

SEQ ID NO: 11908 - DNA, 1050 bp, Homo sapiens
ggacgtgcaggtatgtaggactcaaatccagaagtaaatttttagaaagcttttccaaaaaatacatgataaatgcttaataagtctgtatgttttatctttattggatagtatttttagaacaatgtatttttagcagtttgacacttacttgcatatggagaaatttttacttatgttctgttatctgaattgtttctttttatgtgtgttaagataatttgatgttcatctttgcctcctgaatttttaattagtgatttcaaatctataacttaactggattatagacacattttttaacttagtagagctgattattgatgtctctttagagttttttttaatttgagggtacccattacaaattaacttccacatctctaaaatttctagatgtagtataaaacattgcctgctaattttaccatatgtcatttttgcatattttgaatttgtaaatgtaattctgcaatctcaaggtttctcacaccacaggtcgagatgacatgaaagcagactgtattttgtactacggctttggagatatattcagaataagttcaatggtggtgatggaaaatgtgggacagcagaagctttatgagatggtatcatactgtcaaaacataagcaagtaagccacatacctttttataacttttatcaattaaagcaaatatgaaagtatatgacatcgtttttaagttcttactaaatacattggtggaacaccaaagtgcagatccataaaagcagatgttggagggtaggaaccagcacatcaacctgtatgatctgccttagttcaagaaaagatgccctatctttgagataatcctccaaaactacttttttaattgaaggtttttgagacacattgatagcaacttgaaggctttttttctctggcactgctgtacagttacatgatttaataattttgaaaaggtctatggttaagataggcattttgagagtcaagctcagtaacgtgccaccttgccagctcatgtgtcaatgaaataccaagtttctccttaagaagta

SEQ ID NO: 11909 - DNA, 1047 bp, Homo sapiens
atgattaattttattatttatgttgatgtattttgcttaatctggtacatttgaatctatccaacttatttataagattgccatcctcccagttttacaggtagggaaagaggcttggaggaacagcatatgcaactttgcctaacatagtaatttagtcacatagcaattggtgctagacctgttgaatgtttgctgttttttgttacatcactttgtatcttgtggatgtttgctgagtgtcattgctactgtatttgtcatgtatacgtttatgtgactttggacacttctctgaaatctagagagttagtcgttctgagtgttgtgggttattaagctgaaatatagagttttccataaaaaattagtgtcaaaagaaccatgtggttcttatttgaaaggtcactgcaatatataatttactttctaacattttccgtgcttaggaatgacagattactgttgagtgaacatcattaatagtactatttttaaaaacttgttgtcactgttgtgcttttatttttagaaagaaatttggattattttagaaacaaatttggaaagaaaaagaatggcgtccgtttcaggttagtagcaatgattacattttcttcttccttctgttctatttctgtttgtatgatatttgaaaaagtttgttttaaaaattctgattatagaaatgatttttttcagcttttttattgaagtaaaatacacattacaaactttgccatgctaaccattattaagtgaataattcattggcattaaatgcatttagactgttgtgcagtcgtcaccactatccatctccagagctttttcatctatccagactaaaattctatactcattaatccgtaactttccattacttctcttctcctaatccctgatagccactattctactttctgtttcttgactattttaggtacctcatataaatggaatcatataacatttgtccttttgtgtctaatttttaccttatttgtgtccaaataaaggcaatagcggaatcatgcttttgcctat

SEQ ID NO: 11910 - DNA, 1013 bp, Homo sapiens
tttctcatagtgtatgtttgcatattctatgtataaaacctaattcaaaacataagtattggggaaatgtggacctgtaagtgatgaaaattagattagggaatgagttcaggcctatcaagttttctacaattctttctgttggaacatcggacctttgattattctcttttttcccccctttagagattagttcttgctctgtcacccaggctggagagtagtaccgctgtcatagctcactgaagcttcaaactcctgggctcaaacagtcctcccacctcagcctcctgtctttgatcatttttacttacagtttcatgtcttaatctcgatgctttgttgttctggcaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgtgcttctgtttctgggattccttccttaatgattcctgaaagatttcagtcagtctgccaagtcattcttaccacacgtcataaatgtccctaaattccaacatcatctacactcctccctctggatgagacaaaaattcttttttgcaacaggtgccacggtttgttgttgttgtcctgagaatatgattatctttttaaggttataactgaagaagttgtaacggatgtcaatgtatatgacatttacaaaggaagcccgttttaaaaggaagaacccctaaaatggaaac

SEQ ID NO: 11911 - DNA, 1028 bp, Homo sapiens
tccatgttgaaaaatctatccaggattcatcccgtgtcaacaatggtaaaggtaagacaaactaccacaaaatgtaatatgatttctcgcattgtattctacaaaaagattcatttaaagaggctcagaccagataaaatcatagttcaaggttatttctgtctctcaaagttttatgtaaactattctcattttccaacagaagtcttggacagcaagggcagaaaacttagagaatctaagacattcaatagattgttgtcattctttatataattttgcaaattaaatattaactctgaatcttagcacattcttaaagtattgatcatttgaataagtgtaatagagtttcatttaaagttgatgtactaaactctagattgcctttcatatagcacttgataccttagcaaatacagtttaattcaaaagctatggagcaaatgcacaaaacaggtagaaattaatgattttttaaacaaaactaaaattatattaaaatattttgtaagacaactgactcattttccacaagtcagtgtaaatcaagtgtgtcaataattgggtaattactgagtctttgggtacatacataggaatttgtttattctatctacttttgtgtatgtacaaaatttttgaaattaaaagtttaaaaactgacattaaggtatgtttaatataattagttatatagttaaattgaccctgtgaataaattacccacacgaactggtaaagtgttttggaaattgtatttttttttttttttttagcaattcttgggtattccaagcatcttgccttttaatggtctctaactattacccaggacctcataagttggctaccacctgaaatttcttcctaactaaaagtctttaagcaacttaaaatttcatagaaagtaatccattaagaaccacaattaaaagcaatttaatttgaagactcatatatcaaaatttattaaagtgtatttaaatagagcagtgttcaataaaatacgtatataataaaattaa

SEQ ID NO: 11912 - DNA, 1035 bp, Homo sapiens
cacagtacacttcccaaaatcaggaaatgtaaccctgaaacaatattatctaatccagagtccattattcacaagttatcaactgtctcaatagtgtcctctaaagcttttttcctaattcagaatccattctaggctcacacattacatctactatatatccttagcctccttcattctggaacagtttctcagtctatctctgtttctcatgatcttgacatttttgaaaagtcaggtgagttattttgtggaatgcccatcattttagacttgtctgattgtttctttatcattaggttgagctatgaacttttggtgcaaataccacagaaatgaccctatagttttctcatggcatcacatccaaaggcatgtaatgtcagtgtggccaacaattggtgacactaactgtgataactcagttaaggttgtattttgccaggttactctgtgtgaagttactgcttttcctttgtaatttatgagtaatttgtgggaagatgttttgatgctgactaggaaaatgtctgactcctcatcaatttttctctgctaaatttagcatctattaatgatttgtggttgaataaattaccatgatagttgtcaaacatgatctactaattccatcatttattctgtattagttgcattccactgtaagacagaaatttttcatcttccctctttatttatttgttgatatcaatgtggcctcggatttttatctcatgcccaaaatattgtgtcactatcatttgtaatgctcaagttgtcccaggcttttcaaactgactcttacgtctttttttttttaacatgtcccatcatttttgagcactgtcttgcacaataaattgcaccagcctcattttgaactttccccttcccagcactagaatcagctgtttccctaatgagccctgtttccttttagtgaggaatggtagttagaaaccaggatcagggcataggtgtgcttgtgctactggtatatctttgcttctaggccctttgagtagacagagctat

SEQ ID NO: 11913 - DNA, 1050 bp, Homo sapiens
aaacttgcagcgctaaaaagcaaataagcttcctaaaaatattgagtattagaaatccaagttttagtttccagacaaaaccaaacacttcactgccttccttcccttcctaaattttaactttttaagataaaagtaacttaaaattggtttttgtttttgtttttttttttttttttttttgatgtctacctattggagtcactgtttacacttcattttattcctgacaattcattgaattcatagccaaaaacatactttcgggtcatctttattttctgaggcagtttgatgtttggattattgcagtgtagctcaagggagaaaaaagaagccacaggaacattaaacttcaagcccttacaatacagaaaacttaattcacatatatgttctagaagcttatgtatggttaggcttttagagcatgtcatataggttatgttataatgaagagttgcatttaaagtacctgtttttgcttttctttttaaagattattctgtgactgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccaggtattattgtatactttaagtctctgttctgttaagttcagtgttttggtgtttctgttgttattgttttggactaaaatcagtcccagtattcatttacagaagcagtttacatgtcttctttcattggccctaaatagtggtgtttgcaaaacaaatgcctctgtcccaggccagatgttcaaaaaatgtgacaagagttttagctaaagcaatttcatgtttttgcttcatctggcttggttatagattctgaaggcttttaaaacttttttataaagattatcctgggatggagaatgaagcattcgaacatagtttcaatttgtaagaaacattttgacatatttgaccttttattttctggaaaatcccat

SEQ ID NO: 11914 - DNA, 1050 bp, Homo sapiens
atcagaacaacgaatctgtatttatatagccactgtttcttcattttcattttccactgcttcctgggccccctgtataccaaaacggtcgtaaacagaccatctaacaacaataaacttaagtgcagaacaactattcatgtgtgtcgtccttcaaaaagagatgcagcattctttcttctgagcctgtttaaaatgcaggccatgtctgaatttatttcattttaaggtcatctatttgtggaggcacttgcacaacattgcatcttctctctttaacgtccactaggaaactgtaaatgtgatctgtaaaggcgaaagaatctccttttaatttatccttacagatgggaggaaatattttttggaaaaaaaactataagataaaatagttgttacacagttgtctccaaattcagatgctttattccaactttgagtcctgctaactcttactttacgtatacagttaatagactagacttattgcttagtccattgcagattagaattaaaaactagactgggaagctctggtacagtttgagacaggtatggtgacctcagatgcgacataaaaagtaaaaaacaagtgaaaatcatggacattacaatgggctactacaattataagtaataattgtgaagaaaaggcttatttgccatctgtattctctgttcaagaagacagggtggtatatatttagtgtactataaattgccatggaattgatgtttatttcgataagttttgctctttttttcagttatctagaaaacacatctggttatctgatggcacaagtacatttggtgttactgtacagatcgttcattttccaacaggtttcggttttgtttttttttttacattttaggggtctttagtttggatggttagacagaaactgtttcagagactgatagtctcctaatgtgatcccctgaaacgacaatgtattaagtgtctatctactttccaagaagcttcttaggtgccctaaaaggaattcaggttgatatttttgcagactttgaataaaaattatt

SEQ ID NO: 11915 - DNA, 1033 bp, Homo sapiens
aaaaaagaaatggtaacagcaaaccttaaaaatcttcattctctcccaatgagaatgtaaaaggtgactaataataattctaattctttgcatttttccctttgtgaattcaatgtccaaccatatcactaaaattggaaacaacatttttcattgaatattcaccagtatttccaaataatgtttgaccattcttctcttagggtgactcattttctcctccatgtattttctcctgcaaggagtctctttgactccatttaatatgagtcaaaaaatagaccaatatatttcctctttctcgatattatccagcctacctctttctgtaacagaacaaagaaacagctaaacacttttatctcttgagattgtttagcatagcaagtgtcagtaaaaagctgggtcttgtaccatatgtaatatttagaattcataaacaatatacaaaatgtggctcatgaatagtctcttaaaccattaaaacaaactatttgggatatttatcattagactgctctctgaggtatggatacattatcagaaatcagtgttgtatccataccccttctctggggtccatttttattcttgccatgttttggggctataccagatatctttttgtgggtagttagtgcaataggcaattactgtagttttccatgaatcattttagcaacaaaagagaaaggcaactttcgcacttcacttaaaagctaatcaaaagaataatccatgtattcttgcttatccctcataattttctaccaaagtgcactgtacataccaagtactcaaatgtttaaacatttttctcacctgctgtctgtagcattaataaataggtaatactttgagagattgctaatgtgtaggcttgtcttctataaagttagagaagtttgaaattgtggttgggggcaaagatagaactaatattgtttctatgaagaagccacagcagtacttgttgtgaaattaagtgttataaattgatagtaacaaatgtggtgcttcccatatgggagta

SEQ ID NO: 11916 - DNA, 1025 bp, Homo sapiens
ttatatgttatcttatgccatgtgttttggtaaattttgaggtaaatatatttgagtgaaagagcttaccgtacattaaaagggggaaaaaactacatttcacaggaaataatataggatgtgaaaccagccagatctggttctgaatcctagaagtgccattttaatagctatgagaccttgggcaagttacttaacttctctaaccttccatttcctcatgcatgaaatggggatgatgatgataacctgtgtttttgggtggttgtaaggattagatatatatatatatgtctggcttatggcagttatttaataagtggtagctattatttttttactttataaacaaccaacttttagctagcagaggtcgttaagcttttaaaattatgagttggttttcaaaaaggtttggaaaaaaccagtatcttacaactagataacataaggtttatctacaagttgacaatgatgaagtcgtctgaaaaagatggaaaaattgcactgggaaatagaacaactttcacactctccttgtaataatttgttcctacagcagataattttaatgctcagccgctttttctttttcttcactttataaccaatcattgtgtgtgtagctatactgcatcaacattttcttttgcaggaatgccatttttcttccaaaagaattccattccagcatttcctctcatgtttttctgtctctcttttttaattgcatgcagtgcatgataatttcttttctttcatgacatggcttagcctcacagacagctgaatgttgtcaccacttatttggaaacctcagggaataattgtgttaccagcgtctgttctgaatgttttctcatttttctccaattttagccatgacagttgaaaaagcaagtccagtgggtgatggaaatttccggaatcgttctgctccaccttgtgcaaattccacagttggggttgttaagatgacacctctttcttttattcctggagcaaaaataactaagtatcttggg

SEQ ID NO: 11917 - DNA, 1056 bp, Homo sapiens
actgaatgtttagatatatcatttgtctaccccagtcatgaagttagattttatacttataaagcataactaatcaatgcattatcaattgatggaaattcctaaagaaacataaaacccagttttgatcataataaaactgagaatgtttaaataggaaaataaaacataaattataatgactcccaactgcatatattttaatctgccagagaatcatttccaaatttgtaggaagttttttagttttagtaattcttaaaagacattcagataagattttctcaaatattttttaattatttagagcaaagatgatctgcaaattctaatgatataaagtgaatagatagtcaaaagaggtactgatcagtgtagaaatttattcctgtatttatcttagtttgtttggtactactgtgacaaaacacttgagaccgtgtaatttataaagaacaggcatttattgactcagttctggaggttggaagtcccatatcaaggaaccagcatctggcaggggccttcttgctgtgttatcacagggcagaagggcaaaaagagagcaagaggagatcaaatctccctttttataatggcaccaatcccacccataagggtggagacctggcctaatcaggccttaaatgtcctacttttttttttttttgagacaagagtctccctctgttgccaaggctggaatgcagaggcacgatcttgggtcactgcaacctttgcctcccaggttcaagtgattctccagcctcagcctcccaagtagctggggttgcaggcgcctgccaccatgcctggctaatttttttttgtatttttagtagagacggggtttcaccatattggtcaggctggtctcgaactcctgacctcaagtgatccgcctgccttggcctcccaaagtgctgagattacaggtgtgagccaccgcacctggcctttttttttctctctctctttgagacagggtcttactctgtcccccaggctggagtgcagtgctgcgatcttggctcactgcagcctttagctcctggg

SEQ ID NO: 11918 - DNA, 1071 bp, Homo sapiens
acctgtgataatttattaggatggtttaaagtctcctgcaggtatagttttagaagaaaaaaaatgaagggtgttatagttagaacttcatataataattgaaaaatgtcatttaacacaaaaatcaatgaaatattatcatatattttgattacaatttattttgacaggcttttatagttgtaatacagaaattatgcccggtataaataattggacctctgaaatacaggtaaacctttttttcttaattttaagcacataacacataagttattttagtaagttccatttaaatatttgtctttttttttttacctccttattgcaattaaaataccatccttattctactacattagttagtattgttcattatttggcaatttatcaactgttaaaatatttagttaaaaataataaaatgacatgttatgtcaccccacatttagatgttcacttcagtaagagtaatcagattaagcagcctcaacctgactaatcaagctctcaataagaactttaatgatctctgtgaaaatttgctcaaggtaggaaccttctgactaaattttatttcatgcgtctataataatgaaattttaagtgtctatattgctgtattgtctgtaataccttacacagttgtgggctgaatcattcttacctacttaccttacctctatcagcgggtgagatactaaagttgtcctctcccccttactatatcaaattataaaagaaatagttttagttaatagctttaacttccataaaaatctagtgtatatgtgtatatttaaaaaaacttactatattattttttgtgacttattgacgattaaatcttattgtctacttaaatattaaaaagtatatcgttagtgtaaaaatacacaaaacaaaagtggaccagttttgttttatttttaactctccatttgctataatataatgtacattaaaaaaatcagcttttaaaaatttttaaataaaaaagtgacattactaatattttctattgtgtagagcctgtactttaaactacgatctatgatcccctgctgcctt

SEQ ID NO: 11919 - DNA, 1096 bp, Homo sapiens
gctgtgtctcagcttaatgttcattttggcttgttagcaaataaattctgactggaaagatgttaatgaggaaagccagtgctgcttctataagtagtgtaggactcagagaaccaggtgcctgcaaaaagtgtattgatcatatggaatctgatgaaccacgtttatggaaattctctcattttctaggtactttgctaaccagcattttggctgtgttattggcagttttcaaatttgaattctcttgccatctttttgagagtgcatagacatttaattttaagaaatttatagaattggacttttttgtctctatacatttgtaggtcagatgcacatttgtttcctgtttcatctttctttaagagcaaaaatgtaaagttttgtatgtagaggataattgtatgatgatgataaactaattaggtattacagttttctaacgacagaaatttgtaataattaggtaacttggttcatattaaaatatttgatacataggccgggcatggtgactcatgcctgtaatcccagcactttgagaggctgaggtgggcagatcgttcaagcccaggagtctgagaccagtctgggcaacagggcgaaaccccatctctactaaaaatacaaaaattacccaggcgtggctgcttgtgcctgtagtcccagcaacttgggaggctgagatgggagaatcagctgagcctgggagcttgaggctgcagtgagccgtgattgtgccactgcactccagcctggctgacagagcgagagaccctgtctttaaaaaaaaaaaaaaaatttcttttatacttagagtaacttggggaaaagtggttattttaattcagtggtctaaaaatttgtatgcctagtgaggacattacataaatgtataatttgtgcttgatgcaagactgtaatgattggtgggtgcctatgcatgtcaattaagagctggattcaaattgaggggtttaaaaaacattttgctagctataacaaacgtttttgatggttgagccccaggaaactagtttatgacactgatgtaattcaagacttgcctcaaatattgcttttctgattcata

SEQ ID NO: 11920 - DNA, 1047 bp, Homo sapiens
agcagtttttaactttaaattctacacaaatatttgtcattttgggaattattaacctgccaaaggctagggatgtgactaagtatagattgcttcaattacattcaatatgtaacacattttagaagttgactctctttttttcttttaaagaacagtgccatgaagtgtttcttttactgctttaattagctggtaagagttccttttaaaatgcactggagtaggaaatcctaattggggaactcatgacaacagctgccaggttaccaaatccatcaggtacttctgtcctcatcttagttctgacatctcagcaatagtgacaccattaattattttcgccttgaaattcctttgacttcatgatgctacaccttctatgttttcctacctttatgtataatcttcatcctccttgatgacttctcatttcttgatccttgagagccatgggtttggaccctctgcccaaagctctctccttagttgaactcatcaacttatatagatctatgtgtctgtgactcccagatttgtaactctagtccggaactttcttttgagctttagacttatacctgtctacttcataccccattttgataagccataggcatctcatacgcgttccacattgaactgctgattttcttcacttttcttattagccttttctgttttaatgaatggtacctttctctatccagttcttcatgccaaatttggtattctttggcactgtcctctttctcaacctccccacatcaaatttattacaaagtccgttgatttttcttctaaaatgtatttctaatccatttatttttttccctcttgaatcttagaccttccatttgggattgttttccttttgccttaaatgtacgctttagtatttcttttgatggtctgctggtggtgagctattttttttgtctgtctgaaaaatgtgtttattttacttttatcttaaaaaatattttgggctggcagctatttctttacagcacattgaagtactctttcaccactgtcttctggctt

SEQ ID NO: 11921 - DNA, 1119 bp, Homo sapiens
acaggttatacctgtggttgaaaaaatgcaatgtgctagtcctcagcagttgtatttatttgaagtcatgactgatagctaatgccttgtcttggcttataagaagttggtttaaaatgaattcattagttttcccttatgtagaaatactggttctgctaatgctctggcactgatatggggaaaggaaactggattaggattaaagcttcacctctagactttcctgaacaaactagagtgcagatcagtcaggaaccaacgatacgagagcagtgtagtagctgggaatgagtgaccacagtgaacgggctgaagtagagctgtcccttaagcaaaagcttcagagtgtgctttgcagtgttttttttttttttttttccattcaagcctggttttaaaaagacaggataagtagcaggtcaaaactagggatcctaagtacaggattctcactttattaagtaacccatcccatagagaaatttgaatataagatgtgtattaggaaaaccaggacttaacaggacttaagtataataactttggttattttagaaatgttttgatagctatctgcatttgactcgtataatgcttagttgcaaagtacttgttttcttcattaaatttttaaaatgaatcaaaaaaaaatttggagaatgtaggagagtagaaggaagagaagattccttatgatctcactattcagggataatccctgtgtacatttcatattttaaatgctttcataaattttaatacttttatttttatgccttatgtataccactaatattgaaatttgtgtgagctgtttagttaaaaattgcttcagttttcatccttttgtaccctcttataacacattggctttggattcaaacaaactgaaattcaaacatgaggcctgctacttagtgcttagtatgactttatgaaatagatgttttggtttttcaaaaaagttaaaactatcataggaaattagaaatcttagagtatgcctgtttttgacttactatttttcttttttaatacttttttacattaaattaaaaaattattacacttggattttttttaattttggggggtacctagtagctgtatatattt

SEQ ID NO: 11922 - DNA, 1076 bp, Homo sapiens
agatgcttcatttatagtgctccattacaagcaatattggacttctctggtaataaaatagaattctgtgactctaaatcattttttaaaattacagaccaatacatggagtgttatatctgaaatttttccttatatacattaccaaattatttgtgttaatattttaagtgtgcttgctttctttctttttttttttaaattagtctctaatttcttgtattttgcctaaagacccacatctctgtagaaggatggcttacagatggctttctctcttttaacattgacaaatctttgccttggaaagaacccacaatatagtgagttataaaaataggtaccaagaaatgaaatcagaattaaagttaaatttatggatataacacataaggtgttcactcagtgaggtgagatgtagaatatcctcttagtctaattctaaaattctaatcatagctaagattagaatttggaaactctgggtctacatttaaaattatatctaatcatatattcctatagatatctgttaaagtaataaagcaaatacagataggtggtttgttttccagcaattgagtttaaaaggttaaatcttatgccttttgagaagtagcattttaaagatgggaagtttaaaaatccattatagaataaaacttctttacttcccatagtatgtttattttaaacatttcatgttcatatatataatgtgctattgagtaataaactgatttaaaatttatttttcagatgaaccagaaactcgagatgcatggtgggcagaaatcagacaagaaataaaatcacatgctaaagcattaggctgtcatgctgtagtgggctacagtgaatcaactagcatctggtaaatgataataacaacttgattttccagacactaatttagactgccatctgaaaggggaaaagcttcatgcaaataaaagaaaagagaatagcgaagtgttcaggagcatgggccttggagtacattagattaaggtttatatgccgtctttgccagttagtgactgtgtaactttgagaaagttatttaactcttctga

SEQ ID NO: 11923 - DNA, 1046 bp, Homo sapiens
gacagatcatgcaagcttatatcagaatttattttgtgccacgcaatttgctaggtctagggtggaaagattgccagtccccctgccttcatgaagctcatattcttggaggatagacagacattaaataatttactgtgtggtatggtgtgatacaagataaagagttaaagaagaaggcttgattaactctgtatgagagaaacttatagaagtggtaattcttgagctcagatttgaaggatagatgggagaatcacatagatttgtattttggtgtttttggacccatgtttatgcatactttgagtgtggttctcaaacttctagcatttacaaaacaatgtcctagccagtactcatttgatgatgtttacatagttacttcatgcttactacgttgcttgccacagagtacaaaatatcttggttagtttagctttttttttttttctgtctccttttctcctgctttgctgccttagtttgtgttaactacagcgttagaattttttgttttggagatggaatcttgctctgtcacccaggctggagttcagtggcgtgatctcagctcactgcaacctccgcctcccaggttcaagtgattttcatgcctcagcctcccaagtagctgggattacaggcacgtgccaccatgcctggctaattatttttttgtagagatggggtttcaccatgttggccaggctgatctcgaacttctgacctcaagggatccatctgcctcagcctcccaaagtgtggggattacgggcgtgagccactgcacccagacctagaaatgtttttatagagcaggaagaagggaactcaatattagaatttatttttaaaatgttacctttacttatcatgctgcttatgtttctggcttggtaacagactttgagaaatgccaggcaggtgagtgttgctgctaggaagcagattgcagcatttacaaatcttatgtgtgacattctaggattggaagtgcataagaattagggtagcccatgggcacatttgcattagatcattga

SEQ ID NO: 11924 - DNA, 1035 bp, Homo sapiens
agtttctgttttagatgctttactttctttcccttcataccaactccattcacattggacctgtgtcatcatgttgctaaaccatatgattacattagtaaattattctgtttgaatcagtttaagtctcattttggtgatattcttttattatctttttttctgtctgttgcattaattattaaatttttctgctctattttctgatatttcaattatcactacaaatttacattttattttctggcttttaatatgcttcgtataaagatcttagtttcatttctatgtttagtattgtatagtctctaaaaataatgttcagattactataagaaaaaccatttttttgtttttaggaacagaatgggactatacatatgctaacctttgtttccttatccaagaacagctaaaaatgtaaaagttaattagttcctttttaagtcgttgtggtaaatttggctgtatgcatcttacgttttgaaagggatgggattaactctagtctgtagagcactggcttcttacctgtcccctgctttctatgattgtttgaccatagttgatctactggcatggtcagaacaataaaataaggtagggaaagaaatttaaaattaagccgtaaaaaatacatgtaagagcttgggaaagataattctttcattcataactatgtacatttgtgatgtgtctattacatgtctgtggttttttgtttacttaaaaaaagtttatgttgatttttgtgaatgagcgttgacatgtatgaaattaatactgttttgtcatgatatgtttagaaatgggaagttataagaaaatagatttgactatatttcagactcacctgaattttatgttttctagagaattttggaatattttcagtgagcacaagtagtgcttttgtctctatatttacatttaatcagacattttatatttctcatttgttagtattcttaaattgttagcatagtaattgttattatcttgattattttaattaaaagactcagcttttaaaat

SEQ ID NO: 11925 - DNA, 1066 bp, Homo sapiens
ttctcttctgttaaatgtatacataacaatagtagtggagagaatgccattggatgacagatgatttggaatggattgggattcaaaatgatcattttattttaacatttcattatggaaaatttcaagcatgcacaaagatagattagtatattgaacctcacccacctttaacagctgtctacgttctactgttcttgttttgcctttttaactcctgcccaccccggttttccttgtggggatattttaaggcaaatttgagatgttatatgatttcatctgtgaattccaaattatatacctcttataaaggaggaccccttataaataaacaaaaccttagatcacattatcacactaatgatatcaataattccttaatattctttaatttttaaaataatcttcagaggctggattattagcttaacatcaacaataaattaaataggggatagggaaaggcataaatgtttcatatccaagtttaaaaaaccaaccagagtataagggttgcagagctatcacttgaccaaagcatatgtaagaatgatacagagattttagccaaccacagactcagtcttaatagtatggtatgtctgatgtaaagaagaacatccatggactgcattttaaaagtataattttctaattatagaaaataataatcctttggtattctgtcccaatcttaatagtgtctataatatgttcccttctggccactatatttgatgaaggggactggtaaattagataatggcatgatatccagaaggtggcagccaaaatagtgagtacgtcttccatgaggaaatcattttgcactgttctccattgtaaatgcctctgtttggcacagtgtttggcatatgataacaactcgataatgactaaataaaaggagagagggtagatgtttatatcatgaacttaatttgtgaacttaggttgttttttcttacacataatgttaattttgcttatggttctgttctctgaaatcgcccttagaaattgtggtgtcattgtgctcaattagcattcttctctctataga

SEQ ID NO: 11926 - DNA, 1029 bp, Homo sapiens
tggtgaagtgctttacatgtgttaacctcattcaattctcacaatgccgtgaaggcaccttttattttaagatgactcagaagtccaacccagagctagctaagtggtagagtgaggtttcaaaccgaagactgcctgactccaaagctattaccagaccaccacacctccatcttacattctcccattctacccaccacccccccttcccaagttaaacatctttgtcatttattgttccctgtgccagcaatgttttccctgctttttttgttcttcttcactgctatgtcctcaacgcccagaagagcgtgtaatagactctcggtaaatatttaccacacatattgcccatttctctgataccacttccttcacccctcagctggaactgaaattttcttctttggaattttcattggactacttaagaaccttgtgaggaccaatttggtttttcttcccctgctatttcatgctggcccttatattgggcagcattgtggctgctgtgccttttctgaggcctatttcataaccattatggagcctgggtaaagtttagctcttgcagggtaaggtgtcattcttcagtgaaagagaacaagggaaggaaagtattgatttgcttgaaagatgctttgatcatgctggggaacctgccaaactgatacctgaagatggaagaaatgacactacgatttttaggcgctgctttgcttatggtttatattaggaccgtgatctttcttttagtgttggaaggcacattctgtagtggttgggatactgcatagctgccctctattggaaaagcttaaaggtctggattaagagaaaacaaattctatttctggtgcctgctaatttgcagatgacctcagacagccttaccatttggagcctctgttttttttcaaacatgaattctttccagagtagtattgaggtggctatgaagcatgttgctgtatgttaatatgagttgcactagtcaaaaaaaagagaataatatatgtaaactttttt

SEQ ID NO: 11927 - DNA, 1059 bp, Homo sapiens
tacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaagttttgttttgttttttggggtttctgggttttttccttttctttttctttcctttcattttttttctttgtaatgcacctgacagaaaaaaaagaaaaatgaatttctctttacttctctccaccttctccatctctctactttaaagatggaagtctgtgcatgaggggaaagagggaaaaagagcctgtttttaacttccttgctatccaccacaaaataagcaattattttctttagaggactttatctattgcacaccacactacatctttgagcaagtgccaaatttgtactgaagtgttgaccaagttcattttttctctttactttttccttttccttcttaagttaggacagtgttaaatcttagacaatcccttgaaaaacctgaaataccagcagctggtgagatttgacttttttttttaatggaaactgtaggtgctgttctcaggtgaaaagagaga

SEQ ID NO: 11928 - DNA, 1039 bp, Homo sapiens
ttcgttccttgttacaatatttatatctgtaaaatgagaataacatctccagtcaattcccatttttccatggaggtaatgcaaatgaattgtttctatgtgctgcctctaactattctaaataaatttcttacaaagtctaaaataaattatttttacataggtgcttttaatgtaatatgcaacttttttataaatcatataaaaatattttcttgtatagccattcaaagcttatttatttcctaggtaatagatacatgtccttgatacactaggatacatgtcccttattccacctacatgttgtctacagcaaaattatttcttgaattgagaaaatttttatttgaccaaacagttttatttcaaacttgaatatgaaagtgaattatttttatagacccatagtatcctggaatctttatttattcagcaaatatttattctttgtaagctattgagctaagcattataagaaatgcaaagatgaatcagtcaaggatccttggtggatgatagaggaggttgaaatgaaagagaatgaatgaaatatgaaagtggaatagagtttgaagaaaggcaaacaacctatcattctaacaagtgtatttgaaatgaaaaagacctcacagatggttgaaaacgttgtttcaaactattcaccggactccaagtatgttcaagcaccctccagatagtaccattgacttttatttgttttatatattaagttccactggttaaaattgtttgagttaaagatttctgctgctaagcaaaacttaaaaaccattcttctattccagctccttaattttatggatgaggcaatttagactctaaatagtgacctggctaaaacagatattaacaaaagggtgcccggaatcctagcaactgaaaattaaatctaccttcttcccattttgccatgatattcttaaaaataaatgcatatatttgtatatgttatttttaagttgtttcgtttaaaaggataggaagagaaattgttaattttgcacttaggccatta

SEQ ID NO: 11929 - DNA, 1027 bp, Homo sapiens
ttaaaaaatattgaagccaatccatggacattcttgagttactttcatactaaagagtatcaaataacaatattcatgcaactaacaaaaactctcaaaaccatgtatgctataactttacccactctgagatttttaatggcttctgatgcttaggtataatgtcttcccccatttctccttctctctctgatcaaatccctagaattttatattttatctaaaattgcaaagaggtacctttttgctaagctttttactgccctattgagaaccgtttggaattgatgttctcctattgcccgtctcctccatgtagctgcattagcagccatttgttttcagtcttttccttttcctttctctcactttggttgctttcattttgaaacttgatcagagaaaatggaaaggaaatatgaaataacaaaacttttcaaattaaaactcaatttgttgttttataaggtttttgatgcaggataataaacagtgaaataataataggaaaacagacacaaaggggctttagaaaaatcaaaatcatctgcatttttagaggtaaagatgagagattaaacatggtttataaaaacattgtattttgcaatcatcctagttcaacttaggttaacctactgtggtctaattctgccaagtccctgaaattatgaaccttaagatgttgattccatttttccaatctctctttctgtatgcaaagattaagataggaagtgtggtccttatctttaagagttttgcagcctcaaaatgaaatggaaatgtcttcatgaaggaataattcttggatatttaaatttattttcactgagaatattttagaaagcacaagcaatgtgtgtataccagaataattacaccattttatttatttttttcatttcatctaactggtgtcttccagtagcattaagaagtgctaatatactaaactttgatgttcttttctatttgaaatatctaccacatacacacatatttatggcttgattttttaaaaaat

SEQ ID NO: 11930 - DNA, 1099 bp, Homo sapiens
agtttaaacaaagctgccggaaaattcagactgggcagagcccaccacagctcggcaaagctactgtagccagactgcctctctagattcctcctctctgagcagggcgtctctgaaagaaaggcagcaggcccagcgaggggcttatatataaaactcctctctccctgggactgagctcctgggggaaggggaggctgtggacgcatcttcagcagacttaaacgttccctgcctacaggctctgaagagagcagtggatctcccggcagactgcctcctaaagtgggtccctgacacctgtgcctcctgacggggagacacgtcccagcaggggtcaacagacacctcatacaggagagatccggctggctctgcccctctgggacgaagctttcagaggaaggagtaagcagcagtctttgctgttctacagcctcagctggtgataaccaggcaaacagggtctggagtggacccccagcaaattccagcagacctgcagaagagaggtctgactgttagaaggaaaactaacaaacagaaagcaatagcatcaacatcaacaaaaaggacaaccatgcaaaaactccatctgaagatcaccaacatcaaagaccacaggtacataaatccacaaagatgaggaaaaaacagctcaaaaaggctgaaaattccaaaaaccagaatggctcttctcctacaaaggatcacaactcctcgccagcaagggaacaaaactggatggagaatgaatttgatgaattgacagaagtaggcttcagaaggtgagtaatagcaaactcctccaaactaaaggagcatgttctaacccaatgcaaggaaactaagaacattgaaaaaaggttagacaaattgctaactagaataaccagtttagagaagaacataaatgacgtgatggagctgaaaaacatagcacaagaacttcgtgaagcatacgcaagtatcaacagctgaatcaaataaacgaaagaaaggctatcagagattgaagatcaacttaatgaaataaagcatgaagacaagattagagaaaaaagaatgaaatggaatgaacatagcctccaagaaatat

SEQ ID NO: 11931 - DNA, 1050 bp, Homo sapiens
tatggggaaattatggagatcggctttcctaagttcaaaatcccaaagcatccattaattgggcaaagggggcacttcgaaattcactcttgttttaaaatcgcatttgatggggtgggaaaaataaaaagtgaacggatcaggggaaaagcctaaagatactttaattggcagaggtttgagttgcttttgtttagttactcactgtccttttgacaaagtacatgttgaagaggctttgtaagtgctgttccactgaaggacaaacaagggtacttttcaattgagcccttttaagttttgttcctcacactcccgctgctgttggaggctactcctaatgcattgtggctatgtgttcatctatgcagtctgtcactgaaaaatgtctctcttcttgttgagcaagctagagtctaacctccaggcacccttttcaaaagcaccactgtatggaaatcgacactcataaaatgatgataaagaaaagagtttattttttaaaggtcaggacaagaagacaccctcaaatgctgtagagcctatttcttcaggaataagtgttttaactttagcactgagttagctgagtttgaagcctcataatttttcaacactgaagcgaaacttgttcactgtcatctccttttcaagtggtatccatcatagcagtttatgctgatattgtttatttcattagtgttataggaaattatattttcctgaaatacctctggcttggattgtaaaggctcagaaattctgcttggtaatctttttatatagcaggtcctggagctgagtaccagtgttgtctttataagaaaatcatttgtcccagaaagcttctatttttctttttaactagagcttgtacttttgctaacaaaatgtaatgatatttaagattatagccttcattttcttcatcttctcttaataatcaagccatcattcttttcttatttggctatttgactcaataaaaaaagaatctatttgattcctgctgatacattagtttgtctactatcaggtctatgtaagtca

SEQ ID NO: 11932 - DNA, 1041 bp, Homo sapiens
agaatagtgcaccatacaaaaggaggccactgaggtgaaatggttacaaagaaaattagatttgcatatgggttgaagaagagacagctctctttcattttagccagcctatttttcaagtgattaattaaaatattttgcaacttataaataggagaataatatattgatatatttggcttgcatctttttttctatcagaagttttccctgtcattacacaaaaagctctgattcttatttgttcttatttatccagtgtcactctaactgaatgggatgctaaagtgcatggtctattcatggttttaaatatctggcctatgtaacatagttacattatattttgtgataattatggtctatcggttggtcttcagcaattaaacctaacagttaagagtgacaatgaaatttaatatgacgttatgtgacacataatttctataattcctctatcaagacattgaatatataattatgtattgaagggaaatgcattaaaatatataaattactatatataaattgttaccatgtattaagtgtatattatgcattaactgcaatattaaataatttatataaaatgcttctttcaatctcgatgaaaaccttataaccagggctcctgtgtatagccattccagtttcagggaataccattcacatgatctcaatatcctcattcctattatctccatttccagatgaggcaactgataattaaatatgttttaaagtgaccaagtcagggtcacttttcagcctaaagtcaaccttagactagaatctatgcccttaaccaatacttattgctattccttccaatgagagattttgccaaataatcatttactattatcatttcacacatgtgtatctaaactttaaatattgaataatatattatctgaaatatttaatagtattgaataatagtagtgatcagtagttttctactaaagtaaatttcttatgcctcaatagagatcaattttccagaaaacttttaatgggagattaactcagtttttactg

SEQ ID NO: 11933 - DNA, 1032 bp, Homo sapiens
ctagataacagagataaaactgctgtaactgccacgtggtagcaataaggaaggtgttgtgtaggccatactaaaggttttagattttattctatgtgagaaattgaagactctgaaggattttaagcatggcaaatggcgtgatcagatttttgtctgacgaacattggtctcggtacagtgtgggaaaaaaaatggattgaagagggcaagagtggatagagtcagactaattaagagaaaattatattttagcagcagatggtgatgctttggacttttacagtgacaatgacagtagagacaattacatgattcgagatatgcttaggaaatagaactagaaagacttggagaatcaatagatttgggatggtgagggaggggaaagtatcaagaataaatgacttgtaggtttttggcccaaacaattaggtggatgttgactccatttatcatgatagaatatttggggtcaaaggtagagaggtgatgagtttaatttggggacgtgttgagtttgatatgcctgtaagacatccacgaagacatataaaatttagaagaggtgtctgaaatagaaatagtcttggcaaatagacaaaactaacagataaaattgcctagtgggagagggaaaagtgagaaatctcagaccaagcatctcgaagattcaaaggttgagcgtagaagaaacaatactcaaagaaatcaatgaaggggcagacagagaggtaggataaaaagcaggggtcctgctgcaatggaagtaaagagaagggaatgctgaataaaggagagtatcttggtctgttttgtgctgctgtaacagaatatccaagactggataatgtataatgaaaagaaatttattggcttatggttctgaaggctgagaaggccaagattgaggggccagcatctggcgagggccttcttcctgtgtcatctcagggtagatggaagaatggggtggggagtaggggcggatttgtcctttgataagaaacccactcccgtgataacaaaccc

SEQ ID NO: 11934 - DNA, 1050 bp, Homo sapiens
acacctcacaaatcattgtcacttaaagtgctaaaaaacatttctacagttagtttacttctccaggaaaactttgtctatttttttttaaggccctaagtctggagtttcatttgacaatgcaaaatattattttctgattatgcaagcaacctagtccctgagatatttctgaattgctgagcttaattttcaactttttttttttttcccaaattcctgctaagtttctgggggctatgctaactccttggactatataaaaataagttcctgtatttgaggctccaactctgggtgacaggacaaggtattccacattagactatttcagggcacttttagggtccttgaagtccagcccttctgcatcttttttgccttatgtatatagtggtgatagtaatacctatttatcttggatataaactaggaactaatgtgtgtgtgtgtatatatatatatatatatatatatatatatatatatatatatacacacacacacacacacacacacatacgactttgacctttctaaaaataaagataccttaagagttgttttgctgaggagatgagtacatcagctataggagatcttaaaaatgaataacttccattctgcagctgggcagtggcatttaacttgagtcagaccatatgcaaatgaaggcttctataacatcacaagttttctaagataatctcttttatttatcatcacagtatatactatagagctaattacttccaaatataacatgatataggtgtttctttcctaaaattctttttttcccaaaaatgctttacattgctctttattccatattaaaaccaaaggtttcagatttcttttggctcagggttccaaatttttgtgaacaatgttatcagtatttccaactatgctgtgtatactggcctcgaatctctaattctttttctaggacacattgacgactaaaatccataaattttacagaagcctcatttaatctgctaatttccctttacttattaccctttaagttttttttgttttgtt

SEQ ID NO: 11935 - DNA, 1018 bp, Homo sapiens
agtaaaagggattagttaaaagggtgacgttccgtgcagagagttccaagtattccatgaaacaaaaggctctgaaatgtttttgaagttatttttaattgagttgaactaatttaataaaggtcctacggaggaaaaaaaataaaggaatgtgattgttttatgattcctcacagatggaatggacatttatagcatacttttcctttagtgttccagagaacagtagctccatttacagctactgttagcaatttaaaactgctccaaaatgaagtctttcaagaagttgacagcttataaataaatctgtctgataaaattgaacataaactgcatctgtggttagtttgccaaaattaattctacatttaattagagatagcagtcaaacatatttaataaaaaacagtcttggagagtaaatcaaatgaagtcagattttagcagacgttttgcatttttttgcaaggagtgatgaaatgacctcacctctctgattcccagttatatggcagcgcgagctctgtagagttatggggaagccaatgagttcacactgtttggaaaggttccttgctcagcttaggataaagagagaaaacgatcattttgtgatttctcttgatatcatcattggattttacactgatgccatatgtattaaattcacaagttaataagcgtattactgctaataattacagagagcaggctaaaataattctaactcacataagtgcaagtacatggaatttgtccttaaagtttgttttttgtttacttttttggcaatcttcattgttgttgttgttttttaacttagccattccaatgagatgtattaaaatcatacagtagctacaatgccatttcttccccctaaaagactttttaaaaattcagctttgcttatcaaatatttgtgctcactctgcatggtttaagcaatgtgccatagctgtagaatcctggggaagatgcaaaaacacacagatcaatcagaatgcagcaaaca

SEQ ID NO: 11936 - DNA, 1062 bp, Homo sapiens
gcctcaagtgtaaatcagccagtcatatgtgaggcatgcctaacataatgcctcttatttttaaatgatttctcccaatgttgatggtgagaatagtgctaatgatacaaaaagttttttataaaatgggaaaattctactcaatgttttgttcgctctgaagattaaggaattttagattctttatacaaaacattaatcatccagaggaagtttccccaaactgtactcactgttctaatagttcctgagagaatattcccttcagacaacctaatgcttgtttagtgtctgatgctaataagaaaataccaacttaaatttgaatcataaagtcagaatttttataattgtatgtgaccaaatattaaaaaaaatattcctcattttttacatgaggaaacagacccaaaatagttaagggatacttctaaagatatatcattaatacattttatgactgagatcaaaactctcaaagatttttcagtgcttgtctttccagtctgtagagaattttcacttgcgtaatctcagttactgctggtattaatagaacacatttgtgtaatttaaagttgttctcatattatctgccaaatgtctgtttacagtaactttattttggtattggtatatcctcctgttatgttattcttcttgacacagtaaatgccttgattaaagaataatgtaggtcaattaaattctattttacttgaagcttttttaagtttgaccaagactgtgatgtctgctttcatctacagatgaattttcctgcctacaattgaataattacaattactgatgaatagagatttcctaggctttttttttaaagatgtatgatcatgtcaagtaatctcatctattgttttgatgttatcaagatgtttaatgacctttagtagtttctcgtctatgattgtgtcattgagaactgtctgtgtcaatgaattcaaggcaaataaggccctaagaattttgcatttctatttcattcctttaattaatttatttttaattgacagataataattgtgtatacttatggggtac

SEQ ID NO: 11937 - DNA, 1031 bp, Homo sapiens
cgcctggctgattttttatttttagtagagatggggtttcaccatcttgcccaagctggtctcaaactcctgaccttgtgatccacctacctcagcctctcaaagtgctgggattacaggcgtgagccaccgcgcccggcccatctcatcccttctcaaaaaaaaaaaaaaaaaaaaaaagttagccatttgtaaactgctgatttctttgggtcattgtccccataaacttctgtaaagcatcagtgatttcaccattgttccacccatgcttcgtcataaatttgatatttgttcctgttcggtttcagcaaaattcatttgctctcataggggctcttttcaagctgatgtcttatccttcttagtggcttgaactagattctgttcagacatgtgataacaaattagcatgagtttgttttggtacaaaaaattttaaaatccctgcatagtttttagtaatgcacattttccatgaacttttggaagaatgctcatattcatggatctgtatttattatcagtagtcatcgtaaatatttctgtaacctggagccattttctcttaagttcttgataacttgttataaaataataatgttacaacgtagaatgtctgttttgtaagcatttaaaccccagagtgagaaaggtaatgcaatgagtgaattgggtttagtgtaagaactcagtgatcccaaaatgtgcctagttggtgctgtttttctctggtgccagaccccacggaagggataatgagggagtaaggaccatgggaatctggagatcacctgcatcaaccacaaggactgtaaatttttctcatttattgagtttattgttactcagtcttatttttgttttccaagaaaagtcagaagtctgactgttgaatgtctcagtttttcaacgtttatccaaaaacggtggataaatcaatcaagactaaacaaaacacaaccatgatcagatcaggtccttggatcatccatttcaattctctgccataagaaaaagttacagatata

SEQ ID NO: 11938 - DNA, 1050 bp, Homo sapiens
cccaatatttttgaatactctttattaaatgtgtctcccttgatataagttaggactcccagttgtagtgagataaactagtttgatttcagaacctctctttcactctgcctcttttgtattcttctggttgactctgctccgatttattatctgaggctcaggctgaactcaggcttttgcgatgctggcagccccagctctacattggaatggacggtcaccctccatgtgcaattaaaaaatatccagagaagacctcatttgggtatatgcccatccatccctgcacaattttgttgaggccactgagttcaggcacagtgccaggcatggaccacgtgtactcccaaaagtatgggagaggaacaccccaaagaaaaggggttttgatcagataaggaatggataacacactgggtaataaaattgtagttaatagagtccgtagcattactttaaaaaaattagtaaagggtacattagtcatgacaaaaacaatattcctattgtactgaacttgtttttaacagacgtagactaaagctgttaatatgttgctaatgacaataaggggtttattcaaatgaaaaggtgtttaacattctttcaaaagaaccttcataatggatgtattttcaatattttctctaaattattctttgctttaaattagtatcatccatccaactgattatacccattataatcacaatgtgaagttaagtcatgactgaatgtttgtgtaggttaatagtagtcagatgtccttgtaaatgtgcataattgcgtttaaatccatcagcaaatcccagtgtttctattcacaaagtatatcttgaagctctccatttctatgtgttttccattgccaccttcctagtccaccatcgtttttctcctggactccagcaatagtttcccacctggccactttgcctactctctcttcccaaccccacaaatccatttcctacacaacagcccaaggacgatatcaatcagattatattataatcatatcatgttattcccctgtttaaagccctc

SEQ ID NO: 11939 - DNA, 1030 bp, Homo sapiens
tacagtttttcgtgtgtgtacatctctctggttttaagctgttatgtgcttttaaacttccttagactatactggaacagaactgaagatgcatattattagatgcatattattttagcctgcattaataatttgtgttccatacatttactctatgttttagtttaatttttttctttaagagacacatataaaagacaaataaaaagaaataatggcaagaggagcaacagatatggtggcagatatgggctactctgtaggctctggttcaaacatacctgctctcctttacctgggggaagaggctggaggacagggaagatgaatgacagttgctgagcatgcagggggatcataggaatctatacagtgtgagttcatttagaatgaaaaactggtaaatttctatctgagcccaagaatgtcgtggtttgtttccatgttaattgtcttttctcccattgataagcactttaaatttggatttgtaaggcagcaggatgtatctttgattttgaaaagcaatattttggtatgtcataatttgatggctaggttttgaattcgatatttcattcatgatcatttattgtaatctacagaaagataaaattgtataaaaccaacattaattgtatgccaaccatattacaagaactgcatttgatgaattactttcgaagatacttcatctggttcagaaaacacactgcaccaagtagttatcctattatattcctacagggttaaaagagattttttagaacattttattgttattttatttatacaacaagaaaaatgataaaatgaaattcaaaataatttagttctaagcataaattttgtccattaatctgaaaacctaccctgctagtggcagtaggaaaagcccatgagtcggaagaactgttgttcaattctggctcatacaaactctatcatttccaaactaataagttgcttagcttccctgtctcagttttctgcattgtgaataggaatgattcttaatatatttgactta

SEQ ID NO: 11940 - DNA, 1031 bp, Homo sapiens
ttctccacttcatccctaacacactatttaaagtgctttctaatagcatgtgttgaataaatttggcgtgaagagctgtagccaaatgaatacgatgtgaaatccaatgccataaaggctgcaaaagatctacaaggtgacagtgtataaggcttcatagaaaagagaaagttccatagacaaggcagtatttgagctgggctttaaaggatgcatatgattttgcccagcagagatgttggacagtgggaagattgccaaggatatatttaaagctctggtgtcttatgttcctcttgggcttgagtttggatgcaacacaggggatacaaaaggaaaatagtgactataaaggtaagttgggttcaaataataagaagactttgaatcttatgctaagtggtttgtcctaactccacaggacttggggagtcattaaaactttttgtttgtcttgggaaagtagggtgatgattagggctgtgccttggattaattaattcttatgatgtcactctgaggctgactgatttataaactgtatggctataagaaggaagatagaatactaatgcaatcatgaagtaagagttcaggaaagtcaggcgtgagtggtaacaccagggtgcagatacaagcagaaatctgaagatggaatccatagggtttgatgtcctcctagagtgctaagggatcaatttcaactttgaataatggaaataaaggccttgcaattcacagatataggaaatcacaaaaagcagtttgtttttactgatttattcttttttaaaaatttttgtcagagggcatgaattgttttgagagtctttatatttgagttaccaatactgatatattgaggaagtaagtattccacattggagattctggaacatggcacgagagttgacgatgcagctatatgaatttaaacttgatgctgaaagttgcctccttagtggaagaagggcaatctagactgaggggatagcctgcaagacgagggtgctgaatgccatgtagaattt

SEQ ID NO: 11941 - DNA, 1030 bp, Homo sapiens
tgtgaatatttgagttacacattattttaaaatgatgtcattaagaaaaatctgtacactaataagtgtctcaagttgaaatgttacactgcatattaattggtatggaaaaatagaatggctgtatggaaaacaataggttcaccgtagatattgtttgatagtaacagccacttgataggatcatgtaactttgcagtgaatttcctctagttgccaccaagggaagtgtcctggagtaaatttcagctgtcaatcttgccagtcttgtgatagtattaaaaattagtttgggatagaaaatgaagtgtttttatttctttcttactgatttgaggagggaaaagggtacctcaattcttgcccaaataggaatttgtccaataagacaatgatgtgtaagataaagaattttaatacttgtacatgtttaagaatttaattttgttttctggaaatcttgatattcgacttcaagatacagcatagccaaattgccataaattgcatctttgtacggaaaagtagttgttgttttgggaaatgtggttttacagaatatattgcaacctgacacaatgaattttcagcatcagtattgacaaatgaagaacaggaaacagaggcaagtgaggcgttacaacagacagagtagagaggtcctaatttggagccaaagattagctgcttttgatctaccattaaataactgtaatctggtactaaaatcagggttttaattttgagcatatgatttggctatatcttacaagttaaagaactaaagtgaattttggagatagtttaatattaatacaaccactacttgtagtttttattttttaaaaggaatactcaggcagtaaataggacttcagtgtatgtcacatttaaggatctctttatatagtgccataactttatgtatgtaaaaagatacatacattttgctaaaattagcataaagccttgtatctggagccgtgtattccctctgtggcaatgcagttttattccttatgtcttctgt

SEQ ID NO: 11942 - DNA, 1032 bp, Homo sapiens
tgcagattagctgattttttttcttcttatccatattttattttggaacatgttgatgaagtcacttattttcttaataattatttttaattgagtaatttagacagaattgatagaaggtataggtcaatcataggaaaacatgggtactttctaaatgcctacatggtgatcatttatttttctatgcaattgggaagaaattaaccttttaacaaggtgaagacaagagtagctctcactgagatggaagatggaagtcatgattatgctttattgttacatagattccttactttcttgaaagaaggagtcagcctggagttttaagttgcttcacttgagcataacagtttttcctcttgagcaactcaaaatatcactcaaaaatgggaaagaattccttgtttaccagatatttttgaagaataaatatgttaaataaagacgttacagtgtgtcaccttttgtctctttgcacaaatgaaaaccctgtgaatttagcactgttcgtcatgaatgaataaacttttgaaccagaaaaatgagtcattactgctcctcaagtttaatatacccaagttgtggagaaatatatcatttttcccctaccaattaatgccactgaaatacagctattttgggggatgatcagctttcaaaatagttatacaaaggccattgtgtatctgattatgaagattaacatgttatttagaaaataaactctttccccaaacctctgtttgccaccagttcttgcttcgactgagacgttcatggatttctgatcattctgtgtttgtatagattttgttttgttctcctttctaggttacaacatatgtttacatagtgtcaattttctgtgagtagaaaacagcaggtagttcattctcagaaaagtgatttacagattttcttgctatgcattccttcctttgattttcagttccagttttaattttaacctagctagggaattgattctctccatagtagtatcagtcatcaatagagtttggaggaaaa

SEQ ID NO: 11943 - DNA, 1031 bp, Homo sapiens
ggacagtctgtactgtgttttctcttacatatacatatctttaataaaatttaatttagaaattaggcacaataagagattaacagcagtaacaaataataaaatagaacaattataacaatataccataataaaattatatgaatgtggtctgtctctctctctctctctctcaaaatatcttaaatactggattcagctttcttcttgtgatgatgtgaggtggtacaatgcccacatgatgagatgaagcgagataaatgccgtcagtattgtgacttagtcttaggctactactgaccttctgtattgcagaatctgtgtaaccatcccttgtttccagtaaatggtttgatattactcgtttcaggagatcccttgctgaaatcttcatttaagctcaatactttgaggggcaacacattcccatgagttggaactcatttccgttcatgtcctccacccacaaagttcatagcctttttcgtcttaactaggcacctatcatgcactgtagccataacttttgctgtttcaggtgcaacagtaaaatgagcattaacttcattttccttctttgcaatttcacagataaattagttcttaccgtggaccgtagcagcctctgcataagatttttttctcttaagtcaagaattttcaccttttcactttttaaaggaagcactttaccctttctcttttgcatatccaaattgccagcatcactatgattcttatgctttgggcacattgtgaggtaccataaggcaggagtccccagtccctgggatgcagactggtatcagtccgtgacctattagaaaccgggccatacaacaggaggcgagcagcaggtgagccagcattaccacctgggctccgcctcctatcagagcagccatggcactagactcttgtaggagcgcaaaccctattgtgaactgtgcatgcgagggatctaggttgtgcactccttatgagaatctaactgtgttagtctgttctcatgctgctatgaaaaaaatatc

SEQ ID NO: 11944 - DNA, 1023 bp, Homo sapiens
tagttagatcacagcttctttattagcaagttttaatgactttgttttctccacctcatctaacaaagtacgttacggatattgctcaacaatactacgtgtgtattttatttgacttcatactcagagatggattgagactgtctatgacagtaatattaggacctgaaatttcatcttatttatagagggggcttgaatgttggctgttactgtgtacttccagtttgggctaagagctttaggatgaagcaaagtttaccagcctaactcacaaattggtatgttgatctttctatctttatccattcattctttatcagctgaggggactaatttgggatttaggggaatatagaatttgatgtattttcagggtttttgcttctaatcaggaataatggctttatgtgtataaaaaaaacattaaaatattatgtgcttttattcaaactagatgtcaattatctcagagtttacattcactccacagtggtaccatggctggaaagaggaacaagtcttcttatataaaaatgtggcctattaacaacaaaagatggattaatatactttcttcctatttacagtttatggtctatcctgaagggatttgttgtgttcacctatgttttttaactggcaaagtaagtataactacctttagttcatgaacatcagcagagggatatatctattttactttttaatattaaaaaccacaaagccttttctaaattagcagggggggatttacacagagaactagtgaaaaatgttatgagctttcatcctctgttttggtttgagttgccactttggggcttttacatgtctttccctttcccatctcatctctaggaggcaaacaaagaaatataatttgcattggctatagaaatgcctccgagatcactgctgtaagtgtgctggggatttggagtagaaattctgaaaaggagaaaaagacaagggtaaaagctctgttgacaggagagtttcataggcatgtggggagagcac

SEQ ID NO: 11945 - DNA, 1031 bp, Homo sapiens
cactagaagtagtggtagtgaaagagaaaactacaaacacaagcttcacatttcaaaacactgaatatcagtgtttgtgtgtgtgtaggtgagtgtacacatacttacatgcacacatcatataaacatacataaacacacatacttaggtatatttttgcaaatactaattttccattatttcccagggtacagattccaaattccatcagagggaagctaaaaatttaaacatcctatctagagtagtccctaattaatagacgaccgctcagtaggtaacccctatttgtcagcgaagttttaaacttaggaaattttagattagttgttaaaaattttgtttattttgctaaataaagccaataaacatggaagccaattcaaagagaagtcttcaatttcagtggagtgaatgaggagagaaaggtttgtgtttctggtcatgtaaggaaaagatagctcaagagtatagatgtcagtgttccaaaataaaaaattacgtctgaccaggattggaagcttcagatcaaaagggcaattttagaaaattgtggcgagtgaatgagagcactagtttattgaagaaatcaatttgctatcttaaccaatggcaccagtgctctccctataatctctgaaaatagataggcattttgccgttcaccaatccgtagatcgcatctgcttccttacacctggcaagctcacccccttttcaaataagatagtatcacgggagctttgtgggtttatgaagccacaggtttattagttagataaaatctgtaagcgtttagaaatttaaaactgggctgtcaaactgtatttcagttataatggcaatttccaaagtaaatacaacatagtaacttttaggtcttgtcattctgtttccttgatagtgtgtgatttgtgagcatccaaggcaggtcttcctgtctttgctttcgaacttagctgtacgtagagagtagcaattgaaattctgaaacttagactctgtaattaataaaataccttcaattgcc

SEQ ID NO: 11946 - DNA, 1048 bp, Homo sapiens
ttaggatgaagaccctctacacctcgctgtcagaaggcttttgttgaaattctgtctggctctaaaatccatccttgacctctttgacactctgcctggcatcttaggaaggttccattaacagttaataaggtgaaactcaggaacatacttttttaaaaataaacatactcaaacaaaaatttctgctttttttccccttgtagccatttattcagcaaatagtatttttggagagagagatgcagccatttggtaaacagtaacaatctagatacatcttattaattttccttcatgattgattcaactgtaaaattatatgagaaaccatagcctagctgtagattgtacagtgacctataactttcattttatacatttgtaaatataccttgcagcctcatcattcagtgtctttgttggaggactgtgttataagtgagatcattttctaacaaattcctcctgtacaaagtctaggacagctctgtgtcataacagattccatgcttagtggcgcttgtagaaaccacaaatagtggggagatgagcttttgttcttgggaagaagccagtagaacttgtatattcataaagagcaaggtgtaagtaataaattcaggctgtgttcttaaaccaagttatgttttagaagtttgatttcaagcaagcttagctgacaccaatgcattctttgggtgctcttttattctcattaatacgctgaaatcttggattggaaaacacggtataaacgaatggtggaattcagactagagcccattgagggtgtggtttattgtttcttttccaactcttaaataattctgaacattttaaccagccaaatagaaaaatccctctaggcttttttgtatagttgttttgtttctcttctgctactcccagtaacattacataagttacctggaaattgcgaagttagggtaagctgagccagacagtcaaaatacctggaattttcacttccttagacctaagagtgaagttggataatttggggatgctaaggaagaatttgggg

SEQ ID NO: 11947 - DNA, 1031 bp, Homo sapiens
aagctcaatagaaaagccattatgaaaggaagggggagaagttggcttttatgttgctgtcaggatttgggatttattttctttttattctgacaaaactcttttggggtgtgtttttttctcttcaattcaaacagtttatacaagtgttattttaaacttcctagtgtttacatcatcatgtcgtttaaaaagaaacttttttttctttcaattctgttatctgggaatttttaaggacacagccatggtttctgagacacacacactcacacatatatgtattcttctgaatatttctatttttctctgcctgattgagaaataaacaagaacgggctaattcaagaatacttaataagggactccattaaaaatttatgttcatttcaatatatgtatgtgattattttgaaaatttatatgacttcctagtcagagattcgttactttgtaaaacactcaccacataaagatggtttataaatacaaaaatgacacaaagctctatgtcaggcagcaagtcggtggcagaactggatttaggattttgagttctgacttctgtcctgtcatcaggccactaatctgcttgattttctgaaagaatttgaggcctgaggaaagaatatgccagagacacatttccaaagagatgagtcacattgggtggtttgatataataaaatctgtgtttattttgcaaagggcttttgaacagatattagagaaacaaatttcatcatcatgttcaactttatactttgtaacattgtactttctgttccaatagttaacagcactaagttcatagttcttctcttcctgttctcttttgggagttttctatttaaaaaaaaaaaaaaaaaggcagatttttagtgttttatcagagtgactttaaagtgttattagcatccttcgcctggactaggactattaaatcagcctttcatctttccaatgctaggctttgcctgagtcacttccttgctaataaacattctggtggttccccaatgcccagagca

SEQ ID NO: 11948 - DNA, 1028 bp, Homo sapiens
gtttcctctttggtcaagaggcagcaagggaaagggggatagaattgcatattgcaaccatttcagctggctgaggtttccagaacacttactatgtgaatgagacattattataatttaaattgctaagtgtgattttaaaagatcagttataacatgcctgtttttgaaaactaatgtatattttaggttgagtgtttaagttcttcagaataattttttattctcatgtttattgtttagtaagtattaagatttttagactaattctacagattaaggagttaaagcattggaacagaaatataaagctttaaggatacaaaggaatacatttatattattatttttatcttttctagtgttaggaacctaaatgttttgaagctgaaacataaagaatggaagaaaaaacaaaaattatgctgaaaatactaattaaccatgaatgctgcctgatttataattccatgtacagagattataaagaagaaatatagctcacaaaggatgagatgctctaaaattgtaactcagactatataattgagaataatcctgctgagaaagaaaaggagttaaataaaagtgtgactatatcaggagctctttgataagctcagaatttcaaggggtaagtatcaaagacagaggaaggagtacatagttagggcttagtaagaaaggcaggaacttcaggagagctggcaatcagggtcattaactcgtttattcattcataccactaatatttattgggagactttcatatgccagatacacttgtttatgttgagggcaataaaatataatgaagttgttgccctcaaaaatctactgtgataacacagggctgtaatattaaaaactgacatggttggctgggtgcaatggctcacacctggaattctggcactctgggaagctatggtgggaggattgcttgaggccaggagtcagagaccagctggggtaacatggtgagacctggtctctacaaaaataaatttttaaaaattagccaggca

SEQ ID NO: 11949 - DNA, 1045 bp, Homo sapiens
tggcgtgatctcagctcactgcaagctctgcctcccgggttcacgccattctcctgcctcagcctcccgagtagctgggactacaggcgcccgccaccacgcctagctaattttttgtattttttagtagagacggggtttcaccatgttagtaaggatgatctcgatctcctgacctcgtgatctgcccacctcggcctcctgaagtgccgggattacaggcgtgagccaccgcgcccagccttgtatggctttttaactagaatagcactagctctgcaagcgataactcttgaaaaaaattacaaggtctgcttttgcattttgttcattttggttcttctacagcttgcagtaagattcctgatggtaccaccaagtgttgacgatatctcccatgaccttcatctttgaactcttctaagattctgcttcttgttttctttttcttgagtaatgtaaatacaaattttagctcaggcctgtgggatgatgtgtatattttcttttcgttaaaaggtatgtggtatataaattgagtatttatatctcattattttgataacatgctacaaagatcccagtagctgtgtttaatatttgttttaggaaatttgccactacagacaaatttattttagactcacttctctgaaaaacagtgaattaaatggtggggaaaaaacccgatgtggtaaagtaatgtattatctgaattcatggaagccacgtgtaatctttcttttctcagagagtcttttattctctccatattcattgtttgtttctattttctgtgtagtaactgggcttgtgctgattattataattctaagtgaagtgataaggacagattcttgggtgacagttatggcaccttccttctgaccttaggctagttacttcatttcttttctctttcactttctttctttcctagcttatcaaggacacagtgatacatatttcacaagattgctcaaagggataaatgagatgatatatgtaaaatctcaaatgttctaaatattataaatattgtaaa

SEQ ID NO: 11950 - DNA, 1082 bp, Homo sapiens
gacacttcttatttcattatgaaatcatttaggaacagattcttggagttagaagcatatagaaaatggtagttttagtctgaagggccattagtctttttattgctaatgacacttttatcagtaatctgttctacttggaatcagttctataacattttaatttttttgccagacattattggtgaatttgttttagatacaggatctcactgaaaatttaaagtatacccacttggtaatgttgtaaatcgtccttgtcttgtctccccctttcagggagtttgacattatgcatcctgatgaaatggctcctgggtctgtgtccacgttcttcaggaatctggagggaatataaacttgatgcaaagtctgactagtagtgtcttttttgttcatatcagtgcatttttctctgtttcttcagtgacccccacgtagttgtttgggtcagtctgcatgttgagaaggcaatagcttcaaatcagttggttttagatatagtggctggattggattccaagtagtaggaccttaaggcaggacagagaaagatatggagccaggtacccacccaaacctagatcttttggttttctgcaatagtatgagtctgtcagacaaggatagataaattgagtattacatagatagaaaaagggtacaccccttaaatggattattttctacactgcagggaagaaaaagacctccccggctcctgttttaacaagctgtattttttctactttcatttgatatttgctttcattaggcttacgtacaaagttgaccattttgtccaacttttattgtcaatttaaatagttggtctgctgaaaaagtcctcatgctaattttgaggtctttctctgtcctgccttgaggtccgacgactgaaattgctcagaatattcaggaattctactttggagctgccatagagcctgaggcgtactcttttgataacctcagcgggcaaattttcttacttggaaggaaggctttatatttgaaaatggtcaaaagatatttgaccaagtccagtgaataaagcaggcaggcaatgaaaggtgggggta

SEQ ID NO: 11951 - DNA, 1459 bp, Homo sapiens
cctcttaaactgcaaattatgatgccctttcttataggggtattgtttggattatgttagatactacgtgtgaaatgcctagcatagtgtctgtcatgaactaggtgctcaataaatgttagctacactcagctctctctcccagtcgagtctaggttctgatcattaataacgtttgaagtttcattttgtacttactttgaacttatttgagtctaaaaagaaaaaatgtatcactttcttgaggctgagatcaacactttaaaatagtgattcagtggtctgtatatgatctctgacaatgtggttttattaaggtgctgtatttggtgcaagtgtgaattctatcttttattcatataagtgctccttcagtaattaacatttttaccctacataataggtaaggataaataaaaactttaggacctaattctgtagatttttcctcttgttatctttttgatttcctgttagcaaatatgaactagtgaaaatttattgagatttaatcgtttgatagtcattcacctctgcattatattaagttatagtacctgtggataaacagaaagtccgtgtggaaaaagaaatccatctgagttttcaatgttttgctctctggagtcaacagtccttcaaagagaaacttgtaggttggtttgtttatttaaattgggtgcaaggagaaaggcaccataaacataccattgcctgatttgaagaggtgatgtaaagtaacatggagaaattagttgttattttctcttcccaatgaaacagaatttgtctatcagtacaactaagcaaagataaaggaaagtcttcttaaaacagaaaataaatgtattttcttgcattaattggggttcctgaagaagcagttgccaagatgggattagacctgtaagaagtttattaggggagagggcaggacaaggccgggagagccttttgactatgaggcaagtttgacacttatgcaaggagaggggcaagggaagacgattgagtaggaagaagcttgactatagtgcagcctatgaaaggtttggctaggcaaataagagtcagccattggaagagtcacctatcttgaaagaatggcctgtatcagcattcctcactgtcagtcattggctgggagcagctacaggaagcatggcctccgtgcctaagtggtgctagagccataggggaagcagttggggaagtaagtcagttacactctcaaaacaggagatctgaatggtatagctgtggtttggcagtatagcccagtttagtagtacttcacttgctttggacacttgctttggactctgtctttttctgtctctctgtcacacacacacactcacacacatgagacctggcaatttctttgaggtctctttgagttttgagtttctttgagctttgttttcctcaattgcaaaatgagtgtaatggcagtatc

SEQ ID NO: 11952 - DNA, 1049 bp, Homo sapiens
tggtttatcttaaaaaacaccacacaaaactgtctaaacaactctgtaaataaactgttccaaatgcctcaatttgatgaatgaattaaagaattatggttcttaatccaattatgatcagtctggttattccatttcccatttgggggagcttggggagttggaatagtaaatgattctcaaatgtgagtggggtctttgttgtttactttgtgtgtgtgatgtaacgtaaataatcactcatacctaatatttatgagagggatttctgatgtggagaagtaatttcaagatcttaaattaaccaagagttcgtttgcatgaaaagttgccattaataaaggagtaaagtgaagtttttaaaaatatgaagcaaagatctaaccttttgcttaaatataatgaattttgatatttaagaggggagaaatggagtgcttaaggctcagtagaagggcagacaatcaggcacttttagtttgttttagccaggccatatggggacatttctgtaggactatttaataaattttaccaaattcaatttccttgtctttaaaattgagtcagggtcaaaggtaggctaactatgagttagcggaatttcgcggggggttgtttcctccaaagccctgctcctttatctgcctacacgggacttttgaaggctttaccagcgaggaccctgaccttcaggatgggcccttgacagtccattttgctttgatgggcccttctgaattcctgcctcatttgccccatttaacctctggctcataagctaattattttaaagttgctaatagttcattatggtttaattctcaaactagatgatattactgttattttggcagtttattatgatcgtctaattccatagagataaacttgttgcaattacaggtatcaaggaaagctgccaggaggaaatatttacatgcatgaggactttttcaggactactcaaatcataccttataggcaactaatgattttacttgcaattaaggataacattcagtaggggcagcatattgacaaaatta

SEQ ID NO: 11953 - DNA, 1273 bp, Homo sapiens
gtagattgtgacttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatgaaatcagcattgttgaatgcatgaagtaataatgctaaattaacatttttatgatgtctcaaggtttctggtcaagggaagtaaatgtaggatagtatttttacaccaaaatgacacagagagaattgagcacaccagaaagaccagaaaccacaccactggatagagattcaatatgtttctttttcaaacatttggacaagaaaaaaatgggcatttaaaaattcttccttcccctggttatggatttatctgtagtaaaacttagctttgtcgtttgag

SEQ ID NO: 11954 - DNA, 1059 bp, Homo sapiens
tgtttaaagtattagcttgaaggtgatggatccagctattcagaaaataactttcatataaccatgattttgcacagtatgaggtcttaaatgtgtggaaagagataaattttttatcattaccacaaaccccttttaaagattcaaaggtggaagaaagtgatttattttttctcttcagcatacatatataaaagacttgtcagatgtttaatttggggaggttgataatgaaacatatcaacagagtatagtagttatagtagtgtttgtgggtaaataatttcctggggtcagacatatataaacatatttgcttcaaaatgataaaggcatgaaatcagtcttaaaaattgaaatgggggtgatgggggagaaaaagaagaacaaatttgaagtgccctttcaaatctgctggatacaagtattgaagttttaagtcatcttattctgtctgaaagtgtatttttcattctacaatagacccaatcaacaagacgtataacttgagttgcatgatgttcagtttatgtaatctactgttgggatggtaagaattgatgtaggctgtggtgtaagaatgaattaaaatatagtttcactggcttttctctacatatccactatcacaatggctaggtttcctgttgctcactattggattctggagaaaaatttaatgaaagatgatatcagaggaagaataagtggaggtagagaagaaaggaatgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttct

SEQ ID NO: 11955 - DNA, 1047 bp, Homo sapiens
cacgaaagccctctgtgttcagcctctgtagactggccagaaccactctgtggtcagaggtctcttatcaggaaagaattcttgttgttgtgttgaaactgcaaaagggaggggcagtgtcaggcaggtggttgataccagtctttcagaagcactggtttctgtttaacttttagagaagaaagcttaattggagtgttactggaaagggataccagtctagaccacaagagaggattcttggatctcacacaagaaagaattcagggtgagtccacagagtaagatcaaatcaagtttattagagaagtagagaaagaaaagaatggctgctccataagcagagcagcactgaaggcttctggttggctatttttatggttatttcttgattatatgctaagcaaggggtggattattcatgaattttcctggaaaggggtggggaattcccagaactgagggtttctctttcttttagaccatatagggtaagttctggatgttgccatggcatttgtaaactgccatggcactggtgggaatgtcttttagcatgctaatgcattataaatagcctaagataagctgtgaggatgaccagaggtcaatttcctcaccatcttagttttggctggcttctttactgcttcctgttttttcagtgggttctttgtgacctgtatctgtcttgtaatgtcctatctcatcctgtaactaagaatgcctgacctcttaggaatggagcacaggtggtctcagctcattttatctatcccctattcaagatggagttgctctggtttaaatagttctgacatattttccccaatacccccaaagggacccttaatcccaaaatttgcagacagatgaagatccatcttctgtagcttcttctggctgaatacaggtgatgatatttttgcgtaactattcagggtagagaggagctcagtgagaaagcatcagtatggtgaaggccattcctaactcccgagttctcacaaaaggtgatatctggaagattaataagtgttcaattta

SEQ ID NO: 11956 - DNA, 1013 bp, Homo sapiens
aacatctgctagtctgtatattcgtcctacattcattggaactgaggtgcaaactgactctttattttggggtactttgctgggcaagttattattgtttattgttgtttgaaacttctagcatatagtttgcagtagccccccagtagcatcattaatgacttcttccttctgattgtcaagattagaggtagcaaacattttctgtgaagcgccaatcagtaaatattttttggctttgtggccatatagtttctaataagaaattagatccctacctcttaccataccccaaaatcaattataattcgattatatacttaaatgtgacaaaatactaagacgtttattaagaaatacaaaatatctctgtgaccttaggtaggaaatgattttttttttttgaggtctctctctggttttttttttttgcccacgttgtcgcttaggctggggtgcagtgatgcaatcacggctgactgcagctttgacctcctgggctcaagtgatcctcctgcctcagcttcccaagtagctagtactacaggcatgtgctaccatgcctagctaatttttaaattttttgtagagatgatgtctcactctgttgtcctggctggtctcaaactcctggcctctagcaatcctcccaccttggcctcccaaagtcctgggattacaggcatgagccacttcacctgaccggagaggattcttaaactctgccattttagtactaaagcagccatagacagcacataaatgagtaaatgcagtgctgtttgccttgcccaattaagactagtcattattttctaagtttacaagtgcagtgcctcccattgtggcagtacttctctgaggtagaaatggttttaaaatttaggggagggagagctgctaattttcattttcatgaggtcttgggattacttggcatggagtgagaatggaggttccccttcccacatagaaaaatggtgaaaataaagttcacagtgggagttaaggaa

SEQ ID NO: 11957 - DNA, 1031 bp, Homo sapiens
ctttgtgtgagcaataaagctttttaatcacctgggtacaggcgggccgagtctgaaaagagagtcagcaaagggtggtgggattataattagttcttagaggtttgggataggcggtggagtaggaacaattttttgtgggcaggggatggatcttacaaagtacattctcaagggcgaggagaatattacaaagtaccttaagggcagggaaggatattacaaagtaccttctcaagggtggggagggtgtatcatacaaagtgcattcacaagggtggggaaatatcacaaagtacattatcgcaagggcagggagggtgtattgtcacaaagtcaattgatcggttagggtggggcaggaacaaatcacaacagtggaatgtcatcagttaaggcaggaacctgctattttcacttttgttgatcttcagttgcttcaggccatctggatgtatacgtgcaggtcacaggggatatgatggattagcttgggctcagaggcctgacagacatgaacttcccatcataaaattagaagagcattaatcaaatgattagaataaaatattaccattattttgaaatggcaagcattgtatgtaaataaacagcagaggaacccactgtagcctagacagggttcagagacgttcctgccaaggacatggcacagggactgaacaaggaaggatgacagtgcctggcaaaggcagggaatgttacaggtatttgggcacctgtgagaaggcctgatgtccgaaaggactgaaataaattaaatgtgtggggggagagagaaagaaagagcctagcaaaaggtgagctggagagtcagaggcagaaggcagaatctgggatgggctgggagcttgccaatcattttgtcaaatgggtgatgtgaagccttgaaggttttttgaccaagaggagatgtcttcagatttgcgtttgagacattttcactggttgtcatgctaagaatggcttaaagagaagcaaggctggggtcagaggagctgcttggaagc

SEQ ID NO: 11958 - DNA, 1063 bp, Homo sapiens
aaaaggggaaaaatatttttccttttttacgcaagaatttctcttgcttttcagctcattagaaccagatctaattatttgaaatgagtttaaaaccttattatgaaaggaagttgaaaacattcgatcacaattgagttttgtactatggactaaaaccaagatgtgctttctgtcagtagctgtgcaactccctgaaaaaagaaaaatagcgcagagcgatctgagctttgtgaaggctacacaatttatcaggcccagagagataggagtgtgagacttcagtcacgtccccccgtacgcatgcgcaggagtaattatttaaagacattttgttcctgactaactgcctcactcattatgttcctggaatttgtgatacaaaaaaacaatgtttagcctatcaatagtttatatagtttatgttattttaatataaattcttctcaacttagaaactgcctcttttttcttttaaaaacccacttgtaactgctgtatatattcagggcaacttgatttggtgtttcgttggttgcagtcctcaaatttgacctcaatatactctctacttatataaattttgtctcagttttgtccgtaggctgacattccaattgttttcctaattatatattttgttccttatttctcatgtctagaaataaagctagggaagtaaacagctggaaaactgatagtggtgttattaacctaactgagagggctgggcttatgagtaaattattcctgtgcataaatgaaagattgtttctaaatggcagctatgttgagcctttgtattagttacatcttttggggtttcaggttgccagcttctttaaatggcctcttctcaactggtataggaagttggaaaataaagaactttctttatttccctttagtgttggtaaccacagtttctttaaataacagatgcccaccccagggaaacccagtggcatgatcagccttatgctcaggaaggtttggttgctatactggagagtgagaatctgggaccttccatgatagacataattgtgccagctatcctcta

SEQ ID NO: 11959 - DNA, 1063 bp, Homo sapiens
tgagtcatgctgcttgattctggactgactgctctctacatcaagaagcacaactgtggtgctggaatcctacttgaccatgctcccagaaattcctcttgcctatcctctatgttgattatcccattttctacattccaaagtgttccatttcctggttttatttttgtttctgtggagcacatcctaacttcttgaaaagggtacatggaaggtaaatgagaccctggatgtctaaaaatggctggctccctctatctgtttgatagcttgtctgagtatagaattgaaagctggaaataattttcttttcaacattttgaagtagttgctcgtctgtttgcttttaccattgctattaagttcaaagcagtcctggtaagtgatcctctgtatgtgatgtattttttctctctctccccagaaacttacagaatcttctccatgaagattttgaaatgttagtgatgtgttgataatggatttatttttatccattgtactggacactcagttggcccttgcaatctggacacttgtttccttcaatttgggaaaaaattttaaatgatttcattcatgatttcctccctcctccattttcttttttctcccttcctggaacttttattatttggatgtttgaacttctaaacatgttctcttccttttttctgtactattttccatttgtcttttttttttaagcatggagtttcgctcttatcacccacgctggagagcaatggcctgatctcaactcattgcaacctccgcctcctgggttcaagtgattctcctgcctcagcctcccaagtagctggaattacaggtgcctgccactaagcatggctaatttatgtatttttagtagagatggcttttcaccatgttggccaggctggtctcgaactcctgacctgaggtgatccactctccttggtttcccaaagtgctgggataacaggtgtgtgcctctgcgcccagccttttatttagttgtatgggggattttctcattttcttcttccaagtgttctactgagttgttcatttctgctct

SEQ ID NO: 11960 - DNA, 1027 bp, Homo sapiens
tcatgatttcatggcttcacattgtaacatccctttaccatattttttgaggactgttttggcagaatgtgtgaaatcttgagcagaagtattacccaaaagtcagaagaaaatcagatttttatttcaagattctgttaaagttacccactcccttcttttacttaatcttatagttgcagttctctctctttttagaaaagaaaaaagaggcccctcaggatttgcagatgaaacaatattgctctttagagatatccatctggctgttagattatttttccacagttttcagaagtggatgaggccattagaatcttgagtattgcccatttccttatgtgtgcctttgactatagataaaatagatgcatgacaattatttataagttgattgatttttcttgtcatttaaatcatcttgaataatagagttggtagagctatcccatttttgaaattattttgttttgtcaataactttttgttaccagcatgtacacttgcattgttgactctccatataatacctttaaaaaatttttttttgtggtaaaatatgcataacataaagtttaccatggtagttttctttcatttgttttgtttttgtttttttgagacggagccttgctctgttgccaggctggagtgcagtggagcgatcttggctcactgcaacctccgcctcccgggttcaagcaattcccctgcctcagcctcctgagtagctgggactacaggcgcccgccaccacgcccggctaatattttgtattttaatagagatggggtttcaccatgttggccaggatgttcttgatctcctgacctcatgatccgcccacctcggcctcccaaagtgttgggattgcaagtgtgagccaccgcgcctagaccatggtagttaattttaagtgttcaattcagtgaccttaagtgtgttcataatgttgtgcaaccatcaccatgttgtctaaccattagcactatctgttttgagaacttttttttatcatcccaaatta

SEQ ID NO: 11961 - DNA, 1050 bp, Homo sapiens
gggattttaccatgttggccaggctggtcttgaactcttgacctcaggtgatccacctgtctcggcctcccaaggtgttgggattataggtgcctagcccatggtgcctagccctaacctacatttataaactatcacttgctgctgtgtggagactatattgtgagattaacagcagggatacctgctaggaagcaattgctgcagattgcctgagacaaaatagttatcatggactagggggatggtggtggtggtggtggtaggtggttggatgtaggatatattttgaagataggtaaatggtgcaagattatgggtcagttttaaatgcttaagtaaattttctttgtaagacattttaggatgccatgttaagaatctctttataactgtcatttaaaaaaaaaccacatattttcttagcataatttcccatagtaacattactatgtcaaaggctatgaacatttgaatgactttagataaatactgtaattgctttccaaaaatattgtgcttattatgtcaccagaaatgtttgaattctgtctacaattcagtcttgccagtatagtacatttcatttagaaaaattttttactatgtagatggaaaaaataatattttagctgggagtggggggactatggggaataactttccttcatttaatattttattgtgagttagtttaagttactttattttatcgtagtttcctaaggctacaaattagtaaccttggtaacttatgtacctaatttaaaagtttacttttttgaaaggctggaaatactaattaaaaacgtaacaccttcatccttgtctttgctccattattaactagtttcattacagaatctctgtgttttaaaatcagatgggttttcataaccagtactttctcagagtggtaaatttaaaaaaatatataaagagaataaataatatttgttgagaatacttcaaataatgtgaagagttattaacttacagcaggagttggcaaacttttctataaagggccatatgggtctttgtcacaaa

SEQ ID NO: 11962 - DNA, 1062 bp, Homo sapiens
tctgagtgggtatgatgagtcagtgtctgggaagggccaaaacattttgtccctttctataatttgtcatgataatgctagtaatgaatctgatctcccttcctattttaaaaaccttttagtgattttgtataggatgaagtttaaaactccttacttaatatacacatgaccctccgtaagctggcccctgcttgattgtccagtttcacttcttggtgcttattctaaggcctctaagccttagagatcctctaagcctttgagatccccaaaccctggactgcggactggtacccacctgtgtggcctgtgaggaactgggctgcacagccggaaggaggtgagcattacttgccttagctcctgtcagatcggcagcattagattctaataggagcgtgaaccgtgttgtgaactgcccatgcaaggatctaggttgcatactccttaggagaatctaactaatgcttgatggtctgaggtgaaacagtttcatcctgaaatcacccccaactcggtccttggaaaaattgtcttccacgaaactggtccctgatgccggaaaagttggggaccgctgttctaagctaaagttatatggagctccttggttctgtgtcctcaacatgctgttctatgttttttacattctgtttgctccttcctgcttggaatgtccttcccctccccgtctttcttaatgcatacaaagttgatctctcctgtgtgccaccattgtacttcgtcttgcatatggtgttacattcattttattttaattatttatttacgttcatgtctcttccactcaccttagttgcttgaggtcagaaactatataatgtgtgacacggaatgtgacacctagattttcaataagtgtttctatgatacaagggagactgatgtgggtagatgggaatgaactcatcaacctctgtttacataccctaaattccctgtttcttccctattataattctgacagtctacaaccgtctttgatggcttataaacggaaagtgcggaacacatcattctacagtgaatttaaataac

SEQ ID NO: 11963 - DNA, 1035 bp, Homo sapiens
gtgcagtggcgccatctcggctcattgcaacctcggactcctattttccccagagatatttcacacattaaaatgtcgtcaaatattgttcttctttgcctcagtgtttaaatttttatttccccatgacacaatccagctttatttgacactcattctctcaactctcatctgattcttactgttaatatttatccaagagaactactgccatgatgctttaaaagtttttctgtagctgttgcatattgacttctaacacttagaggtgggggtccactaggaaaactgtaacaataagagtggagatagctgtcagcaacttttgtgagggtgtgctacagggtgtagagcactgtgaagtctctacatgagtgaagtcatgatatgatcctttgagagcctttagccgccgcagaacagcagtctggctatttagatagaacaacttgattttaagataaaagaactgtctatgtagcatttatgcatttttcttaagcgtcgatggaggagtttgtaaatgaagtacagttcattacgatacacgtctgcagtcaactggaattttcatgattgaattttgtaaggtattttgaaataatttttcatataaaggtgagtttgtattaaaaggtactggtggagtatttgatagtgtattaaccttatgtgtgacatgttctaatatagtcacattttcattatttttattataaggcctgctgaaaatgactgaatataaacttgtggtagttggagctggtggcgtaggcaagagtgccttgacgatacagctaattcagaatcattttgtggacgaatatgatccaacaatagaggtaaatcttgttttaatatgcatattactggtgcaggaccattctttgatacagataaaggtttctctgaccattttcatgagtacttattacaagataattatgctgaaagttaagttatctgaaatgtaccttgggtttcaagttatatgtaaccattaatatgggaactttactttccttgggagtatgt

SEQ ID NO: 11964 - DNA, 1021 bp, Homo sapiens
tagttctgtatctcttaagtggaatatttaggccatttacattcaatgttagtattgaaatatgaggtaccgttgcattcattttgctatttgttgcccttgtactttaggttttttattttttgtttttgctttttaacttgtatttttgttttatgggtcctgtgtgacttatgctttaaagagattctgttttgatgtgtttccaggattcatttgaagatttagagctccttttagcagtccttgtagtggtagcttggtagtggtgaattctctcagcatttgtttgtccaaaaaagactgtatctttccttcatatttgatgcttagtttcactggatacaaaatccttgactgttaattgctttgtttgagtaggctgaagatatggcctcaatcccttctagcttgtagggtttctgctgagaaatctgctgttaatctgatcaattttcctttataggttacctggtgcttctgtttcacagctcttaagattgattccttcgtcttaactctggataacctgatgacagtgtgtccaggcagagagctttttgcaatgaattttcccaggtgttctttgtgcttcttgtatttggatacactagcaaggccagggaagttttccttgattattcccccaaatatgttttccaagcttttggaattctcttcttcctcaggaataccaattattcttaggtttggtcatttaccataatcccagacttcttggaggctttgttcatattttcttattcttttttctttgtctttgtttgattgggttaatttgaagaccttgtcttcgagctctgaatttctttcttttacttgttcaattctattgctgaggctttgcagagcattttacatttctataagtgtgtccaatgtttcctgaattttttattgttttttctttaagctctctatttccttgaatatttcacccttcactttttgtatcttttttggggtttccttagattgggcttcacctttctctggtccc

SEQ ID NO: 11965 - DNA, 1033 bp, Homo sapiens
tgtatcaatctggtgacccgtgtaactgaaaccaagatgttaacactgtaagaaaacctagcttatgtttgcagctcctgagaataaatccctttatcttgaaatacctggaaatccctttttaatgtccagtggagtcatattgccaagtttgagaaatgtgtctagaccagtatttcccaaacagcccaccagacaacaccagcctgtaagatggtgatattgtttggatgttttttccctccaaatttcgtgttgaaatgtgaccgccatgttggagttggacctagtggaaggtatttgggtgatggggaatctcttgtgtggctatgtaccttccctgcagtaatgagttcatgaaagatctggatgtttaaaagagtctgtgatcttcctcctctctctcttgctcctgttcttgccaggtgatatgccaactccacctttgccttccaccatgtttggaagctccctgaggcctcaccaggagcagatgctcgtcccatgcttcctataagcctgcagaactgtgagccataataaactgtgaattataaattgcctttatagcaatgcaaatggaccagtacagatgggatgctgggaagacagttgtttccaccttcagtaaagtccgtggaacacagttgtgactatattctaggccagccaagatgcttgtactcagaaaggagtggtctcaggaccataagaaagtgaaaaaataaaaataagaaaataaagaagggattgtcaatgaatcagaattcatcaaggtcaaagtcttaggaaattccttcatgaggaagtctaggggggctatggaaatgaaatttttaaacaaataggtatgtggtgctggcaggaataaattatggacttatgaatataacataagattctttattacctggtctcacccgtctttccacctctgccccccttcttgcccgactctgtgtatcacccataataaactacttacagcttcctagtgttaaatttaccctaaagctgcctccttcaatatttt

SEQ ID NO: 11966 - DNA, 1060 bp, Homo sapiens
gaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccc

SEQ ID NO: 11967 - DNA, 1034 bp, Homo sapiens
atgatagtaattactaagcccatgggaaaggcaaatcctcattagtatctgccatttcaatgctataatgaacccctttatcatataaaattgttagtaaaaatatcaacagtaaccatggtagctattaaaatgactgtggtgatggtgacagctatgtgacaggcaagatctgttttctaaaatggctcctgcttcctaaccacacagaggggtttgctctttttctctgtttatggaaattcacttttaaaaaaatcccttttttgataaatatattctatatgatgctggacagtaggtagttggggaatattaactcaaaacggttgtggcccaccagcactgggtaagagtgagaaaatccgctgaacacacactctctcttttcccccagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatt

SEQ ID NO: 11968 - DNA, 1025 bp, Homo sapiens
catgagtgagtgggcagagagaggccaaaggtatcactagcggaagttcctccacctggggcacatgaggtaaggagaagggcacttccctattgacctttctccattgggagctttatctcattacgtagtaaattgtcattacctttatccttgtcaggttcatgtttctgtgggagatattgtaggactccttgctttatagtatagaagaagtatgtctcaacttgttttcccacagaaacatatctgatgaataacaaaccattagtattggtatctcattagctgctaccactaaactatgcattactcccagtttcactggtgccaaatccattcttttctctgtgagtttgagaactattaatgtagatacgtttcagtcaagactaaggaatatttctataaaatgaatatttggaattgattatctcagtaagtctaccagtatacctgaactgaaagggattccccaaaatgccaaatattcagctataccagaactatactgattggtggtgtaatgtttgtagaattttcagaatttgatgacacttttaggcattctatcatcatcaacaacagcaaacatttctcaaaggcattcttcctacaaagtgcaatgccaagtctgaggacacaccaagaagtataagttgtctggacacaagaagtttgtactccagtatagaatgtgtgccacatgagtacatgtgaaaagtgaataatataaatgtaccctatactacctgctaagtggattacatgagcattacaggcagaatgttaagccatgcaccaaagacacttttgacaggtttgggatgattgtaaaccatttcctaggaattgttcataaagcttaagacactagaagtgagtgttaactttgcaggaatagatcattaggggctgtttggtactaggatatttcataaagaaggtagaaattgagccaggcttcaaatatcccaggactgagtgtttggttcccttgtccactccatctgcattcctcttat

SEQ ID NO: 11969 - DNA, 1037 bp, Homo sapiens
attaagttcatgttaaactttattagtgaatatattactatatagtacatatctgttcatttcctttttacattttctctacctatgactttgtatggcatatggataatttttttagactcatctgagtctctcttcaagtctgtcttctttgcagttttctctaccaatttacttttaaacttcagccactatatttttttatacctgaaatttcatttttttcaaacctgaaatttgagttttttcaaatatatttggtcattttttatcatgctttgttgttttctaatttttgtgattccctatggctgttttatggtctgtatgtggtaactcggagatccgatgtacttgagattttcttgttattctcactcatgttgtgtttcattatatttttgatcatctttgattatgcgctcatatcttttttcaaattgacttcatttttagagcagttttaggtttagagaaaaattacacagaaagcatagagttcccatatagtccctcttctcctctctctttctccgattgttaacatctagaataagtgtggtacattcattataattgataagccaatattgacacagtatttttaaactaaaatccataatttattaaggttcattctttatgttgtttaactatgggttttgacaaatgcataatgtcatgtatccaccattgcagtgtcaaacagaatagcttcattgccctaaaaattctctgtgcttcacctatttgtctctccttctggacccctgagtccctgccaaccactgattttttttctctgtaggtttgccttctccagaatttcatataattggaattatataacatgtagcttttccagactggtttcttttacttagcagtatatgtttaagttcttccatgtccttttgcagtttaatgcctcattttttgttattgctgaataatagtcccttgtattgtttatccattcacctattgaaggacatcttggttgcttctaaattttggcaattatgaataaagctgct

SEQ ID NO: 11970 - DNA, 1035 bp, Homo sapiens
cattacactttgtacacaaatgccaattctggctgctgggtttatataaaagacacagaaaagctgaatttgtaagcattaggttgttcagagaatttatattatagtaggctttttcactgaaaactttccagtcaatattaactaattatggttgagaagtagtacaatttctttttttgcaatgttgaggattaatcacctctgatttatctcaacagtttagaattagaagtttttctctggaggaatggatattagaagctttgcatggctgtgatttatgcagtgtctgacttcatgtttttcaagctgtaatggttcacaattttagcacttctcatcaccaccaaccaaatccagaaaatgtagcatttttaatttgaggcctctgagctggccatacatggaaatgtcaagtgaggtttgtggcgaccacgtgccacaggcatctgagaatgtggtatgactgagtgaaccctcccatttcattgacgacatgtgttacaaattactatggatctggcctctggattttaattccttggtgacaggatctatatttgggggaaagaattgtctgggctaactttctgtgtagtaatcatttggattaaaggattattttccatgcaaatctaaataagatgcagacactgtgggtgccaaggatttgtgtgtgaatcaggggtaagaataacaaaggagcctgttctgtattagtagtgagaaagcatctcttggaggcaaacacgtatacatacttgaatcaagtctcagataaaggtagtggttaaatatcgatggctcaaaatcattgccaacaaccagatgtgcctccctgcagtccatgtagcaagcagggggagggatgttgaaatactcaattgctatgattgtttgagaaccacagacaatgaagcattctgcctcaaggctattctgatagaaaagaggggctggctcaaatccttttgcctcaattttgtccgaacttggaaattacacttatatatacattttgtcgtgtttttt

SEQ ID NO: 11971 - DNA, 1038 bp, Homo sapiens
acaattcctatgacagggctgagtgataataaggtggatttacaaacatgcatctctgtttataatgctaaagctttgaaagatgaattcataaggtcagattccatctttagcaactaacattatagccaagccacttgtgaaaatattctgtgttaaaaaatgaaaacatcttgatgtttgtggtcatgtggttcaagcaattctcctgcctcagcctcttttatttttacaaatacagatgaaattataaggtgtcaaagagagaatagatttgaaggctgtgctccacagcagagcttagacggatgcaaggaaggccaggcacggtggctcacgcctgtaatcctagcactttgggaggccaaggtgggcagatcatgaggtcaggagatcgagaccatcctggccaacatggtgaaaacccgtctctgctaaaaatgcaaaaattagctgggcatggtggcgtgtgcctgtaattccagctactcgggaggctgaggtagaattgcttgaaccagggagtcggatgttgcagtgagctgacatcgtgccactgtactccagcctgacgacagagtgagactccatctcaaaaaaaaaaaaaaaaaaaaaagaaagattcaaggaaagggctgccaaagtatcacgccagagaaggagtgaatgccacgccagtgtgggaacctgtggagtgaagtggataagagaatgggttttcaagttagagtatctgtattcaaatcctgccttgaccatttataaggtacttgtcttctctatgatttttcttttctcatctgagatatgaagatggtaataacaatatccttctcacagtttccttgcaagaattgagggaatgtatacaatatattcaatggactttcaacagtgcctgtctcataagtcaatacaaagtttttatgacgattgtcttgggttggataccctaaaaacaccctgatctagaggcttgtttgcagaaggtatatcgaagagtgcacttggatatgtacctgtaaggaagtgaggaag

SEQ ID NO: 11972 - DNA, 1029 bp, Homo sapiens
tctcaaacttcgactttgctttctgccccttaccactgcctagctacaatggccaccttctgttgatagaacataagcttggttctactacctcagggcctttgcactggctattcccactgcctagatggcttccctttaggtcttccaatggctgcctcgttctcttcattcccatcctagctcaaatgtcacttcttcagcataggccttcaagaaacatttattgggcaaatggatctaatcaataaagtgattaatcacattgccctgtttggtggctttttaaagataaaaagtatatgacattttaccattattttaaagaaaagatcttacagatcattccagcctattcacagaaaaggaatcaatccaagtccatctaggatcttcaggtaacaacccagatctcatgtctcatgaatgaaatatcaggcagtcattttcttttctataattatgcccaaatcattggctatgactttaagtaagagatagaagaaaagcctctgttagactgatgaaatccaaagttattgtgtcataaaagcttattttaattagatttatttttcccacttagcctctgttagactgatgaaatccaaagttattgtgtcataaaaacttactttaattagatttatttttcccactttggaaataggtatttccaaaatacctatactgataattatttctaggtgtataattttttagtagaagttcaaaaacgtatatgccagtatgttttcatgtctttcctcaaaaagctctatttattgaaaaatttacttgcttttcttttgagaaaatttttagtgaaccttctgttgtgaataaattaatcaatgttgttgaccctaatagaacctgttatttgtaagctgtttggcagtgcattctgacagcctttcttctttgcaggaatatattgctaagaatttctgtgtcatgcagtcccagattggctatgatattttggcagaagatactatcacagctttgttgcacaacaacagaaaa

SEQ ID NO: 11973 - DNA, 1296 bp, Homo sapiens
gattgtatgaaaatttgtgtgaaggataaaaggaccagatgtcagatcaataatggggactcctgtgcagttatttctagcttcgaatatagcaccaaagatccatgcagtgtctcaattgtgatttatttctgcttcctagattgttgtaggagataaagttgttttgatgcctgtgaatgcagggcagccactacatgccagcaacatagagcttcttgataacccagggtgtaaagaggtaagttcaagtggaaaaggaatgaatgtgttcatttttctcatgagacagagggagaaaaaagtaatatagtttctttcattgttttcatgagcataatcccagttattctaattaatatccctaaggtacatatagctgtgattagttattgctatttttggatggtctctcaaagatacttgtattgagctatatacttcattatccaaaattgtctttaatttccttttactagttgaactaataatttctggtagagaatggaatctgtagtcttataactttgaacgtttcttcattaataggtgaatgctgtcaattgcaacaccagctggaaaatcactttattcatgaaatatagttcctatcgagaggatgtattaaaaggagtaagtatgtgctacacaggacatttgctgggagaaatgatggtagtcttactgaaattctagatgcaaaacctatgtattcactggtgttcataatttagaatgtgactacacatgttaatacttactctaagtgttttactgaatttcccccccacatttttaaatgtttaaataagcattaaataaatttaaataagctttaaaagtcaaatagctagtagaagggcccagagtagcaaaaccagaaagagacacctgcttctcacatctgtttgttcagatgtctcttgacctttttgctagggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtatgtaaatgttttttggcacttaataaatatttagatcaaaaagagaagattcactgggcttgttgttttattgttataggcatcatttatgatagaatcataaaatagaataatttttgtgaaccaacttgtgcctattcattgctgtgaccaatttgaaaggaaactgtttcctaagcctgtcttctctgtggtagctctcatttt

SEQ ID NO: 11974 - DNA, 1079 bp, Homo sapiens
tttttttttgagatggagtcttgctctgtcacctaggctggagtgcagtggcatgatcttggctcactgcaacctctgcttcctggtttcaaacgattctgctgcctcagcctcttgagtggctgggattacaggcacacgccactgcgcctggctaatttttgtatttttagtagagatggggttttgccatgttggccaggctggtcttgaactcctgaccccagcctcccaaagtgctgggattacaggcatgagccaccgtgcctggcctggccagtggttttcttaccatctgtatttgctaaatacattaatagatgctttaacaattcagtctttaattgactaaaatcacatctattatgggaaagaggcagttagtatttggtaataaaaatgataactttttgaggagatcttgccacgatgatcaaatcaaagttggggtggagaagtcagaaggatgctgtctgaggatatttagggctgttaagtagaagccagattagatttgttctaaatggccttgaggtacatgtagaattacgaacagcatttaaacagagacagattatgcctcaacatgacaacctgctcccagtggcatctctgcatggctacagtacactacgtagggttcagaggatcttggttcatatttcatctcaattcctcatgaagaaaagtctcagtttccttctctgtaacatggagaaaataaccctggctaactcttgagagtcttgtgaagatccagtgatctttattatcaatgtgtagtgctgtttatagtttacaaagcgctccatggtagtaaactgtattgaacaaaccaagtgtggcattggtgtccctaccactaagaggtcaggcagtcacttgtcagggcattcaagcatcctatgtgtggttgaacttcttcatatttataatattctaatctggaaatactatcctgaaggatctagggaattcactttttgagtttttgcttctttgcttcaaggaagggaaagattggattttatctgaggcttctttgagtgctaacattttatcagtctacaagcctgtaa

SEQ ID NO: 11975 - DNA, 1029 bp, Homo sapiens
atgccaagctatctgaccatttttgatgtgttcttcctccttgccctgtttataaaatttatcttccatttctttaaacatttcataatagttattttatattttttagttgataattacaatatttgttgttgtttttggtgactcatgcatagtaacttgtttccttgtgttattagtaatttttaaaatatttgagttcatatttctttgaatttaatctgtagtatatcaagtataaaactttttttggtcttttttttttgaatggaaagttttttcttgatcacaactgtaaattctggacaaaatataaaaaacagctatgtgtagccactggagagtgaccaaaagcagacagaaacctggggtgggggaggtgtctgtacttggaagaagagagtgagactaggtgggtttctgatttgtatggccttttttcctgagagcacctgcaaattggtgtcaaccaggtggtgaaaactcagataggaatgacagtgtgatggtggtaaagatctggacctgaacttgtctagtgagtcactttttctagcaccaatgattttctggctctttgcaggtgattgagaactggtagtagttaaggtcagctcagccaccactaaataattgatctcaactggtagagatgcctgtttatattctgagaaaagtactttgcagatgctttgactttcatgagaactgtaatggacaagctcagacaaaatgcttcacaaactgacttgcaataacactgggttcaaagaggttgaggaggcagggtcaagaggatcaagaaaaggaagttattttagatggagaaagagaagcccagaagaaaaagtcacgatgatttttctttggctggattaggactgtaagctttcaaaatatacgggcaaatcctctctgaaatcattgtcagatagatgtgtttctctttgaaaggctatgtgtaactcttttagttgtttttccccttagtttcaccagtactgatactctgaagataatcgcttcaca

SEQ ID NO: 11976 - DNA, 1055 bp, Homo sapiens
ttgttttgttttttagcttttcccttttctggtagttctcagaaagattctatttactagttgactcagaaacaacagtcatctgcttggaaatttcacaaggtaacttaaaattatttctttattttttatttatatataatagttgcacatattttgggagtacatgtgatattttgttacctgtatataatgtgtaatgatcagatttacagcctccaagtttctggtagtatgagtctagtttctcatgctgtaatgattgtgggaattggtctacagttgcccgaggtttttctggccagggaagttctcttgccaactatttcctcctaggaatgtttctcttttatgtctgatcagtcaggaagtggtagttggttctcatgttcatctctttttgaagaaggaggcataaaggaacagggaagaggcaggtccttaggctacagaacgaatcactgactgcattgtagtgtgaagatttcaaaggaaaaaaatgttttggctaactgatgttctgttctgtctaggagctcttactaactggattattttcagaggtctcctctagccatccacttgtagaatatgtaattaaatgttactttatggtttgctgagggtatgagccaaggacaaacagctatatcattattacatacttgctccatctttcctacctataatctttctttctgctatatcatcacttacctcattttgtcttctgcagtttgttttctttacctttaaaatatcaatggattcatttaacattttttttttttgcacttactatatgccagtcactgtgctgggtattgaggagataaagattaaaaatatactgtactgtccccaaggagctcattgtttattggagacatgtagttagaggtatcatacaataagataacagcttgaagtataatacaatacaataatagcatgtcaaatatggtgggatcataggagaccctaagcctctggaggatgggtgagtgtggggtttttagttaaacataagttcagtgtaagccaagataataata

SEQ ID NO: 11977 - DNA, 1043 bp, Homo sapiens
gctctgttgccagaggaaggacagtggatgatggataggcggagacaacacatgtacactgtggccaaataaaatcacccctttaccttcacgaagccacatttcctaagtccttacaagcaggatataaaaattggaagcctttaatgattttggtatttatactattcttatttccagttcattgttctggggctttattttaggactctttcaggtggcgtacacttcctgatggaaaggagaattatccgagtccttttacatgccacaaagcctcaaagctctggtctggtctaaacttcaccttgacatcagctaatgaaaaaaaggattctaaggaaatcaaggatgggggtaatggtgaggggtcaaagaggaaaggcagcagtttggtgtggctaaattatacctcagtaatgctgctacgagatttaaaaagggaggggagtttctgaaacaaacttcccaaataagcacattattcagaatcacagaactttgataaatgaatctcattcatgaaagcatatgtttatgaatatttctcacagtaaatttgtgaatattcccacttttagcttagatgcaagtagcttatcttgtgtctatgaataattgtggctctttatgtgtacacaacaagcatgaattaataattattgtgatagagatgaacacaaagcaaggtgttatataagcagggtttaaaattttcaaaatttaaaatgtaaaatttaaaagtaaggaattgttaatttagatctcagaaattagaaaatcttactgctaaaatgctttttattaaaaattccccagtaaaacaaatataatttattttatgctacaactaaatatgaattataattaataattaacataatatttgaaatgtgatctttatgtaacttttttgaaaagtcaaagtaagctttttgcattcttaaaagtcagtatcttcaaccatttttgtttcttctgttttaagtatttaaaactcaggtccatgttgtactattgaagacgttggttggttatgacat

SEQ ID NO: 11978 - DNA, 1051 bp, Homo sapiens
aagtgtttttgttctctgatgaaactctaaaagtttagagttaagtttctgatttgcagaacataaatacatctacacaatacatagactagagaataaatgggaataaacttattaatcttatttgtaatttgaaattcagtgttattttgttcctatctttaaaaatcagaattgtgcaatttcttctgaagatcacatcatttcctaccttttaaattttaatttaagtatcttctttttttttatattttacagctaattcctgaatcattgcattattattatgaaggaaaagggaaacttgtatttaattcattaatttctgttacctggttttagattgagatttttgattagtccctaggtttattttatgagattagccatcttttataaaggttgatatgcaaagttagtttaattattagaccattagacttctaaaaatttgaactttacatttcattatttgtccctctaaaagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaaggtaaggtacagctgtggtaactaggtttataaaaagttttccaggccgggtgtggtggcttacccctgtaatcccagcactttgggaggctgaggcaagcagatcacctgaggtcaggaattcaagaccagcctggccagcatggtgaaaccccacctctaataaaaatacaaaattaggcgggcatggtgacacacacctgtaatcccagctacttgggaggctgaggctagagagtcgcttgcacctgggaggcggaggttgcagtgagccaagatcgcaccattgcacttcagcctgggcgacagagcaagactctgtttcagaaaaaaaaaaaattttccaatgaagctctgttttgtacagtgttatttaatattgttgtgtatgtgaggaagagttcttaagtatttgtgggtgttgt

SEQ ID NO: 11979 - DNA, 1072 bp, Homo sapiens
ggagttgtcatcaagcaggatgggaaagagtatggaggcgttctgggaggtttggagtttggctttggacatcttaagcataaaatttctctttgacagtcacagctgcatgaatccggggtgagaggtctatgctggaactgtgaatttaggagccatcaagcatagaggtggtatttagtcatgagactgggtgagatcaccagtgagtagagacactgcacagaataggtataaggactaagcccagtggctctctaatgttaagaggtcagcgagaagaaacaaaggagactgaggagcagccagagaggttaaaggaaaaagtgtctcctcaaattccaattagaaattatcatcttcatcagtattttactaaaaaatgttctcctatttcactctgacaatgaaaaaaggtagtgaccaccaaaattatggatctacgattgtccatttttcattgaagcaattttttttttttttttgagatggagtttcactattattgcccaggctggagtgcaatggtgagatctcggctcactgcaacctctgcttcccaggttcaagcgattctcctgcctcggcctcccaagtagctgagattacaggcacccaccaccatccctggctaactttttgtatttttagtagagacagggtttaccatgttggctaggctggtcttgaactcctgacctcaactgatccacctgtttcggcctcccaaagtgctgggattacagggaagcaatttatttctataaaattttagaagtcaccttgatattaaagaatataaaattagagcagaaattgtgaggttataaattggtttttaagaactttcttatataaaataaaaatatagttgatagatgaaaaacaatagatgtcttagtttcctagggttactctaacaaattaccacaggctgggtgaatgaaaacaacagaaatttatttcctcacagttctggaggccagaagtctgaaatcaagcaggcttggtcctttctggagcccgtgaagaacccattccatgcctctcttgcagcttctggtggtggcta

SEQ ID NO: 11980 - DNA, 2253 bp, Homo sapiens
ccttatgtgggaagcaatgagcttattctctgaaagggtccgttcttcacatgcatgcatcgtaactattttcaatacttagatttcttgaaagccttttacaagaaagccacatatgtattttgtgaaggttaatatagttaaactagagaatagaatctataagttcacctcaatggcatattgctgttggcttcagagaatatggagtctcaaggtccagtcctgtagcctagggactcccagtcttccactctgacctggatatgtaggtcttgaggtatggggccatttacagatggactgaatggtggtgccagtgtcagtattaaacagcagtcagcctattcttgctttttaaacttaatttataaagaggagttctcatatatttgttctgggtcggcctaagttgtgcagcattttagagtccagcagcaggagaagggtttgggaagagcagatagttggttggttcctctttcctgatacatgaggaaatcacatgtcacagtgtgcagtggcatgacaggacatgctttgacggtaaaaatctgttaagtggactcactgtttacattgggttcatggcttaactttgaatgccttttacttgtattttttattttgcagtatgaaatcatgaagtcagcaatgtagagctaacaggtgatttagagcttggagatataattcaatgtcattttgagggttaggaaactgaggctcaagttcacagagctagtgaatggaagagcttggactattccagtgtcttctaaatgattttgttaataagtgcagagcgttgacctgcttggttcctcccacccaccttctagaacacatccttcaaagaagattgtattgacagttaaatgaagaaaattagaattcatttctagttgccaacatattccctggttgttactttaaggctttgatgtatatctgtgttcagatgttccaagaaaccaactctaacttggtaaagctgttgtttactcttagtttctttttgctttttcaggaaacctaaagatttttcatgatgatggtgtattctgggtcactttctcttgcatagctatcctcattccagtagttttcatgggctgcctaagaatagtaagtgtttcatcaaaagttagatttattgattatgttatcctgtgtgttcagctgatcacttatttcatcattttgcatgttttattcactggggagggctgtgttacctgtatcagatgactgattctaaatagccttgttactgtgaaaacgaagttctatttatgattaccacatggtgtttgtttttttcttttttttccaccaaatggagcatcacagtcaatatgcttttaacagtgggagcagagaaggtagtgcttactctagtacaccaacctgatgggtcattagtttcaactggcttcagaagagtgattcttcctctaattagattttattgttgaagttccttcatatggaagatattttccatagtatttggataagctgaactgtgttttaagaactcatatggatgttgaaggttgttttcagtttatctttccagggaacttctgttcagctctgagtgggtctggtcctttttcatgcctgagggagcagatgtgattgcctgtgattgaagccagtggagagttataaactatttttgttctaacatggatgatgcctaaactcttccactcttccacagctgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatggtaagactcttaaatccaaaaaccagtgtgacagcacagtaggagtcttgacccacctatgctaaccagagcacttggaaactaaatttaaagaaagtcaactgggacaaaaggagggaacacagcatacaatgctgtgagaaccctctgttatgataactcaggatcatgggagtaaagcatttaaaattttaagatgaagataaaaatctactaaatgaatttcattaagaaatttccaagattatttaggtttacctggtcattctcagaggggagaaaaatactgacagtaaagatgtttgagacttatgggtggggatggaataagggatgagaatgacaacctgatttaatgtta

SEQ ID NO: 11981 - DNA, 1068 bp, Homo sapiens
gtcagttcacttagcttttttgatgaaggttcgttctataaatattaatacaaagtatcaaattggatgtattatccactaaattttcattattttttaggaagagtgtcttccaaagtgttcttcactctttttgccctgcttggtttcttcatttgtttctttggacacagattctggaaaacaggtattatgtccaatgtagttgctatttccattttgcagtcttttcagtgttgctggggaatgacctgtgaggagagtaagcacttacttatctctactatcttcatagatttgtagctggggtcttgtagtcgtgagtctactgagttgcaatgcatttttatttttttctattctccctacagcggagtataaccttctcttattaacaggggaatacaattatgcagtgaattttatcagctgctagatctgttagttgactaaagataaccgagattagacattggttgtcagggccgggctcagtggctcatgcctgtaatcccagcactttgggaagctgaggtgagaggactgtgtgaggccaggagtttgaaacaagtctaggcaacatagtgagatcccttctctaccaaaaaattaaagacaaattggggctgtgtgtggtggctcacacctgtaatcccagcactttgggaggctgaggcaggcagactgcttgagctcaggagtttgagaccaacctgggtaactcggtgagaccctgtttctccaaaaaatacaaaaaattagccaggcttgatggtgtgtgcctgtagtcccagctacatggggaggctgaggtgggaggattgcttgagcccgggaggcagaggttgcagtgagccaagattgtgccactgcactccagcctggatgacagagtaagatcctgtctcaagaaaaaaaaaaaagaagttggttgtctttgtaaaaatatgtgtggatattggtgatggcgattgacttggtttcacatgaatcaggctatggggctgcagtgtacagtgagtttgaaatgtctgctcagtcctgagagattcagatgccaaagggaat

SEQ ID NO: 11982 - DNA, 1137 bp, Homo sapiens
ggaggggttgttgttgctgtctcaggggtggcagaggtggaaggggaggtaggagaggcaggcacactcagtgtgacttttactgaaaaaaagtctgtatgtaagtggacccatgcagttcaaacccgtgttgttcaggggccgactgtgtatgtatagatacgtacacacacacacacacacacacacacacacacacacaattttcttctctgaaccatatgagagtaagttgcagacataaagacctttttgccattaaatacttctgtatttatttccttacataaccatagtaaaattatcaaaattacgaagctaacactgatacagtagttatttaattcacacgttagcacatttactagttgttccaatagtgtcctttataagtaaaaaaaaattatttttggctgggtgcagtgtctcacgcctgtaatcccagcacattgggaggtcaagatgggcggattgcttgagctccagagttcaagaccagcctgggcaacatggcgaaactccgtctctacaaaaaatacaaaaattagctgggtgcggtggcacatgcctgtcgttccagctacttggtagtctaaggtgggaagatcacctgagcccaggaaggttgaggctgcagtgagccgtgattgtgcttctgcactccagcctgggcaacagagtgagaccccgtctccccgtcaacaaatttttttttcccctgtccagggttcagtttaggatcccacattgcatttaaccgatgtgtctctttatagttgtataatctggaacaagtctttttttttttttttaattttaatcttttaagaccttgacttttttgagaagtacagaatatttattttttttagaatgtcttcaatttgggttactttgatatttcctcataattaaattttgattatgcttttttggcaggaatacaaaggaagtgatgtgtccttctcaggagacacttgtctctttatttatttgtctctttactggtggtgacatccttgatgacttggttattggtgtcttgccaagtttctccactgaagtaactgttcctttttttaagtgtctttaggggaggtacttcgagtgtcagtaaatatcccattctcaaactct

SEQ ID NO: 11983 - DNA, 1032 bp, Homo sapiens
atagatttccagaaagatgagaaggtaaacttagcttagactgggcaaggaggaatatagactttcataaaacaaagccaaagtactctggactaaaaaaatactgaacttcagaactaacagaaggatacaaactgaaaggccagagtcagaagagaagggcaaaagtccacaggcagtagcagacatgaaaattagctgtcggcaggtgagctgctcttctatacacctctctatgggtaggaacttgaaatatccactatctgtctcctggcagttaaagcatcttcagaagtacagtcaagatatctgtcaatatcatgtgttttacatgtcaaacggaagcaaactagcatgttacagcttaaacttcttaaaacatatgtgaaaagtgtaggcagattctactttttaaaaatattgttttgtgagttaacggtatttttatcaaaataataaatgtacttaaaaacaaatatgaaaaaatagtagttcctactgcaccattcaccagtccccaaaagcatattgtaatagtcaactcttcattttttatctatttcttttagcatatttctcaataatatgcttacattgctatttttgatttactggttttaaaaatgtattgacttcctttgatggagaataaagctcatccccaatttcatttttcaatagagctcacaacttggggtaaatcaatagtattattataaatatgtaattattgtttactattgtgataaatgacttatgattatgattttgggtttcttctgtttgctttacatctctttatttttcctagagttaaccactgccttattttttcatctgtttgattttcttttttttttttttttttgagacagggtctcagcctgtcacccagactggagtgcagtggtgcaatcatggctcactgcagccctgatctcctgggctcaagcaagcctcctgcctcagcatcccaagaagctgggactacaggtgcgcaccaccacacctggctaatttttgcatttttgg

SEQ ID NO: 11984 - DNA, 1034 bp, Homo sapiens
tgaaatatttacaaatgagcctaacgtttagttgttagagaaaaatctaggctgctatacaaactgtcctaggctttctggatggataaatgtctatattttaaagaggtgccttcaaattatttaatcaattataggaagaaagtaaaacaattatgtccacgtaagcacttggactgttttgcaaccagctattgtatttcagtccactgacaggaacaatttttcactttctataaggagtacagaaaatctgattatagaatggaggaaaggaacaaataggaaatcagaaagattaatagagataagagccaaagagtcaattgttaaaacatgtagcaggaacttagtaatgagaagaattagagaagttaggaggacaaaaatatgggtaccattctttaaagagtaatagattcctcagatataccaagatcaaaaagatacagaaaggttgaaaaactattatagattaaagaagcttaaaaagacatggcaagtaatgctatatgtgattctggactgcattctgtatggtaagaaaaaaatactgcaaaagacactatttgaacaattaaatttggaatatggattgttgattaaatacaagtttgatattaatgttaattttccagaacctgataactatactgtagttatatatattcatgttcttacataccgaaatatttaggcataaagggtcaagatagctccaacttgctttcaaataactcagaataaaaataggaataggtatacatatatatccatatataaatttattttcctatatatgtaaatatttttctccataggaaaaaatattcattttatcagtgaataaaggatatatatcagttccttgtgctagtcttccaatttttaaaatgatttttaaactataacaacatataaagttaccaagagttaacacagagtggaggaactaagcagtttcttaaacaaacagcctactgtattcttaaacactcctgactaccctgacatcaaagtcctcatccacccat

SEQ ID NO: 11985 - DNA, 1035 bp, Homo sapiens
aacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaacatacggaaaactagtctagactttaaagaattgtgatcaggtcacattgttaataaaaaaaaaaaacgggctagtccctatgttatagccatattaatgttaagccatattgacaagaccagttatccaataatttggtcttaaaaagtaactacttttctttgaactctggttattgacttatctaactgttgaagatagagtcttagaagactaaggtaaattctcacaggggcagatatgtaggtgttatgtaactagggtgtcattcacaaatggtatagtagaatcttatacacggaaaagaaagcacatttttttaaaaaagatgccaagttttttaatctaatcattatattattggtgtattttgggcaacatagggtgagttataaaaagatccgctactgatagtgaaaattaccggtttgtaaaacattaagagaaaaaataggatattttatacatgtggtgagtggagaacagggtaactttaaatgaaagtgtaaggcaaattgtaagcaccacaagatatatcagatttgagaggtgccatgttaaacattgtccattaaactataaaactgtattatgaagtatttgcattcagggtgtcctgaatatgattgattctgtattagattgtgttctaactttcttactatttaaggattggttctaaatcttcacattataaaagattaaaaacagtgagagggagctatcacacaggtactattaaaagctgtatttggaatatgtgtaccaatatcagttttccttttgtagtactgaatggcagtagaagaat

SEQ ID NO: 11986 - DNA, 1049 bp, Homo sapiens
ccccaccaattttcagaacaacttttcctccactgaaagtcattcaggctagattcttgtctgatagggtagaaaatatcccagaaaagaaacaggtaaattctgaatatccatcctccctatgcagagttttaacaagtgtcagataactacagtcatctgtactagggtgatttaatttgatttttaaatttaattttttgaagaagatgctcacttatgctgttacttcataaaatgaatacacctgttaacaaaaaaaaaaagaaggaaatattatttaaaacagctctctgttcctctcagagtaaaatcctgggtggtgagagagatcattgaagtaaaatgtataggttgagcatcccttatctgaaaatctgaaattcaaaatgctccaaatttggagcattcaaaatactccaaatttgagcattgtcaacacgatgctcaaaggaaatgcttaagagtgtttcagatttcaggttagggaggcctccctggcaaataaaatgtacatattctaaaatctaaaatttgaaacttctgatcccaagcattttggataagggatattcaacgtgtagtattgtaatttggttattcagaaaaactttgttgtttgtttgaaaataatagtaggaacactgttagactgacaatatgattggagctagtaataatttatgacagtagactttctttttagtagtaagcttgaggtaatacacttgactgtgaacacagaagaatttacgagaccaaactaccaatcattccagtgcatcaggaaatgctttattgagcaaggttttagtatactttatgttgaatgtcagttaatacatttccctaatcattgtattgccttttttaaagtgcctggtgttttgctaggtaacacatagaacaaattaaacaatgtttagacctactagggcatattctgaaacttgacaatggtaacagacagttaattggttataaagaaagaaggctcctttatggagagtttctattttcagttttttagttaattgctagaattagta

SEQ ID NO: 11987 - DNA, 1034 bp, Homo sapiens
ttattccaaactatacagtataaatatgagttgttattttacataggcctgttatactaattttctagatagatgatgcataagtttttaatcttctgcttgcacatctagaaagtacttattttatcattatggtgggatggtaaagtattatgagattcacatttgctttctttttgtgagtacctatgtttataacttttttccaagttacatgtatgtatttttcttttagagtagttaggctcacagcaaaattgagcagaaagtagtgttcctatatacccgtcccgctacaggttcccccattatcaacaacttgcatcagattggatatagttgttataatcagtgaacctatgttgacacatcatcatcaccatagtttacattagagttcgttcttggtgttgaacgtacattctgtgagttctgacaaatgtataaggacatgtatctaccatactgccatacagaatgatttcactgctgtaaaaattatctgtgctctgcctgtttattcttcccttcccactgtgtataacatttgtacttaccaagtttgaactttactacagatgatttggaatattagttatttgaagaaatagaattaaaagagataaaataggactacatctaatgacacaaagttattgctgaaaattgtaggagttaacatggctcaatggtagaagtattgtagagagaaaaatttttgtagtgaaaatcagttacttgtggtatgagtttatactgagtaatgtaccatttcaagtccatcaagtccattgtgtagccccttatttgtcctactctttgtatctacaatatttcattcagtgtctgacaaagataagaattttgttaattgtgcatgtatgcatgaaagatgaattgagatacttaagtgagtagaagccctactttggtggtcctgatggcacatccattactgatggaatcaaacaagcttatggagctcagctattagacctcttagccaccctgcctcatttgctttcaaggaaatg

SEQ ID NO: 11988 - DNA, 1035 bp, Homo sapiens
tcatgattagatgcaatatttttattttaaaaatcagttttatgttttgagtatcctaaagatgcatatattaatattttagttaactttattgatcttcttattttaaaagcagtgcaagaaaaggtaagtctcatctcttgatcagaatcctagttttgaacctaagaaatgcctccattctgaaattttaatagacttttataattacttttatataatgttttgttattacttttctaagggataacaatagaaaacaatacaggaagttggccaacccaagacaaacgtagcattccagctgttgaccaatttcgaatggaaaattcggacagaaatacaaatgtgctgccagccatgcttggagagcctaggttggttggtagctgtgctgcatctgcaatgtcatggccctggctagttagtctgcagcacccagacaacattattatagaggctccctggccacaaaacagtgggtcctggcagcagtgcattctaactttaggtctgtgcctgtgcctgtggtgcagggtctctgagactgcttgttcaagggctcacaatgggtgtacccatctgctctccctatgtcacaagaaacattaaagtttatgctcccgctgatatagtcttcaccttgcaaatcaatgaacatattaggtgaatgaaactttctgtccttcaacaatacacataccactaatagtttttcattttaaaagctgcttttggccgggcgcggtggctcacgcctgtaatcccagcactttgggaggccgaggcgggtggatcatgaggtcaggagatcgagaccatcctggctaacaaggtgaaacccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaa

SEQ ID NO: 11989 - DNA, 1035 bp, Homo sapiens
gagctgggcacccctaattctttatggaagtgtttaaaactattttaattttattacaagtattactagagtggtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatatatatttatatttaagaaataggaaaggcaaagttgaactcacaatttgacatttatttttagtgttatttatttcataacttataaaatatttaatatatacatacacactcttcttttttctctgtacaaagtggttttaatatcagctttcaaaactgatcttataaaatgtaaatctaaattgtaaaatagttaagttttaacagtccctcccaaactttgtgttgattattcacttgctaaagagatgtgaggaatcagccttcagttttttggcagtagtatattttggaagtgaagaaattggaacacctgtttctaatttggtcttcatcattagagacaaaaccaaaacactccaggcagtactgtttatagtgctgagccaggtagcacacagacatagtagcctaaaggctcacataattcgcatgctcaggccagggcagggtaaaaatagccttctgcttctttcaacccagtatcaggaagcactaccccagtgttattatttgttttgtcaaggtaagtctaaataaacaagaaaaact

SEQ ID NO: 11990 - DNA, 1111 bp, Homo sapiens
gttttgctgcaaaatattaggagatttttatttttgttatgatggataacacaggagctaagacttggatatgcaatcaaggatattcacaatacagcccctatgagagagaaaactgcctcttttcattgcagtattaccccagagttctactctgcccaaccccatcctgccacatttcctggtatccaggagtatctttcatggggcaaattaaccagccagtgccacctttctcttttggtcagattgtcccagggaagtcttctttatcctgtctttttagctttcagcatcctattatatttagcctcctctgcaggatcaattgatccatgctaagcagaatcacctgagaggcttagaatcctaatgattcctgggccccaccaagacctgctgaatcttatcagtcctggcattctgcactttaccaaacacctggagagttttacgcaccagaatttcagaagtgttgatttaagagagaagtaaagacaaaatattttagatcacggaggattattatcagtcgtcagctggtgatgctgtttagcagttaaggaaattccagatgctgcagggcaataatattgccaaattctggagcagttttacgcttacctgcactttttacctatgcagggatccccaagagttccatcagtgccggttgaaccctctaccagaagctctgagagtccttgttgttcttggtgtctttagtatcacatgagttcttaaagggattcagagttttctgtgactccaaaatcaaagtgtgtctgtgcctgattggacaggatatatactgatgttcgattttatctatttttcaccaattatgggctagttaactctggcctttcaatataactcagagaaatgacccatggacttggtcagttcagagaagaaaagttattttaatatttttcccctttgaaattgacttgtcaattcggtctaaatggctaaattaatacaatgctatgaatttaggtatgataattattagattaaaaatctattgtggggccaggtgaggtggctcatgcctgtaatcccagtactttgggaggccgaggcaggcggatcacgaggtcaagag

SEQ ID NO: 11991 - DNA, 1032 bp, Homo sapiens
gctctagcccttctgcccctaaccaccgcactctactgcctccttgtggcccacctgaaaactgggctacagcctgcagcatcactgcccagtagaaatgagagccatacatgtaatttacatttttttaggtagccagattttaaaacattttaaaaagtgaaattatttttaataatatttatttaaccctaatgtattcaaattattttagcatgtgattaatattaaaacataatttttaaaatttaatgtgagaaattgaaaatattactgagatggtgtgcattcttttttttttaaatgaaatatttggaatgcaatgtgtgctttacacttacagcacatctcaggacagccatatttcaagtgttcagtagccacatgtaatttgtggctactatattgtacaacacagatgtttattaataaccttgacttcgaaagaaatatgagtctttgtccaggccagaagctctaaataagacgtgactctatcagagcatccaaggcaatcttatagcaactcatttgaattcttggaattatatgacagacggcttcagacccattcatagcagcagacttcactgagtgttatccaaatatatctggccccttttatgaccatttcactggactttgcagctaatatgtcatgatgctgtgcagcacatttacagtgtgagaggttgataagaagcagctttccatgccagcattcttaatttatattaattcttgttggctttggttagaatttaaaatgtcaaaaaaaaaaaaaaaagaagaaagaaaataggcaagattagcatgaactttttatggatgaacagagcggaagtccctgatggctcaacagaatataatagaatatttaaattcaggatatgggaaaaatatttctgtgaatgctctgttaaaatagctgttggtgtttattactgaaatggaatataaaaagaacttcttgaagaaccatgtcatacctcccttattgccaaaactaccttttgttcacataatagaata

SEQ ID NO: 11992 - DNA, 1035 bp, Homo sapiens
acttttcaggttgtatccacgccatgcaagtgcgctcaacaaccttggaacactgacgagagacacagcagaggcaaagatgtactatcagagggctctccagctccatccacagcataaccgggctcttttcaatctggggaatctcctcaagtaagtgggacgtttaccatcgatcaggtggccttgcgattccaagaaactctttccttctcaacactcatttgattgtgctgcacttgcctctctctggagctgaataattagggttttcagactttgggagggtgtaacatgcatctcaatttcttttccttatcagtcaaaagctgtatttcccagagtgtctttctggaaatagtagttctggaagattttcatagattgtctctaaagaagtaagaatggaaaagtgttacatggtcagataaattgagaacatgctgagctaagcagattgtttatttatggcaagaagctttaatatgctaatattctttgtgaatcttcaagaagggactgtgggatagtcatttttgtcttttctttgtgtgtgtgtggagggaaggcatttccaaagacaaatattccataatatactttgggaaaagcagcattctctgaaggtatagacaaatggttaaccatacttctacccagtttgtgttgtaggtgagaaataaagtggtgcttgctggaattagtagtcggaattagtagtgatgactttggtgcttaggaataattctcagacataacctctagtgtttgctttttacttgctgccctgataaaggttgatagtgtgattaaagttactgaagactacagtaaagggtgcttttgcatcttgtgtgtttattaatatagtctaagcatgttggtgatggtccagacaatgatagtagtaacggtggtggtagttatggaatttagcttctaaacttaaaaaaaaaaggttaacaaatatcagaaatggaaatttaaaaggtaaaaatgaccagaattggagcgtaataatatgtttatctgtgc

SEQ ID NO: 11993 - DNA, 1040 bp, Homo sapiens
gcataaaagtattatgttcagtagcatgattgtaattaacttcttttgttcgttcttttttcttcaatttaaaaatggaagcaatctcaagaaaatttgtccttgggaaaagaacaatgatttaaaaactagaaaagacattcaaatgtgtgtgattacataatgccacttagctctgaatgtttgaactgtgctgaagcttgtctgttctcttgtcttattccaatgtcattgttccaaggccacttttcttttcagatgcttgaaaatgtcactgaatcaggaaaccaagtcttggttctgccatttattggttgactgaccttgaacaagacacaaagctttttttgcccccagattttctcatttttacaatagagattttagtaaactcgctaaaattaacactttggactatgatactgccttttaggaaagttcattcttcttctataagtatgaactttcctaaaaggcagtatcataaaccaaaatgttaggaggaaatgagtgttttttatttatgatattgtactagaaattttaaaacacttataattagaagtgaatttcataatctttgattccttcaaaccaaatacctaatagctttcttaacactttgcagcatgtggttttgacttggttaaggggaaagcagcccttaattgtttactgtgtcttcagcccaatttgggaaggagatgagtgcttgataaatactattcaataaggacagaaatacaacacaattctttatattctacgtggtttaaggtaagagtcttgtgaaggcttgccaataatagggaatacacctgtagtatagaagaccaaaaagtggcatcaatctgtgttctaaatatgtttttgcttagaccagttgaatatatcttagcttttctttgtagtactgatgattccaatggaatcattcttcatttgatagatattcatagagcccctctgccataaatgctctactaaaatctagtgctacacaagtaagtgaatctcagtgtctgccctcaaagagttaa

SEQ ID NO: 11994 - DNA, 1046 bp, Homo sapiens
gactactaaaaataatgctactgtacatatttgtgtacaagtttctttgtggatatatgttttcatttctctatagcatataactaggagtggattgctgagtcataaagtaattaagttttcaactttttgaagcactgacaaacttccgtagtggctgtaccatgttgcattccctccagcaatgtacaagagctcctatttctctacatcccaaccaacacttgttatttatcttttgttattttaattaaagctatcctactgagtctgaagaggtgacttattgtggttgtgatttgcatttccttaatgatcaatgaagttgagcatcctttcatatgtttattggccatccttatatcttctctggagaaatgtctatttaggtctttgcccattttttaattggattgtcttttttgttgttgagttgtaaagaattatttatatattcaggatattaaacccctaaaagatatttgatttgcaaatactgtctctcattccgtaggttggccttttacattcctgataatgtcctttgatgcacaaaagtttttattttttattttttattttttttgagatggagtttcgctcttgttacctaggctggagtgcaatggcgcaatctcggctcactgcaactccgcctcccgggctcaagcaattctcctgcctcagcctcccgagtagctgagattacaggcacccaccaccacgcccagctaattttttgtatttttagtagagatgtggtttcactgtgttggccaggctggtctcgaactccagacctcaagtgatccacctgccatggcctcccaaagtgctgggattacaggcatgagccaccatgcctgaccaaaagtttttaatttttgtgaagtccaatttagctatgtttttctttttctatcatgctcttattgtcaaatctaaaaatacatggccaaatccaaggtcatgaagatttatgactgttttcttctaagagttttgtggttttagctcttatatttaggtcattgattcatttttga

SEQ ID NO: 11995 - DNA, 1082 bp, Homo sapiens
tgcacaagcaaaattaaaagccctgggagacttacttgctgcaagtttgaatccattcttcaatgcgtgcacgagttgagcagcagagattggaaaattcactggcttgagttatccatgtataacctctgcccaaatcattggctgatcacaaagccatgttggcacaagagaaatccccagaaatccaggcaaaagaaaaaagaactgagtaataatttcagcattctgcagagaaacagattttccagtttgagtctatggaaactcatcaaatgtattcaaacaggaaaatcaacaatttcagaagaacaaaatagaatccagggtccctacaatgtgtggcatgcaacacccagtttaaccaacgattactagatatacgaagaaacaggagtgtgtgatcaaactcagttttttaaaaagtgtcaataggaaatggaatagaattgagaattcagggctaaatccacactaatgggatcaactgttttttgacatagttgtcaaagtaattcaatggagaaaggatggtcttttaaaaatgtaactgaatatctgtaaggaaaaaatatgaatcttaacccttaccttatacagtatacagaaattaattccaagtggatcatagtcctaaaaataaaagcaaattacaccaaaatttctaaaagaaaaggagaaaatctttgtgaatttgacttaagcaaatatttcttagaacacaatgtgaaaactgtaaaagaaaaagttgataaattggacatcatcaaaattaaatatttttttcatcaaaagataatgtgaattaaatgaagaggcaagccacaaattgggagaaaatatttgtaaaacataaatctacaaaggccttgtatctgaatattaaaagtgctcttaaaactcaagattaacaaggcaaaaactaaaatggagaaaagatccaagtagaccctgcacagaagaagatatgcaaagtttttaattaataaatacatgaaaagatgctcagcatcattagtcattagagaacttcaaattaaatccacaaagagataccattatactctcactataatgactat

SEQ ID NO: 11996 - DNA, 1052 bp, Homo sapiens
tccttggaagtaacttgaattcagagtttaaaatttctggaaggaaaatttatcatagccttagaatggggtattgaaggtcagtctgagtttctgagtagatagaactgaaatatgcatcattgttttcttagaatagtgagctcctttccttcagaatctttatttgaatatcaaaggagacatcaaaggttgttcgactcctccatggaatgcctttgcctattaaggtttagacgaggcacttcatgggttcaaggaaagtacattaaagagagaacccataaacacttaagtttcctttattgttaagtgtcaaaagacacttaaaattcttttgttgtttttgttaagcttttgctttttttctgatgtgagctgtgtctttgctatattctgatcaactgagaaatcttttttcttgagtttcaaagagaagcagtaaatctgcatttctgttgaaaaagctctgattccaaaacatttttttgatctgaatatgtgactctttactaatttcctttttgcgttgaaagagcaaaggaagttaagtcaattaagattgatgttctagaagaaatttcatatatcactgtttatgatttgttgctataatgttaaacagttacaattcattgtatctgagatgtttgctacctggagctgacatttaggcaaaaattatcaggtgtttatagattctgagaacagctggaaagactaatttcatatcttcattgaaatcattagtattccgggtaagggaaatggcactattaccatttccagtggaaagtggtttttctcttccaacttgctgccacattccaaactgtgagcacttttattttgtaccctgatctaccacgagagggtaaggaaaacacagaaaaagaaaaggggtaggccgggtgtggtggctcacacctgtaatcccagcactttgggaggcagaggcgggtggatcacgaggtcaggagatcgagaccatcctggctaacacagtgaaaccccgtctctactaaaaatacaacaacaacaacaaaaaaaaa

SEQ ID NO: 11997 - DNA, 1081 bp, Homo sapiens
gtttaaataccacagtcctttgaaacaagaaagaagggtgtggggaagccaggtaatggggaggtgacctggacaagcagtgtaagcaaggataagatttgctgtgcagatttcagtgggtgccctctccactgatgcgtctccagtgactgagtcctccttttcctggtatagatggggagacacacttacaaatggagagttcctctgtggatgtaaatttctcttaccaaagagtgatttgtattctgttttcagagcttttcctgtatctgcagtttctcaaaataatcagctcaaaataatccttatgccaaggcagcttattttggagtagcatattctagtctcttacactagaaactgatgactagagaagagttccccaagtttgaccgatgggccacctgtgcacccgggatttgaatggtggtattacaccacggtggtgatagagtcagcccctccagtagcatcctcccctacaaggtgctgtcatctgtgtttggcctctgctctgaactcccatcagcctggtgctcatgccttctgaggctgctcattcttctggggtgaggactcttcttccatcagtagacctgtaggtatttatcggcagcattttgtcctcctgaataatttgttttccaggataaacaccctcacattttctagcttttcttcatataacatataaatagttttaagttttcttattattctggttcttttcgttagatatgctgcaatcaaaagatgtctctaaaagtgagaggcccagagttgaattctcctggaagtggagtagaaccagcaccttcctccttatagactgtggatccattcatctagcctagtgtcaagtcttgtataacagacaggtcattcttggatcataacacatgtgctgtcagcacactcttcaaggtgttatattcctttttggcttcattttcctccacttttgccctctacctatggagttataaagtcttaaattagaatatcaaaaaaaattgtccaattaaatttcagtgtattagattaggcctctaatacactcacaaggaaattagagtat

SEQ ID NO: 11998 - DNA, 1073 bp, Homo sapiens
ttgttttttgagacggagtcttgctctgttgcccaggctggagtctggagtgcagtggctcgatctcggctcactgcaagctccacctcccaggttcacgccattctcctgcctcagcctcccaagtagctgagactacaggtgcccgccaccacacccggctaagtttttgtatttttagtagagacggggtttcactgtgttagccaggatggtctcgatctcctgacctcgtgatctgcctgcctcggcttcccaaagtgctgggattacaggcgtgagcccctgtgcccggccagctcttggaattttatattattctttttccattttgaactaacgtttttattccatttggcttgtagaattttattttaattttatacaattttatgttttcattagtcactgtattatatttctttgcaataaaaaaatctataaataaattagtatgatttttaaatttcccatatccttaggctctaaatattaaaatttcttctgtattaattatgaatatttttaataaacaatttattaaaacagtattaatgttattttttaatctttgagacagcatagtgtagtagttaaaagcacatactctggagcctgagtaaatggtttcaaatctcacctctaactctagttgctctagacttttcgttgccttatctgtaaaatggaagttcaaaataatgctagtctctgggtgtagtggctcatacccgtaatctcaaagctttgggaacctgaggcaggtggatcccttgaagccagcagttcaagaccagcctgggaaacatagcaatattctatctcaacaaaacaatctttaaaaattagccagttgtagtggtatgcacctgtgctcttagctactggggaggctaaggcaggaggttggtctgagcctaggatttcgaggctgcaggaagttataatcttgccactggactccattctgggtgacagagtgagaccctgtttctaaaataataataataataataataataataataataataataataatactgagtttggctgtgtcccaatccaaatct

SEQ ID NO: 11999 - DNA, 2036 bp, Homo sapiens
caaccagtttaatttttttctctttctcttttttaatgtaacctactgatagattgtggagggattgtaataaaagctgtatcagttcatcttaacattgtaaacactcaggggatatataaataattttttcatgagaacattattctatgctaggtaatatatcattgtgatttcagataatttggtgggctttccaggttgttgcttggaaaattgtctggcacatgttttgatctggtactatgtattgtagactcaatatgacagaaccttaaaaatatacatgcttaaatgaaatttttttttttcaaaaattgaagaggtttggaaggacatttatcctcagaagaaaaccagaattttagaagtggaaatgatttgaaaattctcttaaaattcagaagcaagcatgatgattgtgattttcatcatgatcaacattatgagtaccactgtagcacttcccaatggccaggaaccatgcctcaaattttacaggtggcttacaattttgattcttgcgaaacgtatgaggttggcagtgtacattaccagtaaagaacatggactcctgccagagtgcctgggctccaattctgcccccactgcctaccaggcatatgatcttttacagattgcttacacgctctgtgtctcagtttccttgtgtgtaccacggcagaagtaatactaatacctatcccatgagattattgtgaaaaacaaatgaggtagtacatgaaacagcttatgatagctcttaattgtgggttttcataaatggtagtgctaggatttaactcccctctcccatgtttattttatgcgaaagccaatgtggaagaattactgtttagaaagcttttctttttacaccattcaccttttctttgctgtgttaatgaaggaaagttgtatagtctttgtttgactttatggtatgtggttacctcattttatgagcttacactattttagagggaaatagatgataagagaaaaacattcatgtagcaatgatggccagtccatcaaagtttaagaggataatagaatccttatgataacacttaattcttaactgatgaatgccatccttgttatgtctcaaaaggcatatttagagttattcttagtttctgagactaacagctgaccttttttaaattaaaaatttttgatgtattttgaatatcatcactttaataaacaaataattaggttgaaaagcaaataataaagacttaatttactagctttttagatagatgaccttatagtcatatggtaggatgtgtttcattttgtagatttgtgaatttttgatactatttatattattcaaaccatgatgtttataactttatatataagcttggaaatgcatattgactttgacgtcaccctaagctacagtcttcatgagcgacctgtcattaaagatttgcccttagtgatttaacctatataagtcttggtaaagtgtttaaaataaacataagtatagacttttaagagctgaaggcaattaatatatataatttggaaaaataaataaataatacaatcaaacccaaacagccagccagagttggatggaaggaataatgtttgtgtcttttgttaagagctagacatgctctaggtaactaatcaaaaaccaatatatttcagtgtttgagtgctagagcttctggttcctgacagtaaagtctttatcagagattttttttttcatagttttcatttggcttccttaagtaatttttccttgtgactatgaaaggagtgtgattttgtgaaaggaatgatgattcacactgcaattatgatggaaaaaagctttgattttaaaaagtggtctctttcattataaaacttcagtttggcttgtcatgcagtcagggagaggttgtgcatttatccccaatgtaatttgtttcttctttataactgccaaggttataaaggtaaaccattcagataagtcgaaattgggtgccgatctccagacttttctaagcaggaaatgt

SEQ ID NO: 12000 - DNA, 2051 bp, Homo sapiens
ttggatagacttgcacgtctcaggtttttgccatgcagaatcaatggatttatgcggataacagtgccttctgttgtacatgaattatcagaaaaaaatttttggagtgcattgcaattttttttaaagcataaaacatatttctagatacaacataaaccttggttatatgtcaactattctgcattttactctgtgaatttattgttaggcagttactgcaagtcactctggtttcaaaatcttcacggctccctctgctcaccctgctgctggggggcttttttcaggggttgtattataaaatatgcactggctgtggtttttcataagatgttttgtggctttttaaagaagtgtcttactccctcttctctcatttttttctgccttgaaaaggggtggtatttcttttggggtcaacaaatacacatatcagtttcactcctaaccttgtaagttcaggactcattttcttggcagcaagtggcaggggctctttagtcactggagttaacagtaagtctgagtatattctgaataatgtaattatgcaattaattgataatcatacctaaagcacattgaacttctaagagacaggtgctacgtaagcacactgtctttctggatggggacttgtattttaaataacttatcattccagctatgttggactagggtccaaagcattttataatatttttttttaatctaggaaaaagacccaaacaaatctaacttcttgctttctcacctatttgaattttctcctacctaatttgtttgtgtctttattatagctcagtttgacttctcaaacttttcaagggttggggcagctgcacttttaggttgcctataggaaatattgcatatggagattacagtgtttttctgacctagttcaagaccagaacatgggtcatagggtttttattcagcaaaatgaaaacgtatcttcagaacttaacatattactggatgtgatacagattttgctttctgtggaattgaaaattcacaaaaattcacagcttaaatttcccatcagtgactggaggaatttttttcaggtgcttcctatattaccatccctcatgcatattaactctttagaattttaggttaagtgatgtctatagaagtagcctggaaaaccatgagttttggagttcagtgaccccctgctttcctctgctcctcccttcccaaggcattgaagctgaatgtgccaactggcagttagaagcgaaagatggcattgggagaaattttagagagctttcaaactctttattctcatgttccacatggtctaattttaacataaataatatgccttcacactggattgtaaaaggcatgtgatttttgagattttattttgtgatgtattgtcttctgcagtattaaagggaaagagatattaatgtgcattaccctatcttgtttttgaagccagggtagttgtatgattttgttaccagcagtgctaacctgaatgtgacctggttaccttggaaatgcaggaacttatatgaatgtactataaaataaaatgcggactgattcccaggattctgaacttttgtgtgtgaaatgttttctgaaatgtggaggtgctttaagcagttgataataacccatcagtatgttttcctgacacctggtgacctgaagcaaggtggactgtaggtctgggagggtgaccagggcttatcaggaacagctaatacatggggagaagtaggaagtgaaagcccatctcatgaaccaggaggtccgcacagaagagtgttggagctctggaaaggcacagggcgttcaaccacagcaggacctcgaaggaaaggaagatgtcactaaaatggtgcaattttctgatgggtctactatcaaattattactggtcaaaactggactggtaatacggtaatggatatgttcttagaaatgcttcatgggcattttgttattgtgtgagcatcctagagtctgcttacacaaacctagatggtgtagcttactacgcacctaggctacgtggg

SEQ ID NO: 12001 - DNA, 1055 bp, Homo sapiens
ctaatatatgtgaataatatttgaagagtacttgaatataacatggtagatataaacagtgggatactattcagccttaaaaaggaaatcctgtcatttgtgacaacatgggtgaacctggagtacattatgctaagtgaaataagccaggcacagaaagacagataccacaagatctcaaactcatagaaagaacagaatttagttagcaggaagtggagggaggggagatgttggtcaaaatggtgaccatagttagtaaccatgtattatatacttgaaaattgctaagagtagattttaagtggtgtcaccacaaaaaggtatgtgaagtaatggatgccagatttagtcattccacaaaatacatatatttcaaaacggtgtataaatcatagatacaatttttatttgtcaattaaaaaataaatatttttaaaaagtacatctttcagtaaaaagaccagtggttgccagggcttggggatgggagagagggaaggatgaagaggtagagcacagaagttttatgcagtgaaactactctgtatgatacaataatgatgaatacgtcactatacatttgtcaaaacccttagaatgaacaatgcagagtgaaccttaatgtaaactgtggcctttaattaataataaaagaatttctgaaagttctgttttggcttatttcacttaacatagtgtgtccatctctgttgttacaaataataggattttcttttttttttaaggtggactggtactccatcatgtatatataccacattttctttatctgttcatctgtcagtggacacttaggtattttcatatcttggttattgtgaaacatgcttcagtgaacataggagggcacattatctcttcaagatcctgattttaattcctttggatatatacccagtactaggatgacttgatcatatgatagttctatctttaattttttgaggaaccttcatactgctttccacagtggctgtttttactctctcaccaagagtatacaacagtttcctttttctctacatcccctc

SEQ ID NO: 12002 - DNA, 1023 bp, Homo sapiens
atatttttcttttacgaaaatgatagcatgctatacacagtttttatttgccatttttaacttaatatatcttgatgatccttccatgtcaatcaataaagttatatatttttaatggttgcttaatattcccttgtatgatgtgtcaaatttatttcaccagtcccggtttagtggatataatttaactgtctcttgtttaaatgggcatttgattgctagtaatcacaaacattgctgaaatgaatgaatggccttttatgtgtcattttgcacacataatatgtgtgaagggtaaatcccttgaagtggaattgctggtttgcatcgtcatttgtatgggtaagtttgaaggatgttgccaacttgtccttcattgtgtataccatttacactccagaaatcaatatacaacagggtctttcttcccagccccataattgtgatcatttccagtcttaataggtgaaaattgttaatgttgcacttggaatttgtactcttaccatgtattataacgaacatctttttataaacacaggcaaagattataaaaaaagaaacacatttgttttctattgtatttcaatttttaaaaattcactaattttatgtaaggggaatttgatctttgtgataccatttgaaaatatttcactcatttttttttacttccccatgccccatgcaaaattctttaattttttagtcagatgatttcattcttttcatttcttatttctgggctttgagtcactttcccttttcaggattatacaataattctttttattctatttttttatggtttatttcttcacactgaaatcttttatctattaggaatttattttggtataaaatatatggtaaggaactaatataaattgttatggattttacccccatttctgtcagtctatttttcaaaattttctgattattcttgcatgtttagtttttcacatgaagtttagaattgtcaagttaccgtctcaaaaatgtcctcttgatatttttatt

SEQ ID NO: 12003 - DNA, 1023 bp, Homo sapiens
actggtcctcaactggaaaaagagaacaatgtaacccacctttctaattttcatctaaagaaggagaaattggctcttgtccatgacttttcatgacacctgattgtgatctgggagactttcctgatatttgattttattcaacaaaaatttgaggccctgatatttgtcagactctgtgctgggcgttagtgaatattggtgaacagtagatatagtccctgtcatcatagatgcagataaataaaaaatagccagggatggtggcttacgtctgtaaccctagccctttgggaggaggattgcttgagttcaggagttcaagaccagcctggacaacatagagagacctcatctctattaaaaaaaaaaaattagccaggcatggtggcatgtacctgtggttccagctattcaggaggctgaggtgggaggatcacttgagctcaagaggtcaaagctgcagtgaaccttgactgtgccactgcaccccagcctggatggcataatgatactctgtctcaaaaacaaacaaaaaacccaaaaatactttgataggggaagttcaaggtggcatgagcccatatgaccacccagtcctaccttgggagactggccaaagataaatctgagataatcatgtggtataattgtctgaagatgccctgtgaatcagttgcttttccctataccatgagaaactccagtgttttggagagctaggagtgccacctccgtcctcttttcttctctcaagcaggatcagagaatcctgtagttttggtaagtgttattgatgcagtctatactgaggtcttgcaaaaagccttactgagcctttcccatctgagaaaatgtgcttgcccatgcaaccttcaaccagtctatttctcattctgaaaattttatatcttcacttactatctttctgtccctagcagtagcacaaatcatatttattaagttgcttccacatcccctaggaagggattaattatgccacagtgaatctttttcatgagg

SEQ ID NO: 12004 - DNA, 1032 bp, Homo sapiens
tttagagacaaggtctcgctctctcacccagcctagagtgcagtggtgtgatcataattctctggaggcttataatcctgggctgaagggatcttcctgccttggcctcccaaaatgctgggattacaggtgtgagcagtcgccctggcctatttttctttatagtgaactaaaattctcttctccattcctctggaataaagaaaaattcttctaggctggagacatttaccatcctaattcttggctaagaaggattacaaatatggttagaagtatacttttatgatatttaaaattttctgtcttctgtctttactcagagttacccagtaacaatttagtttttcattcaggcctatatttttctaatatatggtattcttttcttctttttagattaaaaacgtgtaaaaaatgcctaccttgtgccaggcacttatgcagctccacttgatttttacaatagtctgggaagttgctataaatagtccaattttacagatcaggaatctgagactcagagcaaaagtaacttattcttttttttttttttttgagacggagtcttgccctgtcgcccaggctggagtgcagtggcacgatttcggctcactgcaagctccgcctcccgggttcacgcgattcttctgcctcagcctcccaagtagctgggattacatgcgcgacttattctttttaagaaaacttttattttaggtttaggggtatattatatgtgcaggtttgttataaagttaaactcatgtcatggggatttgttgtatagattattttgtcacccagttactaagccttgtacctaatagttattttttctaatcctatccctcctcttacctccaccctcaagtggctccagtgtgtattgttcccctcttatgtgtccatgtgttctcattgtttagcccccacttatatgtgagaacatgtggtatttgctttctgtttctgtgttagcttgcgaaggataatggcctgcaactccatccatgttcctgcaaaggacat

SEQ ID NO: 12005 - DNA, 1004 bp, Homo sapiens
tttcaaaaactgtaaagaaggtcacgtggatgggtgatgaagctggagggggtaggtctttgtacaccatttgaaaattactttttcccaaaggcatcagaaatggtacagatatgtttaagcagggaacaactacagatttttagttaaaaaaatcactttgcaatgtgaagtatggtttggagatagtgtatggatgtaaggaaattagaaaagagttgcctgtagtgtaggtgaatgattatgggagccctactaaggcagtggcagaggaacttgaatcaagtagctggatttgagaggtaaaatcagcatggcttggtgactggatgtaggagtagagggtagagctgagagtggtttcaggtttcttgcttgaacagtggatggatggcaaaaccatttattaaacgtgggaccactggggcagaaggaggttttgggaggatggagtaggataaagagctcaattttgtactactgattttaatgtgcctgggagacatcagtgtctggtaccagctgtttaggtaaacgagactggagcatggagaagtttagccgatagaaatatcacctgtatgaccgctacttgaaaccattagaggagataagactgtcttggataaaagtatagaaggcagaatagagaagcctaggacagaatcctgaggaattctgacatttaatgtttggacaataatggctaaaaatgcggtgtgcttattagggtcaggcatcattctgagtgctttatacatatgcagtcatttaaattgtacagcatctttgtgaggtaggttctattactcctattttacaggtgctaaaagcaggtgagagagaagctaatggaaaaattgctagtaaataagcagctggagaaatgggagaaaaatggaagttcagtgttagtaaaaacaagaaatgtctgtagagcaggagtgtgcctttttgttgaaggctgctgctaagtcaaccaaaatgagagctataaaagatcc

SEQ ID NO: 12006 - DNA, 1029 bp, Homo sapiens
ctttcttccaataggagactcttgcatctacattgaaaatctgttgtttagtgtagccagctccatcaattatcttagctagactttctggctaacttgatgcagcttctacattagcacttgttgcttcatcttgtacttttatgtgatggagatgacttctttccttaaacctcatgaaccagcttctgctagctcccaacttttcttctgcagcttcctcagtctctcagccttcacagaataaaagagagttagggtcttgttctagactaggttttgacttaagggaataccactcaaatcttgtgcacgtcagcaatagcatttgttttcttattattcatgtgttcactggagtagcactttcaccccacacaagctcaacctcttccactatcaccatctctcatcagagaaatacattttttactttctatgaatctacgttgacacatcatcatcacccaaagtttgtagtttagagtttgcattagggttcgctcttggtgctgtacattctgtggtttttgtcggtgtgtgtttgtttttaagagacagggtctctctctcaccaggctggagtgcaatagcacaatatcatagctcactgtagccttgaactcttgggctcaagtgatcctcttagcctcctgagtagctaggattacaggcgtgagtcactgcacccagctctatgggttttgttgaatgcaaatgtatccaccattgtaatatcatacagaatactttcactgccctaaaaattctctgtgctccatctactcattcaccaattcttttgttgttgtttttaatatcgtggcagtgtttccactatacatggtctttaaagtttggttgaattattgtgtgagaaactatctgtgcctgcttctctttgaggtgggacctctttgaaaatatgctctatgtttttctttggagattgatttttgtttagatttcttttggcatcagtttttaaaaacttcattgaaaatcacctatttcattcagtttttaaaa

SEQ ID NO: 12007 - DNA, 1086 bp, Homo sapiens
tcgtgtccacccatgaacctttgtgcatagctccaaaatgtataaagcaaagatgataggacaagtagacaaaaaataacccaaggattgagaggtgcactttccaatatagtagccactagccacacagtatagccagtagtcactaggttatttaatacttcaaatatggctaatccacgttgaaatgtgctataaagtgtaaaacatacattggatttcaaagacttggtatgaaaaaataaagtaaaatagctcgaatattttaaatattgattatattttgaaaagatcatactttagatatgagttaaataaaatctattaaaattatgagaacttatgaacacaaagaaggaaacaacgacactggggtcttcttgagggtggaggttgggaggagggagaggagcagaaaagataaatattgggtagtgagcttaattcctgggtgatgaaatgatctgtatgacaaacctctgtgacatgagtttatatatgtaacacaccttcacatgtaccctcaaacctacaataaaagttaaaaaagattgcaacctaaaataaatggataaataaaatctgttaaaattaatctcatcagtttatttttgcttattttaaagtggtgactagaaaatttaaaataacatacgtgtttctcattgtatttttattggacagcactgaagaggatttaaatgaacacaaataacaaatatggtataataattatagaaaagaaacattttgacttatcagattttatgttcttttcagtcatgcaatatttataaattgatcaatcacctgaccataggaagatctcaaaaacatgtgaaaactagttttggcagaggctgtgatatccaaacacaatgcttttcccaactcaaatggaaatcattattgcctataccaatttctgttgcccttcccagtgattatggggaggtgtctatgcaggtggggtctgcagatagcatgaccctgatggcagggattctctatccctctcaggagtccatggcaccagaggtcctactctgcctgttggccccagctcacaagatttattgagtcaga

SEQ ID NO: 12008 - DNA, 1034 bp, Homo sapiens
tctgccctcaaacctgtctccatctccccgccacactgtccacctcggttccccacctcagttggctcccggctcctggctcctgttccgcccacaggctgatcccccaaggcacccccggctgagaagtccccaccagctcccatgccccaggcaccaagcccaaaaactcttttgcatggcctcggtgctcttactgtctggccttaacctgactttttggcatcatcttctggtactttcttccccccacacctcggttttttttttttttttttttgagacagagtctcactcggtcgcgcagcctggagcacagtggcgtgatctcggctcactgcaacctccgcctcccaggttcaagcgattctcctgcctcagtctcctgagtagctaggattacaggcacgcgccaccacgcctggctaatttttgtattttttttcctgggttttaatcactttgaactaagtagttgcttcttcttgaaaacagtgtggttacctagtaactcaggcactattagcagagtggtaaacagcgtgaactccagggcgtggcgcggtgtccgagtccaagccttctgtttactggctgtgtggatttggataagcaacacagcctctgtgggcctcagggaggctctctctttttcctgcccacctttcacgcattgttctctctgccctttctcttccgttgaactcctacacaccctctaaggcccattttgagattttgagtgtggcacctgctctgtcctgggcaggtgagttcatccctctcctgcatgcctgtggtgctgctcacctcacagcagcccttgacacttggggcagggaaagtcccctcactcccctcagaacgcggcccagcacacggcctggtacccgggagccgccccagtgagtgtgagactcagtggatgaggctctgtagagggctgtggaaatggcatctgctcccctacctgcctctgtctgccgagcttctggggcaacagctagtgtttctctttcctgctttatggctgt

SEQ ID NO: 12009 - DNA, 1033 bp, Homo sapiens
aagtttatgtgagtcctcgtgttagatgagtctcctgaaggcagcaggtagttggttggtgagtttttatgcattctgtggttctgtatcttttaagtggagcatttaggccatttccattcaatgttagtattgaaatgtgaggtactgttgcattcatcgtgctctttgttgcctgcctactttgtttatttttgtttttttgtttttgctttttaacttgtatttttgttttatagggcctttgtgatttatgctttaaagaggttctgttttgatgtgtttccaggatttgtttcaagatttagagctccttttagcagttcttgtagtgatggcttggtaaggacaaattctctcagcatttgtttgtctgaaaacgactgtatctttccttgacgtatgatgcttagtttcactggatacaaaattcttggctgataattgtttggggaggctgaagatagggcctcaatcccttttagcttatagggtttctgctgaaaaatctgctgttaatctgataggctttcctttatagattaggttacctggtgcttctgtctcatagctcttaagattctttccttcatcttaactttgggtaacctgatgacaatgtggttaggtgaagatctttttgcaatgaatttcccaaatttgtgcttcttgtatttgcatgtctaggtctctagaaaggccagggaagttttcctcaattattccctcaaatatgtttcccaagcatttaaaattgtcttcttcctcaggaacactgattattcttaggtttggtcatttaacataataccaggcggtcttggaggctttgttcatatttacttattctatttctttgtctttgatggattgggttaatttaaataccttgtcttcgagctctgaatttctttcttctacttgttcaattctattgctgagatgttccagagcattttgcatttctaaaagtgtgtccaaagtttcctgaattttttttattgttttttctttaagctatctatttccttga

SEQ ID NO: 12010 - DNA, 1046 bp, Homo sapiens
ggtacaagtttgttttcaacaagcaattctcttgggaactaagagtgagaactgagtcacttctgccataagggcagcaagcctttcatgagggatgtacccccatggtccaaacattgcccaccagacgccacctccaacactggaaatcagatttcaacatgagacttaggccaaacaaaccacatccaaactggaacacctaggtagtgggaaaggctcatgaaatgtgcctgtgctataagagaaaacattatcagagactagattgttctgtccccaaaaccctatatgcctcactctggaacagcgcaagatgcaccctaataatatttacttctctgaaccccagtttcttggattattatgtctatcttgatatattactttagctcattaagccacaccgtagtgggggtgggacatggtgtttcttcacataataggttgatgtacttagtcaaactaaattttcagtggtgtttgaaaatggggggactagaactcaggaaggtggtaaaagctggatatatggatttgatcacccctgggaaacaacaacaacaacaaaaaacatctaaactaaagctgtggaggtagtaagattactgaaaggaaaagtttccaaaaggaaggaggtatccacatataaaagaatgaagtaggatccttgtcttatacaatatatccaaattaacttaagatggattttctaaagttaaaatgaagttaaaattaaaaattaaagttaaaagctataaaactataaaactggtagaagaaaacagaggggaaaagctttatgacattgcatttggcaatgattccttggctatgacaccaaaaagcacaggcaacaaaaaaaattggtgatgagttgagggatttgtaaaataacataaaaatagatgaattggacaacaacaaaagttacaacttctgtgcattgaagggcaggatcaacagagtgaaaaggcaacctacagaatgggagcaagtatttgtaaatcatctatctgataaggggttaataaccagaatatata

SEQ ID NO: 12011 - DNA, 1035 bp, Homo sapiens
gggggtcacaagagccaggggggaagtggggctggctctcagttcccgccttgcggtgtgtgcctccccccctgcgatgggggtcctaagagccaggggatgaaaaggggctggctctcagtcctcgcctggcgggagtgcctccccccccgcgatgggggtcctaagatcctgggggggaagaggagctctctctcagtccccgcctcgcggggggtgcctccgactcctgcgatgggggtcctaagagccaggggggtaagaggggcaggctctcagtccccgcctcgctgcgggtgcctccgtccctgcgatgggggtcctaagaaccagggagggaagaggggctggttctcagtcctcgcctcgcggggagtgcctccctccactgcgatgggggtcccaggagccaggggggaggtggggctggctctcagttcccgcctcacgaggggtgcctccccccactgcgatgggggacctaagagcaagcgaggggaagacgggctggctccggtagattgtaaatgacctgctttctttcttttcccgggctgcgttcggacccctgtcgattgtaaatcccaagtaaggtacctgccgtgggcagatctgagctttcttcttggacaccccatacccacagtcctccaggtgggtcctaaggatcttaggaaccgcgatgggggtcctaagcccggggggaaggggggctggctctcagtccccgcctcgcgtggcgtgcctcccccgcttgcgatgcgagtcctaagagccgggggtgggagggactggctctcagtctccccctcgcggtgggtgcctccccgccctgcaatggggatcctaagagccaggcggggaagaggggctcttctctaagaatcaaaacactgtcacctttagcagtgaaggatccagtgagatccagtttaacggtcataaccgcctactggtccaacgttcagaagtaacacaggcacctggacaatacacagtagatgtggaaggacgcggttgtacatttatccaggt

SEQ ID NO: 12012 - DNA, 1031 bp, Homo sapiens
ttctgttcagaaggtgattttcaaaagcgagcaatgctgccaatgcagcttgcttctcttgacagattgagaagtccagcttcaaaagttacctgccatttaagcaaggagtttgtcaagagatcatggttcattttattgaaaagactttaaggagttgtaggatttattcatagattgctgagaacaatggcaatatttttatttttacagagtttgcacttctgatttcaggttaaacgctaacttgtttttagtctgcttaggggattgtgacttgaaaatttttatattctgatgagcttttttgtagtgtccacaatgtataaaatatttcctaggtgagatctatgttctccatttattgatgcattgcagaccaatttgagtgatgtgtttaaggaaaattcttcctagtttaataagtaagctaaaaggttttttttttatatttaatgtttaatctctgtctcgtgttatttaaaattagcctgcagatactttccctcacttctgtaggctcctggaagataaacattcaaacagcggaacaaacaataaattaaataaaaaataagaattatattttcttaatttctgcctcagaatttgcgttttgtctttctgccttttttttttggatgtcaaaatagatgagatcgtatactctatggagtataaattgttactgaagtctttatttttggtaatgaatgagtaagaataagactatctctgtgattattaaaatacatggaattatccaggaaattttccttacaaggaattaaaatattcctgtattaaagagaagaaaagcctttcccaagcggctggcgaagacggcagaggtgcaggtcctggtgcttgatggtcgaggccatctcctgggccgcctggcggccatcgtggtaaacaggtactgctgggccggaaggtggtggtcgtacgctgcgaaggcatcaacatttctggcaatttctacagaaacaagttgaagtacctcgctttcctccgcaagcggatgaaca

SEQ ID NO: 12013 - DNA, 1028 bp, Homo sapiens
ggccagacacttttaaacattgtttaagtaaccctgcaaagtaaaaaaaaatctatttaccggtaagaggaggtgccaggaggtcatgtaacttgaatgaaagaatctgcttttcttatttgaaagcctttgttctctaaactgtctcctgtctgctgcagtaatgctgtcctaaccctcattggaaactattccctgggtctcttcttgcctcccttctttctgaaggctgaaatgaggggcaagtttaacttttgcagatacgttgatctttaacttaaatcaaattctgttttttaattttgataatgttcaaagtacctattatctgtctttttgtggagaaaactgctggaggtttagtgaaacgatatcttaaaacaattcatcaaggtggctgctctgcagtgaacaatagaaggtaccctgggagctcttctattcagcgtccctagaacagtttcctagtgccccagatttagcattgtagtggccaggcaatcatttttgtgtgatgttcagtgaactcggaagggaggagaaagccaaattagatcaaagatagataatttcacaggctcatgttctcaaagaaagggatctgcgggttctgtctaacaatttctcaagctgtggagtttggttactcattgtagtcatgagaatgctttaggtatcaaataccttacaccctggttagaaactgcttgttattgtatgttgactagggggtcttagacaaacttagttgcaagctttagcatgaaagaacttagtcattcagtttagagagagacaaaagatttttttgcgaaagcctgctctttatctgaaaggggaaaatgatttattctgttttacagcatttattctctaaacttctatggcttatattagcttaactgtgtctccaggtattggcttttttttttttttttttttcagacagagtcttgctcttgttacccaggctggagtgcaatggcgtgatctcggctcactgcaacctccgcctcctgggttcaagc

SEQ ID NO: 12014 - DNA, 1042 bp, Homo sapiens
aagtgatcttcccaccttggtcttccgatgtgctgggattacaggtgtgagccaccacaccagcctatttaattatttaattttttttttttgagatggagtctcgctcttgttgcccaggctggagtgcagtggtacaatcttggctcactgcaacctctgcttcctgggctcaagcgattctcctgcttaagcctcttgagtagctgggactacaggtgtgcaccaccacaccaggctgatttttgtatttttagtagagacacgggattttgtcatgttggccaggctggtctcaaactcctgacctcaagtgatccacccatctcagactctcaaagtgctgggattgcaggcgtgagccaccgcacccagcctggcctatttaattttaaaagcatttcttatttcaaaataaccaaattgccgtacatagaattggtttgttgaatctagaagataattttatttctgaaatattctatagaaacaatggaatgggatcatccaggatgattaaattgtatctataaaccatacatagatacagttttttccccaaaagaaatgtgcttgcatgaattctttaaggtaagggagactgataaaggtttgattgttttcttatcagattgcatgagactcgttcaggagacatctgcaatgcctgtgtcctgcttgtgaaaagatggaagaagttgccagcaggatcaaaaaaaaactggaatcatgttagtccatctttcttttttctcaattatacctctactgtatttaaagtaacattaatttccccctaatttaggaagtaatatatccctagggtagaaaagtctgaaaagaataaagaaaaacactagctgctgttcagatataatggcctaacattttggcatctttagaacagaatagcctggtgtggcatttccttaaggctgtatccaatatcccccttctggagattcacagtaagcattcacctgtttttaggcttaactcagtaattcccagagttaattagacatgaattctttttcttaaa

SEQ ID NO: 12015 - DNA, 1035 bp, Homo sapiens
tagatcttttcttatgactgtgtagagggtacttcctcatttttcttcctctcaaagacatcaaattcccaagcatttaactaaaattattatcaactaaaaatgttttttttaaaacagttcttagaggtaactgtttagacttaattattgaaatgcatgaaggccttctgccttgcccccatcccactcttttgcctgcctctctcaccaacaaaaacatggcagaggaacagtttattaacaatagcctgtttgaaagggaagcttcagtttttagctaattatttgctaataaaagttttaaaaaaattttcttttaaaagttgtaaaacctctgtctatatttcaaaacccctcaataccaaaaaaatacacataaaaagcctggatatttggttctgaatcattttcattaatacttgctatattatactaaccagaattggaatggaatgggatcagacgagataatccaaagacaaatacagccatatgtcacacaaggacgtttcggtcaaccacagactgcatatatgatggtggtcccaaaagattatgataccatatttttttgtaccttttctatatttagatgcacagattcttaccattgtattacagttgcccacggcattcagtaccgtcacacgctgtataagtttgttgccttggaacagtaggctatcccatatagcctaggggtgttgtaggctattgccatcttggtttatgtgaggacactgatgtctgcacaaggatgcccaatgatgcatttctcagaatgtgtccccattgttaagcaacacatgactgtactgaagctttaggtttactcatctaagtttatttctaaaacaactttaaaaagatagtgttctgtggtaataactcctaaaactatggacacgaaagtgatattaataattttcttggccgggcacggtggctcacgcctgtaatcccagcactttgggaggccgagacgggtggatcacaaggtcaggagatcgagaccatcctggctaacatgct

SEQ ID NO: 12016 - DNA, 1020 bp, Homo sapiens
caatgcttgcatacttcaaaaatattgttataagctcagttggatctgctctctcagttaaagccaccttggcagccgccatgcttggccctgggtccagggggctgcgggacccactcactggcttgctcatgctcggtcccagtggttcacttccagtaccagcagcgtgtgtgcccggcctgcctggagtcctgattctctatcaaccctagtcgaaggccaaattatgggccatagttaaggaatttcctgacccttatgaagatcggatttgctttaccaaagaatttgaactcacaattaaaatctatgacccaggtcattctgacatttatcggcttgtctacatgctggtttcagctgcttaagctaaggaatagctagaaaaagcacagtgtggttggatcccctaacagatcttgttcctgaaaatccagtatgacctctgccacagccaactccccagctttcagaagatggctcaaagacgcgtgggtatgagcagcttctctgttaaatgccattcccttgtttttttcaaaagatcatagattacggccggacactttgggaggccaaggcgggtggatcatgaggtcaggagttcgaggccagcctggccaactggtgaaaccccatctctactaaaaatacaaaaatcagccagtcgtggtggcacacacctgtaatcttagttcctcaggaggctgaggcaggagaattgcttgaacctcagaggcggaggttgcaatgagcggagattgtaccactgcactccagcctggcgacagagtgagactctctcaggaaaaaaaaaaaaaaaaagatcgtagattagattaaaatccagcgatgctgccagaatccagatgggcctgttgtagatttttttacccactttgataaaacatgaaaacaatattgcagatgtcaatggacaactttgaaaacaataaaaatgacatattattaaaatttcccaaacaatttgggtgatgcactacccactcttgtcaa

SEQ ID NO: 12017 - DNA, 1044 bp, Homo sapiens
ttaccacgtttgactattgctctcaattttcttccatctagtccacccagtggtattactgagttttgaaaggtacttttgaatattaaaaaacgctttacttctgaatatataaaaaagccagaagaaggaatctagaaagtggaattggggaagttagagtaaataatgatgtccttcaaagcatgcatgccaactaaggtgaacttaacatatgttaaattcatcgtaataagaaccctctccatatccttaaatgtgagttaacacccttataaagatttaaaaagacaagaaaatagttgaattaaattcatcaccttttctctgtctcctattccatattaaaaagggtactaaagctctaaaatttgcatttcagtatttttcattctgtttcctggttggagcttaaaatgaacaagtatttagtattgctgagatttataagagataatctttaatcttatttatcagaaaacttttcttaaatagcgtctttaatataaactatcgctgtgaaactctttttctttcctatgtatattattatattcagtaaacttatgtgtttaattagatgtaaaattagacgttattcttgatctttggcttcccaatttcattagatgggattagaattgtcccttttgtgtctttgatatattgtggttatctcatccctttcttgactcatcagcaccaaggttagattcattaagttagattcattaagatcattaaatttatatgaaacccacagctttaaagtagaagaaaaccctacaaatcagccaaaacagatgtttagaattgattgttgtgttttaaaactttatttttttgtttatatatattgtccatataattagttatctttttaaattgcttttgctgacttagctattacctttaatcttttttaactttgggatattcagtttatttggtcagagctataattatggcatggttttttttttattttttatttttgagatgaatttttgctcttgtccccaaggctggagtgcagtggcacaa

SEQ ID NO: 12018 - DNA, 1045 bp, Homo sapiens
ttccatgcccttaaatatactgtttatattaatcttggctgccccactctttgagtagttagcaaattctacccgtttctgtgtactatgtacagccagcacctggttgtaatacaagacttagtttctgctctacagcggtttactattgagtagaggagataatgcagtaaacaagaagtgaaatcttatgtggtaggtgttctaataaaggtatggaagggttttgtaaaataagtaattcttaagagaatttcccaggtcaaggggatagagggtaagccgtctcaggcagaaataacagcctgagtagagggtggctagttattaaagtttgtttgacactcctagaatatcagaattccaagttgggagcagctggtaggcaggagcagatcctgaaaagctttgaattccttgccaaggagtttagatactatcatgaagccagtgttggtaccttggaagggaagattagtagttgaactttaggaagatatcacatgtttaaaggatgtagggaagtcagttacaaggttctgacaggagttcatgcaccatgatgaggaacaaacaggcagtggggatggaagtgaaggaagaaacagaatttctaaggacttcacaataaatttgatggagggccatgcagagggtgaaggaagagctcagttggcttccaagttgtttttgtgtgactgtggatgacaaccaagataggtaaatagaggaagagcagatttggagggaagattatataatcaattctcagggtatttaaagattggaatggattggtggtcagttggccatatttatcctagagctaaggggagagattggaccagggaatgaataataggtattaccaataaggttggttagtaacttcctgcgagtggattgcccaaagacagaaagcaaaatgatacctgaaatgtaagaggaaaaaaagagagaaagaagaaagattggtgagtaaaaagaattgtcagagctgagtgcataccttgtgccgatctttgtgttgatgttgtgttgatgc

SEQ ID NO: 12019 - DNA, 1102 bp, Homo sapiens
cgtgcccggcaaggatatatatattttaaaataaatattaaattagctgggtgtggtagcacatacctgtggtcccagctacctgggaggctgaggcaagagaatcgcttgagcccaggagcctaggaggtgaaggctgcagtcagccatgatcaagctactgcactccagcctgggcgacagagtgagaccgtgtctcaaaaagtgtatataataatgataaataaatatcaagtattgtctttgtttttcatttactcaacaaattgtaatatgcacaatattccaaatagtatttgagttgctcaagatatacattagtaaacaaaacagaaatcctatggttgacaaacttatactcaggtcggtgtgggaaacaaacaatacacaaaaacataacaaatatgtaattcatatggtatgtcagaaatgtgaccattgatctggaaagaaatagagcagtataaaaggaaataaagtggggagtggtctttcaaatggggtggttttagattctgctgaatgtcaaggtacattggagcacagacttcatgtaggtgaggaagtgagccatgtagatatctgggaggagggactccaggttgacagcactgccagtgctaagccccaaggcggaagtgtttccatggaactccaagcccagtgtgactggagcacagcaagagagagaaagtaggagattgggggagggggtgtttagtgccagtgccaggttgtgtagggccttctaggtcattggaatgatttcagcctttatcctgaatgaaactggaagctgttggaaggttttgagctaagtagtgacatgatagaacgtttttgtttgtttgtttgagacagagactcactctactgcccaggctggagtgcagtggccccatctcagctcactgcaacctctgcctcctgggttcaagcggttctcctgccccagccactgattagctgggattacacctgccaccacacccctaatttttgtatttttagtagagatggggttttgccatgttggccacgctggtcccaaattccgtcctcaagtgatccacttgccttggcctcccaaggtgctgggatt

SEQ ID NO: 12020 - DNA, 1030 bp, Homo sapiens
aacattttattaagaactgaggcatcacctgtgtagtgcttttttttttccggctactgtattttcttcccttccctctcttttgctgtgattttatcatatgcatgcttgttctgcttgtctctttctccctatccttttcttttttgctttcctgtcattggcatttctccatcctcttagccttccggggaacttttggtctgtcagaactccatggcattctgggagtgggaccagggtccacctcctcctgcacgacttcctaaaaaatccttctctgagtgctgcctggtatgttctttgcttgaaagtgctttaccagatgttcccccaatcttgtctttggtgttacttgaatgttacacatgtgtgagtgcacatagctctagaatgcctcacatgaccttgagatgtgaactcacactccccattttgctctctgcttcttgttatgtttagtccctttctgtgtttgtgtgtgctaatatgagtaattctatgctgctgacatgtaaaactaatcatttgggtctctaatcagtgggattttttttgtgtgctagatagcaaattgccttacttcaaagggggaaatgtattaaatatacaaactcccctttatttaagcgttttccagaagtacagatgtgattgaatttcaaatagcctttcttttgctgggttttatctccacagaattttaatttccccttcctggtctgtattttatgtggtcagaaaattcagtcatcaacatagaatctcagtgccaagaggaatctttaaggtcatcttgtccaatttgacatgattaaattgaagtccaagagattagcccagagttaaaagcacacaaagacagagctggacctatagcccaagactcctgacttctaggccaatattctttccatttaccctgcatgccagcttgcactaaccactgttcacttgaggcaacaagcaacttagaaatcttgcttatagttttcccccattatgtcatactagcttaaatctattttac

SEQ ID NO: 12021 - DNA, 1048 bp, Homo sapiens
ggctttcaccatgttggtcaggctgatctcaaactcctgaccttgtgatttgcccaccttggcctcccaaagtgctgggattacaggcatgagccaccatgcccagcccacttttgttgtttttaataggaagtagttacatatcatgaaggcttgtgagcagtgttgatcagtagaaatatttagtcctaaagcaatgtcagattgaggtgttgagtaaatttttatcatgtaatacttattgagctcttctgaattttttttaatttaatggtgttaaaagtgagaagcaacttatcagaatgccctattatagagttctcgtttgttttggagaaagggctttttggttttcttcaatacattttcataacacagtttgtatttcctgttctactttgagataatcaaagccccagcttgggcccttcttaagcagacataggagacttttgtgggatcatgaagacagaccagtagctatggtgttggaactcctactttgtagtacactcagctcagcagtgatttcatgaccataataagctttaaaatttcagaaaatgtatcattttcccttttcataggaggaggagagggatagaaaaaggtagtaggaaggcattagtgaaggtgatagtacaaaatctaagtggtgggaggttgctggttaacatttagattagcaaattagtaaattttttcttccattttaaagatactgaattggccgggcgcggtggctcacgcctgtaatcccagcactttgggacgccaaggtgggcggatcacaaggtcaggagatcgagaccatcctggctaacacggtgaaaccctgtctctgctaaaaatacaaaaaaaattagccgggcgtggtggcaggcacctgtagtcccagctacttgggaggctgaggcaggagaatggcgtgaacccaggaggcagaggttgcagtgagccaagatcgcaccactgcactccagcctgggcaacagagcaagactccatctcaaaaaaaaaaaaaaaaaaaaaaaagatactgaatcat

SEQ ID NO: 12022 - DNA, 1079 bp, Homo sapiens
agtcagcactgggtgtgaagtgggccctatgctttatgggtaaaatcagagaaagtggatgccactctgtccttaggaaacccacagagaggagagacagtacgggggccaagtgccataatggagtcctgtgatagtgcagaacttcaattagttctgattagggcacagtttctacttctaggggccatccagccgacctcaggggtttcaggtcagcttttcatcctcaccccgcccccgcccctgggataaaagacccatattgcctacagttcaaacatctgcctgattatcctagcagagtggtaggaactgattttctgatctcctctactacccgcctcacctgcacagagagtaccagctgtctcagcctagcttcttcagtgggccttggctgtaaaatgtgtgtatccaccccaggtaattaggttagctctttgtgctcgtatgactgacccctaccttttaggccacctggtgtttgttctagaagttattcctataaacagattttcacctaaaatttgaatctttatgaatcaaataaggaaaattttaagtaaacttgggctgtggataactgatgattcattaccaaaaaggtagtcatttaaaattataaaatgacacaaaaaatttaaatggaaaacatcctgtttatgcttggtcaggtctttgagttgatgtgactcaagtaacatctgatcattttcttaacctttttaaaaagactcccctaaattcttcctcccaaagattttactgtgtttgttcacagtgggttctgtgaaaggattattacaagcccacaatccattatcctcaattctacaaatccaaaaaattctgaaaaccaaacattctttttgtaactcattcatcagcaaaaccagacctgaaccaaagtgaccctattcatattctttgattatctgtcctactgggacatatatggtttgctgcagaaatattaatgtatttaattataggatactgccctagatagttcatatatgtggtatatgcaccatactgcttttctaaattaaaaaatctgaattctaaagcatatc

SEQ ID NO: 12023 - DNA, 1047 bp, Homo sapiens
ttcttttagagatgcaaatccttctctactcacaaggtaggttttccttggattttacattttccaaaaacaagtacttttgctcccaactactgtgtttccatggggtatattattagaaccgaataatgatcacagtcttttctgttttgtgtaaagggagcaggtatggtgggaccagcggctgagatgagactgctgtttctctttgaggtggcagtcagtgactgcagagagaaataggaaggaacacaagtgttaacttggctgatttgggtatatttatttattaatggaaatagcccttttttcctgataatatataatcgtcattaagaaaacattttttcttcatcataatgagagtgagagaactctgttactaccagaaacgtgtagacttcccattctttatggattagtaaaggttcacatcaaaactcagcgaacattgaaaagggataaatgaaattgttgactctgcagcttcctgaggcaatcaactttggatctttgcctgtgggagcatttcatctgagtgagagaaaaggtgagcaggcatgagacagatgactttcccaggtctaacagttctgccagagttgtgtgtgtgtgtgtgtggttttttgtttatgttttttaatctcagaaggaagttatctttgtggtatctttcattcaaagttcttccaacacatattaagaaaataacaaactatggattttattttaccagtacatttgtgaagactaatgctgagcctagactaggatactagttgtcatctgaatatgaatgtgtagagaaaatagagatgctatgtcttaatggatagtgaattgaaggaaattataaaatagtacctgtacactgatagattcttcaaaaaaggttacacaaatatttggattcacttttttttttagacaagttctcactccgtcacccaggctggagtgcagtagtgcaatcatgggtcactgcaaccttgacatcccgtgctcaagctgtcttcccacctcaccctcctgagtagctggtactat

SEQ ID NO: 12024 - DNA, 1054 bp, Homo sapiens
aggcatgagagtatatgcctgtagtcttagccatgtgggaggctgaggtgagaggatcacttgagcctgggaggtccaggcagcagtaagccatgatcgtgccactgaactccagcctggacaacaacagagtgagactctgtctcaaaaaaacaattaattaattaattaattaaaataaactttaatattacctggatttaagtttctgtgttgttgaatattccttaatggagtcgatgaatttgcagagacccctccaagattcttttgtttgattcctttcatgaccatcaccctagaccttcaagtttgctgactagatttgggggttgtgtgtttagaaaggataacaagcttgtcatgggctagaacctgtggtcttcataaatagcttagtaggatatatggctttttctatgaaaggtggagaacatgcattaaaaatgggcaaattctggcctgggcatggtggcttatgcctgtaatcccagcacttgggaggctgaagcgggcagatcatctgaggtcaggagtttgagaccagcctggccaaaataatgaaatcctgtctctactaaaactacaaaaattagctgggcatggtagcacacctgtagtcccagctacttgggaggctgaggcaggagaattgcttgaacccaggaggcagaggttgcagtgagccaagatctcaacgtcacactctagcctgggtgacagagtaagactctgtctcaaaaaaaaaaaaaaaaaggcaaattctgtcttatacttggagaactgtactcgtgtatttaaacatgtaacaagcaatgtagacagttaccaatagaaggtacgatatagtcaggggttagtattatagtcagaaagtcaaaacgaacacaaataaaaactcaggctagtaaacacatgaatagctaactgctgtaataacaaccccataatacttcagtggcatgagacaataaaagtttttctcattcacgtttagtgtaatgtaggccaaggtgggaggcactctacttcacaaagatatttagtgactcaa

SEQ ID NO: 12025 - DNA, 1607 bp, Homo sapiens
aataaaatttctttcaactataaaatgtattagcctattcctttcctcttcaaataagatacggtaaataaaattaaccatttttaccaggtatatgcaagcaagcatgcaggtaccaacaaggctttgatttttttttaagcaaacatgtcttatttatttataaactagtgccaagtgatgagcatgtaaatgatgggcagtatttatgaaatttcagaaagtggttgtactaaagagcacttgtagcttcagttgtggttttaaaggaatatcttaggaaactgcatttacagatttgttcttcatggcacctacatcagctttgggcacagtcagtcagtacagttctctttgtttcaataaagtttaatcctatatatatatttttttatatatatttttttctgtttatactctcctattgtgctttacaatgcactgttctacctaaggcttgactttttaagatggcaccatgtaaggtcctcttggccagagattccaaaaatttttgatatgggactgtctttccccattactcttctctcttctctcttctctcctccctccctccctccctccttccttccttcctcccttcctccctctctcccttccctcccctcccctccccttccctctttctctcactctttctctctttctccttttctttctcagaatctcgctgtgtctcaaaaaaataaataaataaataaataaacccaggctagagtgcagtggcgcaatctcgcctcattgcagtatctgcctcctgggttcaagtgattctcctgcctcagcctcccaagtagctgggactacaggcactcgccaccaagcctggctcatttttgtatttttagtagagaaggggtttcagcttgttggccaggctggcttcaaactcctggcttcaggtgatcacccccctcggctacccaaagtgctgggattacaggcatgagccactgcgcctggcctccattacttttcaaacaaaatgcagcgatgactggttgagtgtgaggaggtaagaactcagaattctaggaatgaaagtattagtattttatctgctgctgagacagcacatcctgaggatagaagaggccgcaagattagctttctcagatgttctgcaccttttccaagaatctatgactttactaactttatttgaaattaactcttgtaactatttttactaacatgggtttcttgggttaccttttatttttctgttagaaacttgtgtatatcactcatgcagaaagctaattttgaaataatgctttatttaaatgactttcaaagatatgtgctagcattattaagtcagaagtaatcccaggaagtcacccttattctatgatgctatgaaaatagctaacatttatgaggcatgaactgtggttggtgatttataaacgctaattctcacaataacttgaaaatatgacttttctcatttgatagatgagaaggatgacattcagtgagttgcccaaagacaggaaaggccatagcttggattccatcccaggctgtctggctgcaaactagccttttttcctacgccctgctgcccctctgagtccttc

SEQ ID NO: 12026 - DNA, 1049 bp, Homo sapiens
tggttacctgtagagccacaacttgctgttcctttaaagagctctctcattattatagagctagctgctttgtaatttacacacactttcaaggtgattttcccccagggtcaagactgttttcccttggaactggaggcaggaaagaaataaaatggaagaaaaggaaaaacaagaaccctggtatatgcagcgtaaggagttgccactctccattagtttccagtcataggtctgttcctcttgtacttgctgaaagaaggaaaatagattcactgttgcactgtgtgaagtagtctaaaacttggagagcaagatatagtctgtttttcccagaaaaactagaactgtttaattgtggaaagataatctaactttatctcctccaaacacagctgttttgcttttgtcaaatttagagaaggttaaaatatcttaataagtgtattgaataatgcatatcagcctcctgaggtctaaataaaaatgatcataagatattcagacaaacagaagagtgagtcggtcctttggtggaataaaggtaaataaaaccggatcctttttgcagataaaatgctcacctacttgtagcttagtaccttcttccaagaagtctcattggaggactggagtaatctaggtgaacagaactcacaaaatgcaagtactacataccaaagagctgtttctaatttatcttattatatttaaaaaggcttggcttcacaagcatgtcttcaaaaataaaaataaaataaattacattcaccaccaaaaaagcttgcattttgatgcaatgccaaaaaaaataacaagaaccactaaaacctgcaatcaatgtggatgggcaaataaaaatggaagaaaaaaaaatacacacagcctgtaatagtacataagcacacatgcaggcataagagaaaaaaagggtcaaaagcaaatggataaaggaaacctttagaaaggtgtcttgagtttttccatgtagcagggtctgtagttaaagagaaacagcacagaataagtttagtgcttatccctaaaat

SEQ ID NO: 12027 - DNA, 1338 bp, Homo sapiens
aaaatacaaaaattagctgggcatggtggtgcacacctgttatcccagctactcaggaggctgaggcaggagaatcgcttgaacccagaaggcagaggttgaagtgggccaagactgcgccactgcaccccagcctgggcgacaaagcgagactccatctcaaaaacaccttctgcagaggatgggggcaaggaaggaaacaaatggaatttttttcttcaggcccacagtgtaaaacactaggaactgttatttctactacaagctacgggtttaaaaagtctacaagcaaaaaagataaatggttctacagacaaaaatcatttatttcaatatgaagtattagactgtttattactctgtgcagtaaaattcatcttagctgctgacagattaccaaaaactggatgcagaatattttctaatagatcacttcacacaactaaatgtatattctccctattactgcatgaaatgacataccaggcaacatgaaggagaagatgcagtagggactagacacatgaaaaaacattctgaacgagaaaaaatacacatatttcctagtaaaagacattcgttttgatactttggaaaaccaagttaaattaaaaaggcaagtcagtgttactagccaaaataattaatgaaactactaaattaaaatttaggaaaaagattttcttaaatgactcaaaatgtggcagccagatagaacaaaagaatctctcatttttaatagctttttctagctgatacatgaggtcctagtcattctatgttaacaaaatgggtcttgctacaagttacccaaggactatcagaaaatccacttgatgatttagaataaaaacctaaaattgtaaaaatacatgtatttttcaaaacagatcacagaatcatccagaagtattaaagtccgtcatttatattaagtaatactaacctgtcttgaatattctttctgacaatgagaaaatatgatttaatgagtcgttcaataacctcacaatctcgctgttcccgagcagatagttttcgtgcaacaggaactggctaaatagggatgagggggaaaaaatattacttttgtgacactaaaatggcagctttaacatctgaaagttatgtaagtttttgagacttttagttctttctgtctaatcgttttcctactaacttggtcacctaccttattacctaaaccaaattgtcatggcttaccacatctagcaggttcacggcatgacctttttgtggactggctggcataattggaatgggttttgatttttcttctgctaataactcttcagcttttgaagttttcagcattcc

SEQ ID NO: 12028 - DNA, 1122 bp, Homo sapiens
ctcagctcactgcaacctccgcctcctgggttcaagtgattctcctacctcagcctcccaagtagctgagattacaggcgccaaccaccatgctcagctaattttttgtacttttagtagagacggggtttcaccatgttggccaggctggtctcgaactcctgacctcaggtgatctgccttcctctgcctcccaaagtgctgggattacaggcttgagccatagtgcccagcctggaaagataatatttaatgtgatggttcatgcaccatagtctaaataagaaatttaagacaggagagaattgataacttgaggtgtaaggaatgaaggttaggtaaaggaactaaagttcttgatgaggctgaagagaaacatggtaggagggagggagggagagcagggagaacgggaaactatgttcagagcctgacattgctgagtttatgttttcagaggcaacatgtctctgagtgaacacaggctctgtgtgaccatggaagtgagtggctgatgtatggaagagatgaaagtcagggactgtggggaagtctaggaactgtgaggtaatcattttgatgaggtatatgaataggaggtggagaaggctgtgaactgggctccaaagcctccagcaaatgttgaggaaagaataataggccttgtgatagcaaagaaaatgctgtggggggtgatagagctggacggtggtgactcagaagagcaggacttatgcatttgagggaaaacggaatagtgtagaagcgcaactgggaagacagagagtgccaaacgtccctcctggcccaggatacaggagtggtgtccagtagtctcctccttggatggctacaggggaaggattcttctcagaggagagcaaatagtctaacagaatgttctgcaaattaatgaaagacaaattttaatttgtttataatagaacaaacattagaaaatagtaattaaattcctttgagtcatggacactttgagagtctaataaaagttatgttttaataactaataaacagagtattgcaattgtatctaacaattacatgttttcttcctccttattttttttttttcccaagatgaggtcttgctttgtcacccag

SEQ ID NO: 12029 - DNA, 1061 bp, Homo sapiens
atttttaatgcattcagttacaactgtcttctccagcacatacacaccaaaaaaaccacataccaaatataatttttaatgcgtatcttggtaccaaactttagaaatttactgcatctacattttcatgattatgcattttcttttctttctttttgtattatttatttgtttattttttgagacagagtcttgctctgtcaccctggctggagtgcagtggcatgatctcaggtcactgcaacctctgcctgccaggttcaagcaattctcctgtctcagcctcccgagtagctgggactacaggtgcacggcacctcgcccagctggttttcatatttttagtagagacggggtttcaccatattggccaggctggtctcaaactcctgacctcatgatctgcctgcctggcctcccaaagtgctgggactacaggtgtgagccagcgtgcctggcctgtatgcattttcattctagttacctttgctcatccatatcttattctgaatactcatgacttatttgatctagccttgtgcatagtcccagataattaagaagataattaaatcagggtctaattttcttgactatcaaatagctatttttcttttttgtaagatgtagaccccaaaagaggccagaacttactattgaaaatcagaatctaaatgcatttacttctggagaagaatttaccataaaactagaagagtaatgctagatgagatagtgcaaacaaaatggaaacttgatgaaagtatctagatagttcaccccagagattggctttcccaaaaatagaaagacaactgaatcatcaacttcagcctcagttatttggctaattatttaaactctttatgtttcatgtgtaaacataagcaatatgaagttaataaataatggaattggcaatatttctaatgttatactatcataaccagtcataaccatattttctgttggttactttagatatacaaacaagtacatggtttaattaattaaattactttgtaaattttttttttttctttttttgagacagactctca

SEQ ID NO: 12030 - DNA, 1052 bp, Homo sapiens
cacatgtgttacagactcaaatatgactgtgctctgaaatgctaatgtcaactacaaatcaaaagtgctgagttaatgctttgtgcctggtgctctgtaatgaaccaggcaatgagatagttttctcagtttggtttcagcagttaatgtgctttcttggatccaaatttaaatatcttcctaaaccaaaactgtaaatatggttgttgcatgagcaacagaaaaaattgtttaaatgcttgaagcaaagtatggatgtcttctctaaatctttctttctttttttttttaacagaaacagctaatttccaatgtattgttgggaaaaagcacaaactgtgtttttaactcaaatattgtcttcgactgctatgtgtataggaaagcagtctctgtatcaatgtttacatgttactactttttaaatttcaatacttttataactgttcttaaaaataagagttttaaatactgaatcctttgtcttctaaattgcaatagctataatcacaagagcaatatctctttgaatgactgtctggacaaacacaattgcaaataagggaagggaaaaatgcttttctatttttcagtaactggattgtcttaagaaactacatctgcttaataaacaatttctcagcaatgtttgctgggtatgggagtttaagcccggcagatgtgtctcctggttgaacatgcatttttcatggagtttgggttctaaatttagactgcagttggtttgtattttgtaacactaagtagaaattataaaaagtcaaacattgtgatctataaatgcacagaaaatactttgtaaaaagtagcatccttatataataatgctatttagaaagactgaaaccaagactatttaactgtgaactatgtagcagatgttttaaactttttattccattatatcttgtctagatattttaattcaaagggatactggctctcttgatcggaatttcttgttatcaccattccacgttgccacacaaggtgcacaggctggaagtcttttgtgaaattcccagttaaat

SEQ ID NO: 12031 - DNA, 1034 bp, Homo sapiens
attttcatgatattgattcttcctaaccatgagcatggaatgttcttccatttatttgtgtcctcttttatttcattgagcagtggtttgtagttctccttgaagaggtccttcacatcccttgtaagttggattcctaaatattttattctctttgtagcagttgtgaatgggagttcactcatgatttggccctctgtctgttattggtgtataggaatgcttgtgatttttgcacattgagcagattgttcagtttccgtatagttgtgcggttttgagtgagtttcttaatcctgagttctaatttgattgcactgtggtctgagagagagtttgttgtgatttttgttcttttacatttgctgaggagcgctttacttccaactctgtggtcaattttggaatacgtgcgatgtggtgctgagaagaatgtgtattctgttgatttagagtagagagttctgtagatgtctattagttctgcttggtgcagagctgagttcagttcctgtatatccttgttaacctgtcttgtcgatctgtctaatattgacagtggggtgttaaagtctcccattattattgtgtgggagtctaagtctcttcgtaggtctctaaggacttgctttatgaatctgggtgctcttgtattgggtgcatatatatttaggatagttagctcttcttgttgaattgatccctttaccattatgtaatggccttctttgtctttttcgatctttgttggtttaaagtctgttttatcagagactagcattgcaatccccgctttttttttttttctttccatttgcttggtagatcttcctccatcccttcattttgagcctatgtgtgtctctgcatgtgagattggtctcctgagtacaggacactgatgggtcttgactatccagtttgccagtctgtgtcttttaattggggcatttagcccatttacatttaaagttaatattgttatgtgtgaatttgatcctgtcattattatgttagctggttattttgcccat

SEQ ID NO: 12032 - DNA, 1029 bp, Homo sapiens
tttcatagtagctgtgccctaacataagaaaataagttacttaagttttagaataataaccatcctgcttactgtttatactatagtgatatgaaattaaatattgaggcaatgagacttaatcacaaataaagcttactaccttgtcataagtcaatatacgtaaaggctttctatttgtttgtttatgctgtggattggccattgtgtataaggcagtgccattccgcctggctgcatgtagctgctggccagcttatcatttcctgaaaaattatatttaaatcatattttccattaaaaggagaataataaccttgagggcttagacttgaaaatcactaatggagctctgcacagtaggaacaataaagcaaaactgagcagagcagcaactaaaagcccatttgcccaaatgaattcaaacttatttttacgaataggtaaagcaagcagctagagcagtcatgtggaacattttccctacacttgtgggtgctgaaaaaagatgtagagtaacaagtataccatacttcctatagaataaaatgcatttattggtattctttacatgaatgtgataaattaatgcaaagtaaaaattgatttattcttctaaactaaatattataagggtctaaattaccatgtggtcaacatgcattcacaaatgtgtgggaattattttggacaaaagtttctcaggtacagggatcagaaatgagagactaatagaggtaataaacagagtggcctaagaagttgagtggaaacctgtaaatataaaaggatatgagcaatcttctaagaaagagggcaattttgtcatgaaaattttaagatttgaaataagaggtaaaggaaatttctgaagtcacttgtcttttttctcatttataaagtaacaccttgtgacatgactgaagaaataaatgttcctttggaaaaggtttagtttaggctagtgacttttttttaatcctactccaaatataagtgtgggatgaaggatactcctgtttgataaca

SEQ ID NO: 12033 - DNA, 1025 bp, Homo sapiens
agaaaatattgtaaaccaattctctaaaatattatcagataatagggtctatttaggctgtcttaccttttctctgctttccatttctcactgcttgaagcgaatccagtttatacacacaacacaattgaaattccacatttctcaagtggacaaagaaaaccctaaggtggcaaataatagtatgtagctgaggttcagcagaatattgggggtagtagatagggttttattagtatagtaaatattaaataccttcctttttgtataacgatatttaaccctttattaagtgtttcatgtgctaggcaggctaagagctatagaattaaatcactcagtccttaattaactttatgtgacaggtactttgattattgcattttacaaaaaaggacatgaagctagctcaattcctcttgtccacagtcacccagctaattagaagtgaaccaggatttaatcctaaaatgtctgattctaagattcttaacatgtattctgtataattttgattctaacacctaaacatggcatttaagattctccgtgacctgacttcaagctcttctttagctaaatacacacagaaacagacaaacacactgtactttatcttaataaactaacttcccatcatacatttccatggttcttgcttttactttcacttgtcatttacctggaatactcttcctcctcatctgtgctgatcgaaatcctatactttcaaatttctccacgtatagcctgtcacacagccctctccaaagacctcactcgccgcacctggatgaattttcactttgtccccatattactttatatcttcctaaaaataccggtcattgtttgtctcatagttatttacagataagaaaactgaagccagccccagatcaaaagttaaacaacttttggaaagttatttaggtcataagttggtagatccagatttccaagagtgttctggttctaaaacctgtgttactcctattataacacactgtcctaaaagacaaaat

SEQ ID NO: 12034 - DNA, 1006 bp, Homo sapiens
ggctttttctatggttagattttcactccctcggttagatttattctagatatttgtgtgtgtgtgtgtcactcttgtgaatgggattgcattcttcatttggccctcagcttgaacattattggtatataaacaagctactgatttttgtacatgattttgtatcctgaaactttgcagaatttatcagttccaggagccttttagtgtagtatttaggattttctaggtatagaatcgagtggtgtgtgaagagagatagtttgacttattttcccatttggatgccttttatttctttctcttgcctgattggccagctcttccaatactatgtggaataggagtggtgagagtgggcatccttgacttgttccagttctcaagaggattgtttccagtttttgcccattcagtatgatgttggctgtgaatttgtcatagacggcccttattatttcgtggagtgttccttcaatgcctagcttcttgagggttttatcaggaagggatgctggagaaaatcgtgtgtttgggggattgtcaaaaagaattagtttaaggaatgacattattagagatgattttagcaatgcaacactttaaaggacatgctaatttcacgattactacagaacaattttggaaacataaattaataatacatgatggcattgaggctggaaaataattatttgcagtttgactactttgttatgagtcacttaattactccaaaataggaactacttttattcccgagactttagttttcattgtatgtgactataaatatatgtaactataaatatatttttgccaagttcttaccatgtaaaactgcctatctgatgctatccaatatgtactgtaatatattgctcttaattaacgtttgagaaaatcagtgacattaaaaaatataaccgaaatggaaaagaaactccttttatcaggttatttcattattaatgagtcttgtttacttctattccaggacgcaaat

SEQ ID NO: 12035 - DNA, 1035 bp, Homo sapiens
gggaggtggagcttgcagtgagccaagatcgcaccactgcactccagcctgggcgacagcaagactctgtctcaaaaaaaagaacccagttctgatttacaaatggggcctggggaaatatagtttaagtttcacaacataattaatctaactagacctaagataatttctataaaactttattatttgtaaaggatatgaaaaaatattatttgcatatattccgttgtttttatacaaagacatattataaatgtatgtaatgtccttaaaatatattacagttatacatttaactattattcaccacaatataatgtttataagtaaaatacagggatattaacttattcttttggatagtggaatccaaatcaactagcaataataatcattgtattatgtatctttaaatgtatttatatatctttgccctgaaggacttcttaagagcaattggcacaatttctttctttctttttttttttttttttcctgagacaatcttaactctgttgcccaggctggcaacactgcaacctctgcctcctgggttcaagcaatcctcatgcctcagcctcccgagtagctgggattacaggcatgtgccaccacgcccagctaatttttgcatttttagtagagaggggtttcgttatgttggccatgctggtcttgaactcctggcctcgagtgatctgcccttctcggcctcccaaagtgctggaatcacaggaatgagccaccacacccagccaaattgggcacaaatttaaaatttgacttttattaatgatatggtaaagagatctagcttggtcatgacacccttgtgttatacggtgacaggcaaatcatttaaaatatctaaactataatttcctgtagttcacatgaattggatattctgaagtccatttgtaaaaggatataattcaattcaatcttccagctcttccatgacctaatgacatcttatttattttttcttcactctgaaatcattgtttgcatttttacagaaggcttactcta

SEQ ID NO: 12036 - DNA, 1037 bp, Homo sapiens
tcacttgttgtttgagcagagacttgaggttggacggagataagaattccctagatcttccttgggcatgtgtacaccccttcaaagggcatgggcttctagatttccagcaatatgccagagcttttaaaagcccccgataagcatctcattctctagatcttcctttttggtttttgagttagcctcttacttgcctcagattatatcatcacctccagcagatacgctgttaaacacctgcaactgactactttcaacaaatgtcctggagatagggcatttccctctgagcaggctttgagttaagtcaaataatgacaagcccaagccctatgaatggagcttttccagaaagcttccatataagtcagttaatgacaattctctagaaaagacacattttttttaagttttgtttttaattgacacatgttaattgtaaatactaatggtgtacagtgtggtgtttcaatacatatatacattgtgtaatgatcaaatcaggataattaccatattcattacctgaaacactttttgaagaactttatacccattctgtcccctccaatggcttttaaactgttggtttacacagccactgtagttgctaggctgacggttttcaatgctgctacatacagagctgggaaaagtaggattgcagtaaagcaagttaaaatgacatagtgagatttactctttgtcttgaatgagtgatcactgatttttgcaagcctttgattaatttccagattcatgaaaaaatttgattttgacaatttttgctagtgttctcattgtctttatggacaagcaactttgcagagggccttactctatcattctaaagtgacttccctagtccattatttagttttagaagtgacggatgctactgtatttatatattacataactttattattgttacatcggatgtattattggcaattgaaatggtcctatatgattaaatgaaaacatctttatgcaattaaatttaattatgtaatttaaaaccaaatcatgag

SEQ ID NO: 12037 - DNA, 1027 bp, Homo sapiens
cagatacagaagtgcaagcactagttcaagattatggaggtcattaggagagtaatgaaaacctatattaggttggtaggaaaggtaagaaaaagaataataaaatcactgttatgaatgccatctgaagtacactttgaatatgcatagagcttttcagtttacaaagtactttttttacatccttttccatttgatctttgcaaaatcctgataggcatgcataacttatggttgttctgcttttgttgataaatgaatagaagttcagcttcttgccgaagtttgcctagatgacagcttcagaatgtggagccttcagatttcacatttatgagttttcatttctccacagcacatgaagctgggtagtagggccagtgttaaagagatgacatctatgggtttataacagccacattattttaattgaagactgatgtaaaacataattctaaaattctaaatgtagttgacaaacatatatagtattattgatgggaacaggagaataaggcgttgctgacttgtcagttgggggaatagaggtcgatataatggacttagattttgaatgggtgaatttaaaattctaatattagcttttctttagttttgatgaggagaatcccaaatgtaaacttagcagatagttacaatccagacaatactggaattcgtgattacctcatgtcagaagaatgaaaatatttcagattacaccaacctcaatctattgtgctttcttatgtaaggtttagttcatgcttcccaacagacacagatgtttccaagacctctctgtgttttactctggttccctttatgtgaaaaccggctatttcttctgatattcagaagtccagaatcttttcttgaaagcacagatacttaacttttcacactcgatgctgcttataatagatccaacctgagataattaaaaccaaacaaaaatatgtttagctatttattcatgtcatagtcaaatcatgcctggaaaggaaaattttatagttgttcatct

SEQ ID NO: 12038 - DNA, 1021 bp, Homo sapiens
ttaatctgaagtcaatattgtctgtttaatgtgggccagcagatctctgggaattggtatttccagaggaaaaaaattttccctagattacctctagtgctctttacttttagttgctgcttgattgtaggaacagaaactcaccccaaataccaaaagcttaacattttgacattgaccagagtttttatagagagagccatagtttattttattatctcaaaaagttgtctttttaacttttagataaattctgtagctttatttacataatacatttctggtgggacatggtggctcatgcctgtaatctcagcctttgggaggccaaggtgggaggatcacttgagcccaggaattcaaggctgccgtgagctattgtgccactgcactccagcctgggcaacagagcaagaccttgtctcaaatatatgtatatattatatctctcaaatatagatagatgatcaatagatagatagatagatagttgagataatatgctcagggaatcatatgatattgtcagcaaatgatagaaactgggtattacagctgattacatacctttgggattctgggggcaggagtagaacagtgagataacaataggaactataataacagatgagtggaaatagttaaacactaatattataatttaagtcatttaaaaaacatgtaaattgaagcctttctgttgttgtgctcattgtctttgtccccctgggcatgtcacggtcatatcagtctcacttttctcatctaaaaaataccccaacatgcccacatataatgctgttaaagactatcagactcaagttttggttttgctactaatttgtactttgtctaatcaagacacttgactacttactctgtgttttacttttcgtatttgaagggcaataaaccaaaaaatgtgaactaatcactagactatttaaaaaaaaaatcttccagtcctggcaattaactaccataacattaagtttgatactataatgtacataaaagtagt

SEQ ID NO: 12039 - DNA, 1037 bp, Homo sapiens
attaagactgttgttgtctacctgccaattttgcaaagtgaaataaatatgaactggaaccttgtaggaaaaactgctaagtgcccaggttgcatgtggcataaaggcacttacttatttttttataaaagggattttgtagcaagagagaccccttgaattagtaataataattttttttttccattctcttttccgataattttgaaagaattttctctcaggatgactttatttggtgttcggtacttaagactcttgggtcaaattcctgttttttgatactgttagggaaaatggagatagaatatagaactgcaccttagatttctaacattgcaaataaatatgacataagacgtaaatgatcataattactttaattgattctatttgtggtggaaacgtgttttagtgaaaatcattgtgcaccagacaaagacttatggaatctagggacatcttttttagaagatttattctgtttatgattctctgaggaaatagctttactaagatatttttccctatactgttaggccctgtgaacaaaatatggcattttgaattctgagtttgttctgtaaggtactagtgaacctactcaactaaatactattagcagaactacatagcatactttcatttgcataattaaattgcataagccaaatcattaatgaaaggattaatgacaggcccataattggtgtgtacaggattctgcttgggatgttggaccagataacatagaaactgtactctatatactaaattttcatacagacaaggcaatccaaaatacatttatccacttggttggttgcggaaggcaccactaaactttttgtttcagacgtattcatgggtcactggattattttgtacactagatactagacttcagtgaaggtgtatattttttaatacactttctaaatattataaatataagctttcacatacagatcagttatatttaaaaattttatttgaatattgtttggaccatgaaatggattttctcatagaaacag

SEQ ID NO: 12040 - DNA, 1044 bp, Homo sapiens
tatggttcagaacccttaggtaggcttaatgaccatttggctattctcttttaagaagtgttgtctattttcttactaatttttaggagttatatcttcaggacaggaattccttgttgcttgcgtatcttgcaaatatctttttcctttatatagtgtggcattctactctttgaatagtgtattttgatgaacaaaagttcataattttaatttaatcttagatagcgatatgatcctttataatcataacatatcctttatgatctgtgcttttgttctctttaagaaaatcttcttctctgaaggccatgatgatatttcctagtgttatcttttagaagttttattgtgttacctttcatgtttagacctacagttcctctgggattaatttttgtatatggtttgagatgaaatttactttgatgccactgtagtgttgaattgactcaggaacatttgttgatgggatcgcctttctccgctgcacaattacatcacctttatcataaataactgtaaatgtgaggactttgttgaggattctattgtgtaataccatactgttttaataactagtgctgatggcatgagctttgtagttttttttttcttcttctttaggattttctagggcaggggctggcaaacttttttctgtaaagggtcaaacgtaaataggagccagggcaaagattttaggctaggtgggccttatagtctctctagctactgtagcatgaaagcagccatcgatagtaaataaatggatgatgatgggactatgcttcagtgaaacttaacttacaaaaaccagcagcaggccagatttggcctatgggctatagttcttgaaccctatttctaggatattcttagcattacacagctcaacagaaattttagaatctgtctgtcaatttatacatacatttatccttactgtactgacaggggcctcctgtatagtgttgaataaaagcggtgacaggaggcattcttttttcttttttttttttttttgtgagagatgaagtctcg

SEQ ID NO: 12041 - DNA, 1078 bp, Homo sapiens
cctccggatgcttttgccacgactccgtcttggcaccagtcttgctgccctggaatgcagtttcccaaacgcagcgctcactctgactcctctctgcttttatccgtcaggtctcagttcttgcgggtgggagtcggctgaaggagctgcgttatatggttgtgacatcaccctccccggcccccattttcaggtcagaactttcatgcctttggaaacgagggacccagaagagcccttactgtaggaggaatgtcgccgttagacctctaagctccgaagaaccaaggggagacagaatccagattgcttccttaaatcccaagtagtattgttttttccaccttagagtccgcccccccgcccccacttgtcccatatattgatcggccactttgccaccgtgttccaaggttggagagcgtcacaatgccccaccgtccccaactctcaagtggccgacagtgggcagtccagaagctgggaccagactcatctgcccgagggcacagtaggagggacggagggatctcccaagagctccgagggcgaggtgagaaccaattgtggggagggggaccttataacggggcagttaggaacgggcagaggtgcccccacctccagctttcaactcaggcgaggaaacttcgagaccttcccgtccacacctgattgacagaaggaagctgtcgcggcccaggaggcgagtgtgggtgtgcagaggtggagacaaaacctaaaagcacgcagagccggcgagggcttgcggtcctggacggtaggggtctgcgtctggtgccaccttctccatcaggctgcttgctgggtccaccaagcctgacccctccagccaggaggggatcacggagtgtgtcccccgcccgggctgctgcctgccggaagggggctgggaaaccgggatccccgcgcgccacttgcctggcagcgtcagtttcacccaggactggctagcggttccctcgtggctctgcgcggaggtccgcctcctcccttccctcccccatcccgcgcgctgcctccgcctccttcttctgcctccaccctcaacccccat

SEQ ID NO: 12042 - DNA, 1030 bp, Homo sapiens
ggtagacagtttgtgttaaatgttggcatttacttgtattgaccaaagttttgcagctctactatattctgtgctcaggactaaaatgctgttaatttttttttttttttccagtgctgtgcatatattctgtgatgggaaacattgttgatgtcctaacagaaatatattttgatctattttcctatggagttgtttctattatgaccatttaattttgtttttatttaatagtagtatttccttcccttttatctaattttttatatgctgctaaatatattttaaatatactatgtttgcgaaccttggtagctatgatgagagctattatcatctgtggtgggaaaagctatgtaaataggtagattgtatagagagactatcttgtgttgtgcctgtatgaatttttaaaagttgttgactggattttgcaaaaggatgtataatatttctgtctgctcagaatattaatttgtaaattctgcaagtttaatttttatgtagatggtataacatttgaaaatattgtcttatgtgattttttcccctgaaaatatttgcttgtaaatgaaaacttagctagggcttaaataaacatgttgctatgaaattatttttactgtattgttctttttccaaattgcaagagaatggccagtgtttgtaaaactttgttttatttttgtgtgatggaagaaaagacatatttttggttatctggcaatccatatgccttcctttctttgcttactagacgtgaaatattcttgaggattttaaacagtaacctaatcttgatgaaccatggaaactcactacttaaagcaattaagttcaactgtgtaatttaggaatttgaacatggatgataaaacaaaacaaaaaaaattcctataaacattaagacagtggtgaccttgttttctagagaagagaaggggtggcttgtgactggcaggtgtcacagcaggtgagttgggagggttgggagggtgcttctggggtcctagcaatgttgtaatttttg

SEQ ID NO: 12043 - DNA, 1024 bp, Homo sapiens
ttttagtagtattttagtgtttttagtagagatgggacttcaccatgttggccaggctggactcaaactcctgacctcaggtgatccacccacctcagcctccaaagtgctgggattacaggagtgagccactacacccaggcatttgttgatttttttatgtttaacattaaaaaaaaatctaatcttttctgaaagatgttttagcccttcctaactcagggcctggaattactagtataccaagtaagagttttaaaccatgtaatcttattttattcattcataatcttattttatttattcatctcttcacttaccaaataattatttatatgcaccaactctgtgttaggtgctgtgctaggtagtatacatatagtgacaaaaggacactgttcttgttgttgcctacagccagtttcctgggaattcaaggaattctaagccaaacccaagtccagaagtgtgacttttttgctttgtttgtatctcttaaggtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtagatatttttaagaaaacatacctcttgcctatggcaaatacaacttcagacattaataacattagtgcatgtgaaatccaatttttatgaccccagaagttaatgtaaaatcataggcttttttattcagcatagtacctctaaatgtctcttgtgtccttattaacaaactgacaattttctcttttttttaatctccgttgctggggaaaataagtatatgggggaaaaataaaattgaaacattacaatttcttaatatttgcctacaagtcatgttgtttactaggaagaggtcaagattctcatcctagtttcaccagcactcttgatagagttatttcttgcaacatcgt

SEQ ID NO: 12044 - DNA, 1037 bp, Homo sapiens
agtcgtttactttctgtggctgttttatttactgacttcctaacagttttatatgtttaattcttctcccttttcactagtctactacagttgttctgaaatagcagtggtttatttgtattagtttacagagctgttgcatgcaagcctattgtttttgtcttctgtgttcatgtgaatgagctgcatgctgatgtgtgacttctgaacaccctcatgcacaccttctctctgtatgtaggcaaaaatacaaaaattaaaaaaggaaaaatattcaagtacattggcataactgataaagtataacaactatatttacactttatgtagtattcttggttgactcagtacattaaaggaggctcatgtagcatttactttatatttttaaacagtggattattgtatgtttggatggtacaggatacgtacatgactcttcagtattcatatgtacccatctcattcagaaggatgttactcttctacagtttaccattcaaagtcatggttttcctatttgaacatgttttactcattctagaacacacaatcaaaggagagtttttagaaatacttttctacaattctgtctatttagattcagctactaaaaccatcgtgcccatattgagatgttgagctgttgtttattacagcctatggattgcagtcaccattcaaactgtgacatggggataatgcttacattttaaacatttttttgtagaaaatgtagaggatagtactgatgaggatgctcctttaaacagcccaggatcagaaggaaggtaagaaggcctttagaaacaatagagttgacttatttacatattttaaatactttcatcttgtatcaaacaattaccataaaacagaaataattttcaatctaatggcctagtgaatagcacttagaaacagtaaatagaaaccaagttaagtcatgcttaactatcataaattttaaaatgaaaatattgaaatatttaaggaacataaatgaattatttttaaattaattcattttgacttta

SEQ ID NO: 12045 - DNA, 1028 bp, Homo sapiens
tgcaagtaaccatggctgaagatagttttttttttttccccagctaaaaattctggatttaaattgttggactttgtgttctgcaattctccagtgtcttaatcaatgacagttacctccatgcttaggtgagaaggtaatacctttaccattttgatttctggacaggctcccattgtctggctagaaactgttagggtcccaggattatgtcagtttaggttgtgtcttctgaacctcttgctttaactgggttagtaaggaatatagaagaacctggcttttaaaccctataaagccccatggtaaagtcaacttagatttcaagctgtatgtggtgtggactttcctcagtagagctgaattcacttagacgtctgcctgagactgctttatttaggctgaggttatttctcttgaaggactttgttgagaacagcaagaagtagccaatccatactaagtgttttggtgtggcttagaaagagtcagtagcttttcatcttactgtttgttttgtcagcacctgccgttcaacttccaagtcagtgtcacatattacaggttctattaggtggcaactacttctggctgtcaaattttgttaggacatgagttgagctattctaacaaagacccagctttacaagggcttaatagaaaagaagtttacatttcttccacattacaaccagactataagcagtccagaactgataagtaccattgtgttggtgtcccgggatctttctatcttattgattcaccatccctcaggtattacccccattcacatgatctggaatagtgcaccctgaccgctctgcattccagccagtgaaaaagaagaaaaaaagaggaggcccatcctttccatttaaggactctactgttgacattgaccggaagttggacacatgaccacatctagctgcaaggaagcttagaatgtgcagggtgtccaggcaaagattttgttaataaggaaaaaagagagaatggattttggagtaccattagcaatttat

SEQ ID NO: 12046 - DNA, 1057 bp, Homo sapiens
aagtaacctgccctaggtcatgtagctaataaacagctgagattcactagaacataagtcttgactcctagactcatgctctttccatatcaaaccatattaagttatctaaaattgaagcactgaaaaagtgtgtgtacatttttaaatatgtaggtgtatatgtatcacactcacatgtatatacaaatgtatcatcagaaatgattaaactttttctaattaaaaacttagtatgctgattagattttggcatttttagacagtaaacatgctttgtcttacaaactgtagactgtgagttccataagggcatgtactgtgtattgcatatcttggtattctcattgcctagcctagtgttttgcatagagcccccaggtgttcaagggtttgatgaatgaacaaatgggtaaatgaatgactgttaggtttttttttgtcaaggggtgtttgaaggtttttgatgtgtatttttgtctcaaagtgggaaaggttcattactgagctcttgacttttaagtggggatgacacacattcttgaattatgagtacatgtagtgccagttctcacaagcagatgccaaacactgcttcatgaaccagcacaacaatcatatgatggtagtagtttcttctcttgcaatgtgttatgacatattttacagtttttagttatatacaggtaatttttttttaactaaatataatgcaagggtgtccagtcttttggcttccctgggtcacattggaagaagaagaattgtcttgggccacacataaaatacgctaacactaatgatagttgatgagctaaaaccaaaattgccaaaaaaactaataatgttttaagaaagtttatgaatttgtgttgggccacatgcaaagtcatcctgggccgcatgcagcctacaggctgcaggttggacaagtttgatataatgtatgttactgggtaaaattaaattctaagtagaggagaaaggggctcctcttattttattatttaaaaattatttatttatttgtataggtatgtataatacaggtgtcttg

SEQ ID NO: 12047 - DNA, 1049 bp, Homo sapiens
gagcaagttacctaacctctagaagccttggttttatcttctgtaaaatgagataattatagtatttatctcacagagttactggagggaataaatgaatatttctggcagcatagtaagggtttgatatattactcattgaagattgagaatagactattggatttggttatatgataagttgttaatgtctttgacagtgggttttcagggatgagtagagacaaaggcctgagtaaaggaggtacaggagagaatgaggaattcaaaacagcaagaataagccattgttttgagattgtcaaaaaggatattagagaaatctggtagccagagagggacatgaagttcaaggataagtttgaaacattgtaatgattgtaattacaataaacttcacggtaattttatgtagtagtactgttttgacccccactgtaaaaatgagaaatctctagcataaagagaggaatgcaattctaaaatgtttgtgtgctgagaatgatctactgggaagggaagaatcgacaatgcaggagctggaaggaataattctaggagcaaaatttcaaataagtgggaaatcatggaatgcagtccacaagtggagagagtgacctttaacaggagcagggagtgtgcattcattttaacaatattgaaagcaaagtatatgggtagattttggagtgggaagatgaagttttattctgatagcttgtatttgctcactgaagtaagaaacaagggaatgagctgagcatgagtttggaggtattatagaagaagcagtgaattagttattttggagagtgggttgatttgagattacgaatgagtcttttgatagtgctgagggcccatttaagtttgtggtcatacacgtaaagtggagattgtggcagtaggagagaaaagggaggcaggaagcttgacatctttgagaaagaacaaaagatgaattaacatggtgaagccaagaaaggaagaaaacagtccttcccttgaaaagcttaaagtatacctgccaagttagatgatacacaggg

SEQ ID NO: 12048 - DNA, 1045 bp, Homo sapiens
cttataacttgggttgcttagagtaaatttacaccatcctaaatctctggttgggaattaggattttgcttctttagttctcctcagataagagtgaaggtgtcctatcctggagagatactctgtgctttcctaggtacgttttcaccactaccctcaaattgtaatggtgtaattatatcataaatttctatcaataaagaactattagggttaactttctatcaacaaagaactattagggttaacttttagagggatatctatgttttgaggtgatagcttagggaccttgtccagaaaaatcacagtcctgcgtcaggaactggaaataaaatcgtgcttcactgacactcctcagtaatgaattagcaagcttgtgcagtaagcccagtagaacgatggtagatgtgtcacacgaactgtagtaagctctccccttttctaaaattctggatcttttataaactctttgggaagggaactaagtttcatacatttatcagtgattaggactcaatatatgaagttggaagttttggtttttatacacaggtcatatttcttttcctctactcccatatataagcctggagcagtcaaattatttcatcatggagaataaaggggcaatatagacagcatgtgctgtgtaggaagcaaggaatatactacttatggctaactagcaagaacagttgtatatttgcactgcttaagttcctttggttatttcttaggtttgaaactctaaagataaatgatggagaggtaacattttaaaaggcagaaatagatctacgtatgaactaggtttggtgggtgttgagtgggcaggggagcattgttccaccttcaaagggagctgttaatttctacatgttattactaaagggagttctgtgtattccatgattggaacagggaaccgattatttatttggtctgtatatcaggttttagcctagtcattctgctggtaaggattagttctctcactcagccaaaatgagacatatttcacctgattgcatgcaattctgct

SEQ ID NO: 12049 - DNA, 1049 bp, Homo sapiens
agaggtcaagaaatttcaacagcaaatatatgtcttctctgaggcttacaatgtagtgaagaaattgttgtcagatgacaaaagatcagcctaatgggaagcaaaaaaagtgttttaatttttttaattaacatttacatttattgagctattgactatgtgtaaaatgttgtgccaagtgctggcctatgacgcctggggaaggaaaagggaagataataggtatggtgttctcactgaagtttactatctagtgagggtcataaaagtcccccaaaaaacccagggaaatagaagaattcaggcaatagagtgaaggcttaagtgtagaaaaacatcagttctctcaattggaacttggggaggatgctgcaatcagatggcagtgttaagcagtccttcccgtttcagaaggacatttgagaatgctgcatccaacatactcattttatggataactcaaatgaggtccagtgaggttgaatggcttgccaaagtctcagagcaaaactgtaagaaaaaccagtcttcagttgcaccccgcccataggccacccagctcaggggctagtagccactgagatccaacttatgccagcccttggggccagctgtagggatgactcttcctgggggaaagtgtctcatattctagttgtcacaaaggcatgtattacctacgtcctggttctgactccctagttagttcttttccctgcaattagtggtttttcagatatttcccttcctcattattaaactcttaacctaaaaagtaacccccaaactgatagaaacagagttttcctggaagccctgccaacttaaactcctcctatacccctatagatgttgctaaatggttttgtgttgcagacttgctgtttttcagtcattggtatttaagttgatagccacttgttttggtatctcaaaggatgtccaacacctggggcaatgtatgtatactcatgtgtcaaataaatgagtgaagaaatgaatgacgaaaagacaatgagttcaatagagtctattttactggttgccac

SEQ ID NO: 12050 - DNA, 1051 bp, Homo sapiens
accatcattctcagcaaactatcacaaggacataaaaccaaacaccgcatgttctcactcataggtgggacttgaacgatgagaacagttggacacaggatggggaacatcacacaccagggcctgtcgtggggtggggggagcggggagggatagcattaagagacataagtaatgtaaatgacgagttaatgggtgcagcacaccaacatggcacatgtatacatacataacaaacctgcacattgtgcacatgtaccctagaacttaaagtataaaaaataataataataaaaataacaagagtcacctttgctccgtttttcaacaagttcctcatctccctctgagaccacctcagcctggaccttattgttcatatcactatctgtatttttgtcaaagccattcaacatgtctttaggatgttccaaattttcccacattttcctgtcttcttttgatccctccaaactgttccaacctttgtctgttacccagttccaatgtcaagttcacattttcgggtatcttttcagcaatgccccactctacttgtaccaatttactgtattagtccattttcatgctgctgataaagacatacccaaaactgggaagaaaaagaggtttaattggacttacagttccacatggctggggaggcctcagaatcatggtgagaggcaaagggcacatcttacgtggtggcggcaagagaaaaatgaggaggaagcaaaaggagaaacccctgacaaacccatcagatttcgtgacacttactcactattacaagaatagcatagaaaagaccggccgcccccatgattcaattagctccccctgggtaccttccacaacacgtaggaattctgagagatacaattcaaattgagatttgagtggggacacagccaaaccatgttactggggaaacttctacacaaggtaaacacaaaggtttcttaacagcagactgcctcttactttgtaataaaagcatagcaagacttccttaagttaaaatatgctttcccctaagatttttgtc

SEQ ID NO: 12051 - DNA, 1029 bp, Homo sapiens
gttacttcaacaggtgagtggataaacaaattatgatacacccatataattaaatactacccagatagatggaaggaattactgatatgtccagtaacctggtacaatttcagaaacattgtgttgggcaaaaaagccagatacaaaacaatatatactgtacaagtatttatataaaattctagaagagcaaacccaatctctattgaccagaaatagctcagttattgactggagttgggcatgaaggaaatttttggtgttatggaaatgtttactctcttgtctgtggtagtggttacatggatttatacattgtcaaaactcattgacttacacgtaaaattggtacactttatattttgtatattatacatgaatagatgattaaagtactggatttcttgacttccaagaattatagcatacaaaattatatcttcctagctattttcaaagggcagactaattctactttaagcaaacagcatttgatgacacttttcatcacagacaagattctcctggtacgattattaaaagttggcttaggcaacttttatagctagactcacctagggggagaagacccaactctccattattataattattataattgaaagggtgcacttagaagaaatggacaaaattcctgataacacaaatttccaaaacacaaaaagaaatagaaaaactaaatcatgtatccattttaatcaccagatttatttgcttgtagcttacctgcaggtttaacagtacctttgaaagcaaatgagtagcctagctgatatttatcaagtcttatagccaccctttacttgtttttcaattagtgtttttattttgaaataactatatatttacatgcagttttaagaaataatgtagagatcccatgtactctttacccagttcccctgaataacaacttgcataattatggtatagtttcacccaggagattgatattgtttcaatccactgattgtgttcagactttccgttttacttatgcatgtgtgt

SEQ ID NO: 12052 - DNA, 1030 bp, Homo sapiens
gaaaagagtatgggcaaaagtgaagagaatattcagagcagttttcctcgtcttgaaagatatgattatagttttacagaatttggcaatacaatatagatgaagtaatatacgaaatcactcatactggaaattgtccaagattgaaactttcgaaatgtggagttatccaagatgtgactgtgtaggcttcagacagtttccaggaatgacattcttcagcgtaaaatggaaactccaattttaaaatgcctgtgtaggggttctgttcagttaatattcccaattacatctttttaattgctattttaaattttaaatcaaatggaactcacattgagattgtagatggtagtggctgcagccgtgtttcaagtctccctgaagcttcttcatcccccactactccaataaaaacagacagttggcaaggaatgggccttatttgaatcttgattcaaatgaactgaaaaaagtcacttaaagacaaccaggaaagtgtgaacagtgattggctgtttgatgttcttaagaaattattgttaatttttcaggtgcagtaatcatattgttatatattttttaagtccttgcagagatacatactgaaatagtaacagatgaaatatggtatctgaaatttgcttcagagtaacccaggagaggtggattaagtgacaatttagatgaaatgtcattggccatgtgtttacagttgttgaaagtttgttatgggtacatccggttaattatactatactctctacttttgaatatatttgaaaatatttgtaataaaataaaattttgatgtatgtcaaaataaatgctgacctagatcaaagacaaaagtatttttaagatagctaagaaacaaacagaatagataaaatggaatgcaaaaaatatctaattaatccaataaaagaagttttaaagggagggcaaaagtaatactataggctgggcacagtgggtcacgcctgtaatcccagcacattgggaggccgaggtaggtggatcacttgag

SEQ ID NO: 12053 - DNA, 1047 bp, Homo sapiens
tgcaaaagttaactgcggttttaccattactttttgccattaaaagtaatggtaaaaccacagttaacttttgcaccaacctaatagaaacgacaccaattattggaggcaaggaagccaccaggtgtgacagatggacaaatgaatacataaagaaccttgcattgcaaaaaaaaaaaaaaaaaattgaaagagactttaaaagaaataaaggaaatagtgtatttttcaattatactgaaagttatatacttatgattggtgcagtatatatgtgtattttatatgacatatatatgtgttataattcagcaattttgcaaaaaaaaaacttgggaagctgaaattttagagaaatgacataggatgtggtatgagaacttttagaaaaaagccttctaatgagtttttaaaatttttctgctttttattttttttcagaaagaaattgagattacaattagtttttcaatttgttaaatatagatgttacaagtataagagtaaactcttaaaatatgaactgttagagggagaaataagagactcaaagtatagtaagagaagaaggggcaaaaaaaaaaacccagaaaaattacatctaaatataactgtttttacaataaaaaataaaccaattaaacacagttgtaaaagacaaagatcttcatattgaattttttaatacagttgtatgctgttcacaggagacagtcacagaaaggttagaaatacagaaataagaggaaagaaaaaattagataagtactaagtcaaaaaaacaaaaacaagcagagactatttagaaaatttacaagcttgataggagagtcaaacagaacctaaagtagagaatgtcattctttttaagaaaacatggaacacttctgaaaatttaccatgttcaagcacaaacagtaaattcagtaagcttatataaatgtatagatatttcagtaaattataagtaaatccaaataatcagtatcatccagaacatgttttctaataaaaatgcaataaaactacaaaacaacagaaagatat

SEQ ID NO: 12054 - DNA, 1080 bp, Homo sapiens
taaagcaacaaacaactctgcttatatctcagatatccaaagtaatagagcctccaccattctgggatgccacctctcacttcaaggcttcaagatttatcacagaggtgaagcatagagctggagagttgagcactagcaataaatgctttggcctacaactattatttcatactctcattgtatggccacatctagtcacttggctacccctaacttcatataaggaattgtattataattctctatctaccttgaaatggagggcaagtagatattggtgaacattatttatatctttcacaatgtatttgctgatttatttggggccaagattccctattattctttctgcaaaaggccatataaaattttcattctgctggctggatcactactgtaagaagtattaatgacagataggcttgtcttagaaaacatcttctcctttggtgatgcccattaaaaatgataaaattcttcaattaacaatttctagcactgatttggaaaacctgactcattctgtaccagtatcattggtcaaagatcaagtacgaaaaagtgtgcacaaacgagtctgtcagtttttcagaaagttaatataaatatcatatgtatagttatatgacccagcaattccacccttgggcatatacccaagagaactgaaagcacgtatctactcaaaatcttctacacaaatgttcatagcaacagttttttttataaaacagcgaaaaaacgtagaaataacccaaataccccatcagctgacaaatagatacatgaagtgtgatatatcctacagtggaatattgtataactgtaaaaaacatgaactactgacaaatgctataatatggctgaaccacaaaaacatgctgggtgaaagaggccagaaacaacagagcacattgtataattacattgatataaaatgtccagaatagcaaatccatagagacaaagagtagattcgtggttgccagggggtgatgaaaagtgggaattgggaagtaaaggatttattcttgagcaatgaaaatgttccggaattggatagtggtgatgcttgta

SEQ ID NO: 12055 - DNA, 1031 bp, Homo sapiens
ttatgttgagtccatgtctttgctattgtggatagtggtacaatgaacattcccatgcatgtgtctttatggtagaatgctttacattcctctgcatatatacctagaaatgggagctgggtcaaatggtagttctgcttttagctctttgaggaattgccatactgctttccacaatgggtgaattagtttacactcctaccaacagtatattagcattcccttttctccacaacctcaccagcatctgttattttttaactttttaataatagccattctgactggtgtgagatggtttctcattgtggttttgatttgcatttctctaatgattagtgatatggaatttttttcatatgctccttggctgcacgtatgtcatcttttgagaggtgtctgttcatgtcctttgtccactttttaatggggttgtttttcttttgtaaatttgctaagttccttataaatgctggatattagacctttgtcagatgcatagtttgtaaatgttttttcacattctgtaggttgtctgtttactctgttgatagtttcttttgctgtgtgcaagcttttaggtttaattagatcccacttgtcaatttttgtttttgttgcaattggttttggtatctttgtcatgaaatctttacctgttcttaggtccaggatggtattgcctaggttgtcttccagggttttcagagctttgactttcccacttttcattctttcatttggcacacattactgaatgctaaccatgcaccaggtactgcatttgtgccaggtgttaaggaaacaaagcatgagatatagcctctcatcagaagtaggaaatatcttaggtttttatttacattttgaacccgtacacaagtatatatttagagagatgttggagacttgggtagacttgctttttcagaatatattcaaaaataagccaaaatattttttaagcatttgaaaaaaatacttgtaccacttggaatcatggtaggctgtatattacagaagaacccaaa

SEQ ID NO: 12056 - DNA, 1087 bp, Homo sapiens
ctgttttccctttccagcggtcagcctcaccaggacagtggcatgttgttttgaaatgctccccaggtgatgccagtacatcttccattaagaaccactgccataatgctatcacttttttttttttttttttcagaaaaaaaaaaaaaactgccagctttctttctttttctttttttttggtttttgttttgttttgttttttgcttcttgaacattgttaaaccaagcataagaatatgatcaatgtggttctttttctgtatagtgatagtttcacattttcctcttcagatgaagttccccaaaatccaaattgacaaactgtggcttcatctgtagatggtggtgacactggttttgtgaaacagtatgcccctcataaattagtcccttcaaagttcatttccaataaaaattcattttgtattcactacactgccttttcttctccttttgccagccttgtgttatttaacaaacgcatcattaacatgagcactgtaagactgtcagattcgatcataaaacttttatgcaaccttagaaatgtgtaaaaacggtcgggcacggtgcgtcacacctgtaatcccagcactttgggaggccaaagcgggtggatcatgaggtcaggagttcgagaccagtctggccaacatagtgaaattccatctctaccaaaaatacaaaaaattagccaagtgtggtggcaggctcctataatcccagctactcgggaggctgaggcaggagaatcgcttgaacctgggaggcggaggttgcagtgagccgagatcgtgccattgcactccagcccaggcaatagtgcaagactccatctcaaacaaacaaacaaaaagaaatgtgtaaaaaccctattagcccctcttttttccccagtatttgacatcctggtaatagtgtgtttagcatcagtaattcatagcatcttgacagtgaatataatattatgctgtgaattgaaacaactttccatttgtgttaaacatttttttttcttactaatttcctataaaatgaatctgtttcaatttttttggcatggtggcacaagctaatataccat

SEQ ID NO: 12057 - DNA, 1062 bp, Homo sapiens
tgtcacacagaaagaatggcaggtacaaagatcctgcaaggcagtaaggaacgtggcaagtgcaaggaactgaaagaagatgactatggggtcagagaagattcagataagactattaagacagatcagagccaaatcatgtagagcctcagaggtttttgatcttcagtctaagaacgtaaatccatggaagaattttaagcaggggtgtgccttgaccacattttgaattctaaactgtctctgggtgggtgtgggtgccaccaagagcatgtgttcatgtagggagactggttttttacagttgtctatgagagagatgacagttgcctggattatggtggtgacattggagataagcaggtagacagattctcagtgtattaggagagaaaaatcaataggaaatttaaaataaataattaactgtggccataggaggaaggagtctttggttggttctcaatttctgcatgagaaaaaaggtggactaaatcataaaaataagatgcagcaattggaagatgtaagaccatgcgtgcaattttggacatgtggaatctcaggtgtccatgaaccaacatcagctgggatattgaataggtatttgggaaaactggcccgtagttggaggagagttctagaatgaagaattattatccatgcatgataattaagtccatagacatgggcaacatcttgttcacaactaagatctttatcaagactctagctacctttgcaattcataatctatttgtaaaccactagtagtttactaatcaattgggcagtatctctccattcttcaggcttttaatcccagcatagaatcataagctattcatgctggaaggccttaaatgtaacctaattcaagcctttcatcttacacctacacttacatcttacttagtttccttactgaggtccaaataagtcacactcctctcctagggcacacagactaaccacctattctttaggcttctcttgtccccatacagaccttccttttttagctaacacagttctttaggagttattgttaatatgaaacca

SEQ ID NO: 12058 - DNA, 1092 bp, Homo sapiens
gacttaacagttttttttttgtttttgtttttgtttttttcaaaaatagccaacattgcgaaaatgtatagtatggtggcccatccattcaaccaatatttatttgaatctttatatgccaggcactagaattggaccttactggatatgtgctaggcataccatcttagagtttatcattttcatggagacaggttatttaatgagtgttatgaaagaagagactcatctttccttcacatcttaatatatcaaagtttcctgatttaaaaaatcttacctgttgcatggcaataagatatggatgtaatttgggaaaatagggactcagattttttgatggacagactaacagtaaatctcatggttcgttttgttttgttttaggagagaggtatgatcttcataacagacctattatatctcttttctgttttccaatttggggcttgatagtcttttgagaaaagtaatggctcaaactattcctagttctggtttgaattttaagccaacagtagttaaacaaactgtgattttagttttatcgcattattggcctggttttgcaaaatagacttctgacctttctttaatcctccccatccttcaactttgttctgttattttgaaggcttgctgtggctgctgctgctgctgcttgtaataataatcatagcataataactaacatgttatagcattaaaacatctttcggccgggcgctgtggctcacgcctgtaatcccagcactttgggaggccgaggctggcggatcacgaggtcaggagatcgagaccatcctggctaacacggtgaaaccccgtctctactaaaaatacaaaaaattagccgggcgaggtggcgggcgcctgtagtcccagctactccagaggctgaggcaggagaatggcgtgaaccccggggggcggagcctgcagtgagccgagatcgcgccactgcactccaaccagggcgacagcgagactccgtctcaaaaaaaaaaaatctttcaaatacattatgacatttaaaattcactgtaagcccgtaaggtgagtattttcactaagccctattttacaaaagac

SEQ ID NO: 12059 - DNA, 1049 bp, Homo sapiens
gatcttgccccataaggattttacctcctgctgagggtgtttctatggctgttttatgcaccatcattattgtctacccagttaaaccgtgctcttgacattgcttcgtttaatcttttcctgccactgttaactcacttgtcaatatgattaacattactgaaaatttgatattagctatgtaattatgaaaatttgatattagcaatgtaattacagtgttacaatgtaatgtatttaatatatatcttcttctaaatgcttattttcataaattttgttttataatatcatcctagaaatcttgtcccactgacttttctccttactattaggttgctatatgcacttttaattcttttaactgctgcattttatccatatgctttggtcatttctctgttggttttcctgaccttttcttgataaattgaaaatgtgtcttatgtattatatttataaatcttttgtagtcttttgttcctgaaactaagtctataacctgttaactttgtgatgacctttgttgatgtagtcaacaattttcccattataattcgtgcattttagatctttaataaattctgcttttcactgaagtcgtaaagatacttttgtacatttccttctattagtttatagttttatcttatatattcaggtattaaatttttccgatgtttttctgacttaggtagagaatcaagttctacacagcgagtccgtttttccatcactccttaataaatagtctatcattttccactggtttgatataccaaatgtatcatatcatgagtatgtatatatattaggttggtgcaaaagtaattgcagtttttgccattacttttagtggcaaaaaccacagttacctttgcaccaacctaatatatgggtttgattataacttgtagctttattcttctgcaccctttaacaggttaggcttttaattttctctccagtactctgagttccctctccttgtgtatgatacaatccggaaatttgctatggcacttgcagagctcacctcatttttacgt

SEQ ID NO: 12060 - DNA, 1028 bp, Homo sapiens
tatacaccattgaatactatgcagccataaaaaaggatgagttcatgtcctttgtagggacatggatgaagctggaaaccatcattctcagcaaactatcgcaaggacaaaaaaaccaaacaccacgtgttctcactcatagatgggaattgaacaatgagaacacttggacataagaaggggaacatcacacaccggggcctgttgtggggtgggggaaggagggagggaaagcattaggagatatacctaatgtaaatgacgagttaatgggtgcagcacaccaacatggcacatgtatacatatgtaacaaacctgcacgttgtgcacatgtaccctagaacttaaattataatgtagatatatatatatatatatatatatatatatatatatatatatatataccaaaaaaaaacaacaaaaataaaaaagaaagggcaggcttagagagtaaagtgtcagtaatgggaaagtgtgtatagacctcttctttcaaggaatgtagaagtgacggaattgtaggttggtagacttgggatagagggattgattggcaggcaaggaaggggaataatagtgtacaagatcccagaggaggagggagacctgacatgttcaacatagatggggttcagagaggaaagagtcaccatttttgctgagctacaaggaaaaaacaaacagaaataccgagaatctttgtgttggaagggaggtgatatgtttggctgtgtctctacccaaacctcatcttgaattgtagttcccataatccccatgcatcttgggagggacctgatgggaggtaattgaatcatggaggcagttacctccatgttgttctcgtgatagtcagtgagttttcatgagatctgatggtttaataaggggctctcccgccgcaccaccccacaccacccttcactctgcatatctccttgctgccaccatgttaagaaggacatgtttgctttcccttctgccatgattgtaagtttcctgaggcctcccaaaccatgctgaa

SEQ ID NO: 12061 - DNA, 1086 bp, Homo sapiens
taccatcaccgtttcatttttttttaaaaagatagtagaatataatcttgaaatgaaggacaatactttcaaacaaagaatattaggcaacttcatactgacacacaagaaaaaataataggatggtgagtgggacatatttttattgccctgaattgatgctgtggatgggtgggggtccaaagcagcagaggacaaaggggctggtaagtagcctgtattctaaagagagcacccatgtgggaagagaggggtcttcctcacatcccaaaccaaccaatacagatcaagaaaatcattggtaaacatgagagggacctgcttgactgggagaggctaacatcccattgcctagctagacatgcacttatgaggcgtccttgctaatctgcctcctgtgtctacttaagtaggaacactggagcatgatggcagcaggggagtggggtgaacacggaagatgatgggagcagagcactggagtggcctgaaaaactatcatgtggtagggctacgatgtcacttggagcccatttgagatgaaggaaaaagctttaacccagatataagattgaagttttaaagcaaatggacttacacaaattgaggaaaaggatttgagaactctgctatctatgagaaactgtgggcagttctacaaagcactgctgtgtgaagtaagtagagaaaaacacagtctttcatggttgaactccgtgaagttaagactgtataaggaacaagataactgtctgcaaatcagaggaaacttctctgtggaccagtacaggctcacagattgatttttaggaaagacctaatctggtccaagccttcactttacaggaggaaaatcagtgtttggcacacacttcagggggagagagagagctccgttgatgaaaaaaggagacttgaaccttgaagcctaggtttgagaatcgaatacaattgagactaatttgagtatgtgtttgtgtgagtttggaggtttgaaaagctctgattagagcttttgttgtagagagagttggcattgcttaaagtttctaaactgtgatcatataatgcatacataaagtatgg

SEQ ID NO: 12062 - DNA, 1060 bp, Homo sapiens
ctccagaggcttctagaattgataaacaacttcagcaaagttttaggatacaaaatcaatgtacaagtatcagtagcatttctatacatcaataacgttgaagccgagagccaaatcaagaatgcaatcccattcacaaaagccacaaaaataataaaatatctaggaatacagctatacagggaagtgaaatatctgtgcaatgagaattaccacacactgctaaaggaagttgaagagaacacaaacaaatggaaaaacattccatgttcatggataggaaaagttaatattgtttaaatggccatatgtccaactcagtttacagattcaatgctatttctacccaactacctatatcatttttcacagaattagaaaaaactattctaaaattcatatgcaaccaaaaaagagaatgcatagccaaaaccatcctaagctaaaagaacaaaagccagaggcatcatcctaccaacttcaaactatattacatggctacagtaaccaaaacagcatgatactggtacaaagacagacatatagaggagtggaacaggttagagaacccagaaataaagctgcacactgacaaccatctgatctttgacaaagtcgacaataacaagcaatggggaaaggattacctatttaataaatggtgtttgaagagctggttagccatatacaaaagtttgcagctggaccctttcctttcttcatatacaaaaatcaactcaagatagaacaaagacttaaacataaaacctaaaactgtaaaaagtctagaaggaagcctaggaaataccattctagatataggccatggcaaagattccatgatgaagactccaaaagcaattgcaacaaaaataaaaattgagaaataggatctagttaaactaaagagcttctacatagcaaaataaactagtgtgagtaaacagacaaccttcaaaatgggagaaagtatttgcaaactatgcatccaacaaaggtctaatatccagattctgtaaggaacttaaatcaacaagcaaaaatcaaacagccccagtaa

SEQ ID NO: 12063 - DNA, 1567 bp, Homo sapiens
agtgtcttaaaaacaataattgccttattgcattttaatatttaataaagtagattaaataaagatttgtattataacagttattcttttatccattgccaaagcaacccttttttgcctattaaaatctggctaaactgttctgatgttgtttcttaattcattaaacatgaaactaggttttacaaactaaattatataaagacagaagtctaaaaatggtaccagaaaatttttttttaaaaaattaatgtgttattcaaatatccagcaattaaagactcatgagaaaaacagaatagcatattagatgtaacagtttaaaatggattgcaaatcaatgtcagacttaaatagaaaatatttattatcacctcatttctaccaataatttcagatgtttaatgggactttgaaaagataggaaaaaatagaaatgaaaatttatctcacctttaatactgtgaatactatttggagggtccctggtcagacatttaaatatcaaacttaagaactgacatggagcctttgattagtttatatacaggatctgaatatttacacacatagcacactatagcaacctcttgtaaaaaatcatgaagatagaattcaacagtgtatattctattaaaaagtaaattggctgggtgtggtggctcatgcatgtaatcccagcactttgggaggccgaggcaggaggatcgcttgagcccaagagtttgagaccagcctaggtgacaaagtgagaccccatctctacaaaaaaattaaaaaattatccagatgtggtggtgtttgcctgcggtcctagctacacaggaagttgaggcaggaggattgcttgagtgcaagagtttgaggctgcagagagccaagattgcaccattgcactccagcctgggtgacagagcgagaccctgtctcaaaaaataaaggaaattggctttgactatgaaaaacagccattttcaacctttttataaaacctcttcagggaatattggaatattatttttgtcaggcaaaaataatccagggcttgagcattgctgtagaatatgttatctgttcaaaacttagcagagcacgcatgcatcacatgcattgtcatcagtatttgagagctgaaccaatggtttttgatggttgccgtaacagaagatctgtgaagaggatggtggtttgcacctgttcctgaagtcaaactggaaaaggttgcaggtatttcaattttctcaatcattttgcataaatgtattaatattttgagtagtaatagttctaaacctgcaggaaggcatcattgtatactgtggtatgtagagaatactactcttacactgctctttatcttaaaatgttttggtatactgtgaatattttcctctaagtatttggtgtattttgacagttattaaaggagaatataaaattaaagattctggtctaaactaagaataatggaaagttgcttcgtcctgccttagaggagttttcagttcatcctcttcttgagaaactatgtgttgctgttactaaataaacatttactcaataaacg

SEQ ID NO: 12064 - DNA, 1026 bp, Homo sapiens
aagtaagctgcatgttaaaaattgagctgtgtaaggtagaggaaaaatagtgaaaactttgggattttaatctgtgtgtgcgtgtttgtgtgtgagagagagtgagaaatgtagtgtttcattttgtatgcattaaactgtcttgccaaaactcagatctaagattgttaaatagatatttggggaatttttttttaatcactttaaatgaaaaacgtcagctttactgggcattctggaagcaaaatatattatgctgatggtaaagtgagaaccttaagagtatactcatgatggtggaaagtgtgatggaccaaaatgcataagctatatacttcctgtgagtagtaattttagttacaatggagtagaaaaatatggtccatttaaacttgtcttctacctcataacggccttgcaagatacttttgaagaagcaaatgtctagagccttactttaagtaagttaaacaacttaagtggatgatttggaataagattgttacatccagctgtagaaaatgtggttttaattgggttgatgtgcatttttgaatatcacctaagacagttaatttttttaaatcttgagaaattacttctttggcattcttgacctgttagctaatataactatagattctgaatacttagcatatactatgctggggcacatatcttattttaccaacaatatgattatctatatggttatcttctttttctccctgatattttaatgctcaagtagaaaatggaaaatcatgaaggaaaaatacaacctgtgaaaattgtggcagttagctttgtgaagacacagtgacctctgtggagacatggaatatgcagaaagagatggttagtacagttgttctgtcgtctgcagttcagtcagggacaaattgagagaggaaagtttaagcagggtgcattagaagttgataaccagtccagcattcttagaacagatgggtttagagaacacgagttgtagttccttggcagaatgccatggtgaatataaga

SEQ ID NO: 12065 - DNA, 1078 bp, Homo sapiens
agtattattgccagagtggtttttaaaaggtgggacgcgggtgtggtgtgtggtaaagctcttcttttagccagtccaccttttattagtttcaccgagatactcgtagggcttttggttgtcttcttaaccagtatttcagtcttctctgcccttgcgcatgttctccaggattcccccggagatttaccatggctgtctttctttaatgggagataatagttctgtttaatttattgaaaatatttgttaaacatctaatttctgtgagacgttaaatggagatcgttcatattaaactgattgaagaagtttggaaaataattgaacttacatatgtacctttgccttttaaattttttattttttaaaattttctttctctagtgttcttttgaagatgacaacatccgttccttattaaaacctttagaactggaactacaaaaaacagtgcatacatactgtggaaaaatttacaaaatatttatcaaacaactagcaaaaagtgtaagagatcgttatgccagatcaccaaaggaaaagtgattcttggtgactgcttaatcaaatggatgaaaacaaagaatcagaagataagtgtgaaggaatcgtcttggatgaagtattcaggaaggaattactcatctccagaataattttttttttcctaaagaagttaagtaagcagtattttcaggtaatgaagaataagttaaaatcttgggcctcaacattgaacattttttatctctgatgttttgtaatgttacttgctatcattccagtattgatgaaaatactattgaatgggtttaacctgcagacttctgttgactcatactctcaagagtggtaggggtgtgtagatggagaaaatgtacctcaaacagtgccaacactcaagactgtgagtagagcaataattttatgtcagcactaacctcactttaaaagtgtgagaaaaaagtttgtttacaggagcagaaacaggtctgttgtttctgaagaaatgtgatgtaactgatgtaaccattgacaatctatgtgtgcctttatacatttcatctctgtttta

SEQ ID NO: 12066 - DNA, 1177 bp, Homo sapiens
aagatacgaaaatgttaatagtggtgggtaatttgtttcttaggctttaaaaaattttctaaacggtacttaataaaatgtattgattgaagtattcgtagaaacacaaattttcaaaatttaatcatttttaagttggagtaaacaggattatcataagagaaatgatcagtactgcgataaaaaaatttcaagctgactctagttattccttgatacacaatgtttctcattcaggtctgattttaagacttatctgcggatattggtgaaaaattcagctttttaggccacttctctggggagtcttgattaactgggtatgggataggatcctatatctgtatttttaacaagtgacctgaggaccaggcaggtttggaaaacaacacataactgatttgttttgtaacttaaagtacaagttgaggctgcaaatggtattgttaaatatatataattttaattaattttatagaaaaattgaatttgtttttgagatttctatttccatgtttcactgttgtagagtttgacaggggatatggaataacctgattagttatcgtcttcgtagaacaaaggtacacattaggtgttgattgtaaataaattgtgcatttgttgaaataaagctgtgctatcatctgtatctgaaagacggagatcatacctaccttaaaacgtttctagtgagtctaaatgggtgtgaaagtgcttgaatctgaaaataactctgttagttgttattaccatcaatgagtctgactgtgtggtatgaaatcaaagacttaagaaaatacatagccatgcctgagagggtacaaacacagattttctaatcaagtcataagttttaccgatacatacacattttcttctctttctggttcagccttttaaatgaagatatgtagccttttgtgctatgctagaatgtggtgtccctttagaggaaaacaaagttataatgtaacttttttctgttggttaagaaattccaaccttgttctttatgcagtagtatacacaattacttaggcagcattttaaaaaccaccagtgccagaccgtttctagagattctgatttaataggtcttgtgtggcaccctctaccagggctaagaacccctgccttagactgttgccatttgtgagagatgtgatcagatttt

SEQ ID NO: 12067 - DNA, 1035 bp, Homo sapiens
gtttcactgtgttagccaggatggtctcgatctcctgactttgtgatccttctgcctcggcctcccaaagtgctgggattacaggcgtgagccactgcgcctggcctaatttttgtatttttagtagagatgaggtttcaccatgttggtcaggctcatctcgtatcactgactctttggtaagttttgcatagttttcactgaagcctcctatcttggacattttgaaatgaaaattactttttctagtttaacttaaaagtacaaccaggcatggtggctcgtacctgtaatcctagcagggaggcaaaggtgggtggattgcttgaacccagaagttctagaccagccttggcaaaacactctctcaacaacaacaaaaatacaaaaaattacctgggcatagtggtgtgcgcctgtggtcccagctactccagaggttgaggtgggaggattgcttgagcccaggaggttgaggctgcaatgaaccgtgttcgcaccactgaactccagcctgggcgacttgtgtgtgtgtgtgtttgtttgtatgtatgtatgtatgtatgtatgtatgtatgtataaaaaacctcctgtaattggttttaagtaaacttcaagtttgacaaatgttattatgccgagtgttgttttatcacatgtaaatacatgtaaccacccccaaaattaggattaggatacagaattgtttcatcaccgcaaaggtaccttgtgctaccccttggtcagttgtagacaagctacctagagctagatgctttatgccttattaaacttgaggatgagccatagtaacattttatttcagtttgatccacagtgaaaaagttcccttttaggacttcagtgcttttgaatgtcagtatgggtatagtgaagacatacccacctaactcatattaatgctttgcctcattaaaattatttaatagagttacctctttgaatgttggatgtttaatattctgctttcaacagttttaagcaactaatagccagaacctggataactacct

SEQ ID NO: 12068 - DNA, 1062 bp, Homo sapiens
ttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctcattctttagtgttgttaaatgaaaaattaaaatttgtgtttattataagatactttcaatggaataccagctaaccagatatgttcctttaaaacatgaatttttttgtcttattctgtttttaacatgtttcaaatgttttatacatttttggagatagtaaaaatttaaaaatgtaatagggaaaatatttaatttttaagtcaaaaactatgctttaaaggaattacatcttatgatcaaataactttcaggatgtattttaaatgagctgcaagagagaaaaatctgacaggagatgg

SEQ ID NO: 12069 - DNA, 1033 bp, Homo sapiens
ggctgtaaatacatatttgatagtcatttgtacacatgatttgagttgaagctgtaggagtgggtaagacagatcagggagggaatagattgcctaccatgagaaaagagacctaggagagacttttgaggaacatctttatttttttacagtggtagaagaagagcatcccacaaagaagaagaaagaaatggagaaggaaaaaaaaattaatagggagtaagaaacccaggagagtgtaacaatacagaaacagagggaagaggatattttcaaaaagaggggggtgtgtttagccatctccaatggcttttactttcatcagacagaatcttaatttttctctcaagttccatgtagtatttgttttaataagtatggcatttagatttgtatttttaagttgtaacaagataatacttttgcgtagtgattgtcctcagcttttcatgttacaataattctggtttatatttatagactaaataaaggaggttaatattggtaggtaggaagataagtaaaattatgttagtaactaactttgtttcccaaggatataattatctagtaatatctatctttaagtctatgcctctaacaatgactttagattataactacaaaatgtgatagaattaacaacaaaaaatcccaaaacattgggtacttgttggtgtcaagaatttaagtggtaagtaaatgtacagtagctttatttatttatttatttatttatttatttatttatttatttatttattttttgagctggaatctcgctctgtcgcctaggctgctggagtgcagtggcgcaatctgggctcactgcaacctctgcctcctggtttcaagtgattctcctgcctcagcctcccgagtagctaggactacaggtgcaatcatgcctggctaatgttttttggtgtttttagtagagacagggtttcgccatgttggccaggctgtcttgaactcctgacctcaagtgatctgcctgcctcagcctcccaaagtgctgggattataggtg

SEQ ID NO: 12070 - DNA, 1049 bp, Homo sapiens
acttcagcaggtattctttttatttcctttatagtgtgaggcctgataactaatatcctagttgtttaactcagtggcccaatctcactcatctgttgatgtcgcctccaaagtatttgatgttcttggccctttttaaattgaaactctacttccttcatgtctctaagactcctttttcatagatttctgtgtatatctctgaaacccatttctgcctccccaaacttggcatctgtatattctttactttgtatgtggcataaactcctttctggaacctcagctagaaactgtcattgtctcagctttgattctaatttgtagtcctccttcatgtcctttctctggattgtctcttaaatctatcctttttccttttatgtagttacagttcagaagcccatatcacttctgtcatgaactattggacaaattggtctctcctttggaatgctactaacatgatcttcattatcttttttgaaacctatgtgattatgttggtccctgtatatttaaaaaaaaaattgagtcctattagtggctgctgaataaaggctgagatccttaggatagtgttcaaggccataataataatctatccctaaactaccttcctagcttcatttcctgctgcttatcccaatcctgtgctgtgtcagcactgaattatttttatcatatggtactttttctttctctttctttctttcttctctttcttctctttcttctctttcttttctttcttgaaggagtcttgctctgtcgccaggctggagtgcagtagcgcgatcttggctcactgcaatctccgcctcccagatttgagcgattctcctgcctcagcctcctgagtagctgggattacagacgtgtgccaccatacctagctaatttttttatttttagtagagacagggtttcaccatgttggccaggatggtctccatctcctgacctcgtgatccgcctgcctcagcctcccaaaatgctgtgattgcaggcgtaagccaccatatggtacttttcaaagaagccctcta

SEQ ID NO: 12071 - DNA, 1035 bp, Homo sapiens
atgttacattttgttagaggatattataacagtcctttaggtttctcataggtgttattttagagagctataaaaaagatttcacatagtagaaagagtgctagatgttacactagtatgattttggtaacctgggttcatatctcatttcatatcaaccatttcaatattcagcattcagcaaatgtttattgagcatcttatttaagggctgagttggatactagacatacagtggtgagcaaaatggatttttttgtttctttaaaattttacagttttgcaaattagaaccgctttaactgtaccaagctctatatgtgaggtttagtgttagtagatctttcctttatgtgtaggctgaagaggtggaacttcttcattaaaaatatatgttgtttataactgaacacagtattattattatggttaggtaaaaagagtgagttatttcagcttcttttaaaagtaagctataaaatccacattctgaaagaagcttaaaccaactatcatctggtagaaatcttttcagcatcgttgttttcttgtcatacttgctttatgtcttcaaatttgaggtttggcactgattcttctagacttttggtgtaggaatgggagaaaaaaattgaggaccatctacataagtcctttttaaagaaatgcatggttcctgagccgcctcctgtctatctgaggagcctttctagcaaccatttagttgttcagagactccttattctaggagatttcttacttgtttgttttttgtcctgtaagaggactcacactggttaattgtatatgggtaaattttacaagtgattattagtgtttgtgtagtctggatatcagagtggttttcaaagtgtagtctgagggacactgagagtccctgagatctttttagttgaagctttctatgaggttcacactgtttttataataatttgaagatgttatttgcctttttcactgtgatggtgcagaggcagtgatgggtaaaactgccagcaccttagcatgaatcaa

SEQ ID NO: 12072 - DNA, 2031 bp, Homo sapiens
tccattagaaactaaactataacaataagcatactaatcttactgttgctttaaaaaagaaggcacatgtaatattgacatatacaaatattcagtagacgttagatttctaaaaaatgagatcttgattttttaaaaaacactttacagaattttattaagtttaaaatttagagacaggaatggttgacagtaacttatctgaaaaatttctcagtgaagctcgctggttttgacatgcttgttttttgtaaatcatcatatgctttttgtatattcccacaattgataaaatatttcgtacatttttcatattcaaaaagcaaactttcaaacgtatgctaaatttaagggattacaacagaacattccaaaaagaaaaaaagtatttgctaaaatgattgtggttactatttttggacccgtgatttgtgatttaagtattttgaaaagcagagtatcttcttggctgtgtaaggttggagttggtttagagtatatttgtgtatctgtgttagtactttgtgctttttaaaatgctcaataagcaatttttagaaaattcgttttttggaggcaggaacattaaagtggaaacaattataatcttgatctctggtactatatattattgctttttgttgttccctctctattttcttgtagccattagaaaaatactgaaactagaagagcctatatgtttatttgcagggacagcaaggaaggggggaagctggtgtcctactccacagccagtcttggggttagaggaaccctgagaaatagagtaggtggtggcagctcagaagagaagaaacaggctgaatacctggcacctggaagaagaaggaatatagtacacaggggagttggcccaggacagagaagtgggcctagtttaaaagaggcttgaggcccacatgggggcccctgacattttttttttttaccagtacatctaagctcttgtagatccaatttttagtggtggaaacattacttgaggaggactcagagaagcattgtcatttggattgaaactgaagaggctctgggcaactcaccagaaatctaagggacactgtgttcctgaaagtaagtgttctacaccacgaccctctcagcttcttccttcctctctctgaattctcttctcttttgattttggctctaagttaaacctaagagctctaatttctctgttatctgttattttcctagtggtttctgaaattcagggtagaatctgtgtttgtatagaacagtgtggaacagggtattgttactagagaagatattgattgcatcacagaatattaatatttttcctctctggtaatgttaaaaaaacaagattaaaggactgcagaacggtgttgagaagcaaaagtttcagtagttggaagaaataattctccataattgacttattaatgaacagggtaatttccagagtaaggttggcaagtactaaagccaagactggatagctgcagagcagaaggatgcagtttgctaatgatttgtttgtgtgacgcacagatgggatttgaatcctttgggtcagactgacctttgaactgattctgcctcattgccaaatgttaggccaagtctaagccattctagacatttgaaaaacttttttctttttagacctgcagagaagattgagtccttgttctacctttgaagtcttctttttttcttttttcttttttgagataagatctcattctgttgcccaggctgggttgcagtggcatcatccaggctcactgcagcctcgaactcccaggttcaaggaatcctcccacctcagcctcccaagtagctgaaactacagatgcacaccaccatgtgtggctaattttcttattttttgtagagatgggggatctctatgttgcctaggctagtctcaaactcttgagctcaagtgatcctcctaccttggcctcccaaagaactgggattataggaatgagccaccattcggcccctttaaagtctttattggcaatataa

SEQ ID NO: 12073 - DNA, 1032 bp, Homo sapiens
ttcatattatgtgcttaaataagtacatcatataccttatattaggaaatggtgctattatctacctcttttcccttgccagaaacatgggagtcacagtagatttgtccttttaaatctctgatgtaattttttttttctgttaccacagaaggtatctctatcaaagtattgtatgatagttggtttgttggtctgtctctaccactaaactgtaagatttctcctgagggtaaaaactactgttagtgcttagcacatgggcttgaggctaacagagtgactgagtgaccgaatgaatgaacacacacaatgtactcttttagaaactacttttcccatttttttggtctgtctttcccattgaatataaaggtatatctatcaatcaacatattgagctgggcacatatggattacagagacagccttaaaggagtttacattaaaatagatgagatgaggcattgtttatgaataacacaattcagcagagactagcataacggaggagaaattatatccagttgaagctattagaaactgacacattgacctgaaccccgaaagaatgaggaaaattttaatgagcagtgattcagaggtggaagaagatagaagctgtatgaacaaaggcacaaatttggggaaatacaggccatgctactggagcattgagtggtttcttttgggtagacttcatagtgtgtgcgtgggaaggagcagtgaaagatgaaggagatgggagccaaatcatcaaggatactgacagtgggacaaagaataggcaacttacagaaccaaagatttttgaacaaaggaatggtgtgattttatttattccttaagtagaagactacttaaggatatgagaaaattataagagaaaaaattaccataaaggaaccaataagaatagactgttaaaacagtaatgcccctatggacaagaaaaaagcagtggaattggaaaagaggcaacagatgagagatcattaattgaggatgatgtagaaagccaatacttctttt

SEQ ID NO: 12074 - DNA, 1049 bp, Homo sapiens
aaagtaacagaagagagagccaagtataaagttccaccaacatgttaatggtgggcagaggaagaagactgatagaaatggatttttcattataaaagcttattttatgaggttttgttttgttttttaaataaagcagtctaaggatttgccttctcaaacagggattgcttaataggaataacaaggtagtggtgagggtagaattggaaaagtgctgctccataagattgacatttgaagcacaggtgtatctggcactatgatggagttgatagttgccatgggtatacctcaggaacacagcagctgtccagtatgtatgccttagatctaccacatgtgtagagtgagtttttttctctgtatttactccattgtcaaatttagaaacagacagatacatgtgactccaacaacagtaagtatattattctagtaaccaaaaaaaactttttcctagggcctgtcttatagactgaaggctgaaattattcataaactgtaacaaagaatttggtcaatgtctgcaacctaaaaatttgatgttttatgattttaaaataaattgtaaatatttggtcttttgtttcagatattttccaagtatggcaaagttgtaaagtaagtattcacattaaattttgtaacttcatttaaaagtttatctgaatttgcttctacatttttttaatgacagatttttaaaaataaaacatgcttgatataataaagaaaatactattaacatttttatgacaatttagttggttttccatgtacataaacatgtagacaatttttcttaaagactattacatacatacaattttcttttcttttttaatttgacataccataaatgtctttccatgtgctataaagatacatcctcatagctaatggtaaacaaatattttggttactaggaagtgtgttatcaagtatactataagtaacctactttcaaataaataggtggttttttgttttgttttttttcatataaatagtgtaaaaacaaatatttcagtgcatctgacttgcag

SEQ ID NO: 12075 - DNA, 1063 bp, Homo sapiens
atatttattttcttttatttcttttctttctttcttgttaaatagacaggttctcactctgttgcccaggctggagtgcagtggcacaatcatagcttactgcagcctcaaactattgggctcaagcaatcctcctgcctcgacctccccaatagctgggactagagggtgtgtaaccatatccagcttgcacctgcatttcagagttctgcttcctactctgttggctgcctgcccctaaggaagagcaaactcattctaaccactgggattctcaaacaattttctcaatggtcataaaatttaggatctttctgaccacctttctgctattttggctaacactggcctttgttgaccctcatatcagtttcctctatactgactctgatccacaccaggtctgttctgtttgaaaaatccaactcaaaatagcttctctgagaaaaggaaatgtgttggttcattcagttgaaaagtccaggactaaatcttgtgctagcgtggtggaatctatatgttttgtgattcctaaggactgtcatctcttcttcttcagcatgtctttctcttgtgctggcttcattgtcaggcaatattgtccaagatggagcaggtgtgcacaccagcagctgtaagtttgtatcttcctcaataattcaggaaagttccagaattgagctgatgtgccatcagtcatataccatatctgaaccagttactggccatgggtatggaatgttccagttggctaggtttacagggtcatgtgtcccaccctaaacccgagggtgggttctgccccaccaaaactgtcacaaactgagagtggatgagagatggtgtcccagagaaaaattatttttattagagaaaaggaaaataaatgtcaggaagtcaaaaaccatacatatctactgcagcacactatacatattttctttgtccttactccatggctttagacaagaatgatttgtattttgttcataggtaggtttatctttctaggaaaataaatctgtttctttggggttttttttagtatcccctttcaaaaaac

SEQ ID NO: 12076 - DNA, 1024 bp, Homo sapiens
ccccagatcactatccaacagaaccttctgcaatgatggagaccatctatttttttttgctgcctagtatgaagctactagctgttgagcaacttgataggtagctagtgaagctgaggaactggattcttatttctaaatctaaatttaaatagccacatggacctaatggctactatattggacaatgaaagagaagaaagagcactggatatatatatttagagacagggtctccctatgttgcccaggttggtctcgaattcctgagctcaatcgatcctgtctcctcaacctcccaaagtgctgggaatacagatgtgagccacacccagccaggagcactagattaagagtcaagagatttaatacttctcccaacagacactctttggatgaccttgggaaagtgtttttaacttccctttgcctcagttttgttatctataggtgataggtttcattgcattatgtcattgttttatttcagtattactgttacacgattgtttggttgaaagaatgcttctttgaacaagtgagtcctgagatggacatgccattttgggagtgtatcttgggcagagtccccaaagcacaggaagggataaaagttgaatttaccaagtagtggttccacaaaggaggagagcgtagtttgctaatcagcacatatgaaatattcagaaaatgtcttgttttccactaaatctccaaggcttcaatcactgtctggtacacagtaaacactcattaaatatttgttgaatgattgaatcaaagtgatggttaaatattcagtaaaacagagttggtattcaagcctgtttgatatggtcaatattactgcgttttgtttggtttgggtttttgttccctggcagatttgtttaagaatagtctcagatgaccaggcatggtggctcatgcctataataccagcactttgggagacagaggcaggatggtcgcttgagcccaggagttcgagaccagcctgggcaacatggcaagaccctgtctc

SEQ ID NO: 12077 - DNA, 1492 bp, Homo sapiens
ttatgcctgaattacagaaaataatatggattgtatttagcaactgagtgaggtggtaaatgtttgcttaccttcaaagtggaattaagagatacataatgttacagacctaacctcaggctacttgtaaagaaaatcaaatttggtgattaaatagtgaaaggcataattctttttactctctgggcccttagaataatagaaggtttatatgcacttgggttaggagtgaggttattgctaatgctgaacaaccaagtggtatataaagaaaatgctatgcagaaataatggccattctagaaggattctagggggatgcttttttaacagctattttttactgttacctttattaattgttaaaatatttagaatgtattataccttacaaatacccatttgttctatctcaaaattttgtgttaagctataaaaagccataatgagaacattttcaactctgagctctgtgtcatttgaaactcaacaaaacattgaaataatgatctttgtgttcccttataagaaaaagctaattatgggtatgtaatactcaggtaaatatatgttgtgaaaggttttaaattttaaaggtgggaataagaaaagcaatgaaaagaaacattgctaaactgattttatactcttacataaagattattgtttttcgcatctataaccacaataatactatttaaccccaaaatagttgggccaagtctattccattttcctctgtagtctaacagaaattactgctttttgctttgttttgtttttgagatggagtttcgctcttgtcacccagactggagtgcaatggcgtgatctcgactcactacaacctctgcctcccaggatcaagtgattctcctgtctcagcctcccaagtaactgggattacaggcgtgcaccaccatacctggctaattttttgtatttttagtggagacagggtttcaccatgttgcccagtctggtctcgagctcctgacctcaggtgatccaccctcctcggcctcccaaagcgctaggattacagggatgagccactgcgcccggcctgagaatttatgtattttaaaggagtttgaagaattttgatagctacccacccaaagcaacacttaaatgaaccatcccatctaagtgtccatattgcactacctagtgaggtactcgtgtaagaaaaaaaaaaaaaataagttctagtccattttgttttatttaaactagaggaattttcatcttgttgcccagtaccttagggaaagagttggtgaagagaacgtgagcctcggttttagtgggaaagttctgtgttttataaccttcaccacgaagagaattgggctttgctggcattagcaaattcactcctttattctcttgggtttggttaaaagtccttttttaaacttgaaacttcctttttttctagcaagaatttgcctcacctcttgtgatgcttttcttcctcacaggtttc

SEQ ID NO: 12078 - DNA, 1068 bp, Homo sapiens
ctcaatctgctggacattttgttaaggtatgttgatcccccatgagcccagtttagttccattgtgaataattatttaaaatagtaatattaaataatcatctctttgcccctcatatgttttattttctgcaccctgaactttgaggtccttgaggaaaacaactgcagtattaagagtttctattttagaaccaagcatatgatagtggctcaaaaactttttctttgatgagcagattaaatgtttctcaattgaaaagccaagtttaggacaccagaccctgatgactgtattaaccccagtgagagtcactgtccacttctttatctctggtgcctggcttgaaatagcacaaaatgtttgatgaatggaaggagggtggaagggagagagaaagagagaaatttaattaaagattcagagtttaagaatgattttacacacattctcatttaatcctaataacaaacctgtaggtcaattgtctcattttataaatgaagaaacaggttccaaatggttgagagaatccctgtggtcacacagttattgaacattagcagccagcagagaatgcagatgttcttacgcaggtctggtccactctaccagcttgcttgaggcccacatttggagtactctctgtctcacagccacttccccctccaatttctgtttgccatcatccatcctcaaaccctctccaccgtgtgtatccttctaggttagtagcttcagcaaccaccgagttattcaacctagaaaactggatgttatccttaactcctgttctcattttcacattcattcaaccacaggtcccatctaatttgcctcctggacatttctggaaccagcttcccccttccctccattctttcgtcccattcaataacccacctaaatccaggcttctggcctcttccacaaagcagagtgatccgtccaaaatgaggatctcatgataccacacctttgatccaaatgtgcttctactaagagccctccacagcccgctctgcactccttcacaaacctcctgccagtctctccctggcctttgac

SEQ ID NO: 12079 - DNA, 1048 bp, Homo sapiens
cacttgttgacacacagtgattaaaactgtgtttaaaatgtgcgtgcccattgaccaaactggatttaattttgggaggcttagagagggtttgctggaaaataaaaataacataacattcattttagttgcattcctaatattttcaataaccctaataactttcttatcttccaaactccccagataaatgctggtgtaactatgcagtatgtagtgaaactcttcctataattaatctttgataacacatgttggcatatgtcaccatacctactggcctagatgttccttttagtagcattgtaattaattaaatcactcacttttcagcaaatccttaggacctcaggtcttgttcacattctaattaggctgcacccaaagttataagcagccaccgggaagcattactatctgtattatatctgagattaagtttttgaattgttcagatgaacacagcagtgagccatgatgtgtctcccagaagattcataagtgactatgaagtactgtaccaataggaagaactaataaatttgacattaataatcgccagtttgaatctgggtcacttcagccatgactcaaagatcaaacgctatcagatggtaatgactgtgtgaaaattctgcaggaaggcatttcatttcttaatgacacctttgtgggccttctcagcagactgttagagggtggaacagaaataaagtcgaatatgccccttggtctggaggctagcgctccagggtatggttgacacacttttgcagagatgctttaggagcagttcacagtgttttctgttgttctctctccttaaatggatctacagaacctttcatcttttgcctcttttcctaaccatttattcacttcaaagtgatgggggctgttttgcatattctctgccttcttttctcttctctgaaaagtaaggagaaattgcacttacaaatgcatgttaaccatttaatgttaagctttcccatttttatttcaatttggtggcatggttttcctttcaacacacctttactgagtg

SEQ ID NO: 12080 - DNA, 1846 bp, Homo sapiens
aattataagttttaaaagttgcatcataatttctctaaaatctcttataattacttgaaagcaaaatacaaagaattaagtattatgagtgattgtctataatactcatgaaatggaacaagaatctttacaaagtattttccagtaattaagtaactctcttaatggcctatacctatattttgggctctctaatatcatgggaaacaattttcagtaaagattatcattacttatattctacttactgcagttaatttcctggttaaaatagtttataaagagcaaatttttccttttaaagaaagacaggaaagctacatgtagtggtgcttggctctatagccccagctactggggaggatcgcttgagcccaggagttcaagttcagcccagccaacattgttagaccccatctctggggaaaaaaaaaaaaaaaggtaattttaaaaaatcaaagtgattctcatctgtgaatagaaatgttaaaagtatcatttgactaggatagactcttcccccttggaaaaaatagctgtctctctcatctccatgttatgtaaaataataccaactgtttaacccttattagtgagagaatattaagattgcctaaatctatgtatgattattccacaataaagagaaggagttaggaaagtgaaaggattgtgtttctgggttgcttggttggtcgattggtgttttaagggaccattacttctttttcttctggtcacagaagaaaggattattggattgcacaataatatctttagaaggttggtgtgagcaagcaagttgagagagggaagtacagtaatctgggcaccaagtcctgcattgttgcagttcctcgaaacctcatgcagcctatggagccagcgctccacagcacgttccaaggaccaagatggcattgaggaatctggagcagccccaagcctctgacttccccatctctggacacacagaaatgtagcgcttcatctgccccagtaactggtaatcacatccccttgtttatggtcatgctgaactgaagtggaggttaattacctacgtgttgatgaatgaacattttggagcagtgaaaaaagcctggcctaaaattgtatggggaatctgagtaagctgctatttccccccacttcccctctctcctgaagcagggatggcgaaccagacaggctttacaggttggagcacgctgatgtcatgacacttctggcacagagatatgatagaataatcagatcacttttctgtatgccagaatgacacaatttttccaagaaccattcctgagccactggtccactggcattgactatttccagttgtggggggtggggagggtgatcaaacctctcagaatgtaataattcttcctgtgtctcagttttatgcacttgtttagactaaactctaaatgcattttggttatttttgaagggacctctccaggaacaagaatgattgcccagcctgaaccgattagacctttccagcttcattctcctataaagagagattttacatataaaataaaagtaaaaatgtcagccaggcagaagccaatgtaaacattttaaaatgtaagctgcaaactagcaagcagctatcatttgcctttacttaactttcttctcccctaagtttggtcctaagtgagcctaaaagtcaactgaccaattcaacagcagttgcatttttctcactggtagatttggggtaaactcttgggagagatgcctttcatttctagtggattacacttcagaaaaaaaaaaaaaagttagggctgtgttatttcagttgttctggtactgaagtcatggactc

SEQ ID NO: 12081 - DNA, 1084 bp, Homo sapiens
tcgcctgtcacctactggcgtccggagggagggtaccgattctctcctctagcgctggggaaaggggctggtggctttttggcagaggcgaatcaactcccaccactctccccaaccccctgccccgcgatggtgtttgctgaatgtagcacagatatagggaaaaaatgggagcgtcttcctctcttgaggtagaaaaagttgaagaaactaggcatgttaatagttattaggagcgggactcaggatgcagcagaaagctgttaaattttcattaccctctaagaaaaacaaacggcatcgccagtgactattggcagtgctgtgttattcttgggactttgggaaaattgttcacagattgtcttcaggaggctgaagaacgaggttgggggttgggagagagggaggacggctgcatcacgcttagttccagcttgcctaaggagggttcaggatcacaagccgaacgcgtttggttgctgatttttaaaagggtatcagcggcagaactgagaccatgaacaaggcaaacacaccacgggaaccagcctaaaggaaaaaaaaaaagcaccaacaactacaaccaaaaaaacatgtaaaaatctgcctctcctgcagagttaacatgcatttgtgctatcaaatggatgcatgtatatgtgtcttttaggataagttttatgaatgacaaatcactgaaatggtatcttgtatctgttcatgcatacagtgttgtctactgcctcgtcttaatcagtactttggaaggctgtgcctgcagttgatgttatataattgatgtggttcaccatcagacattttttaatgtactttaggagtagagggaacttccatctgtcttttcagacaggcccaaggtgtagactggtgagggttgctaatgtttgccgtagtccggctccagatgtgtgagctcagctgttgcctgtcacttaggtgacaactggccctttcccactaagcctttgctgtctccattatcctcagtgaagtgtcagtgttcagccgccttctattatcaggagtggactctagccccttgggagccggcagccttgtt

SEQ ID NO: 12082 - DNA, 1031 bp, Homo sapiens
tgatttttcccccttataatattacagttgggaatactaatggatccccaaacaatattactcattatgacctccaattcctactggaatgacaaggaatataaacaatgaaactcacaaattaaatatctttagacatactctacacttttttaacgttggcatcacagctcttgtagttaagctctgttattatatggctttactacttaattttggaagatgtgacatcctagagttgaaagattgccaagtcctccttcatccccaggaggcaacacagtaagagctcagtctggagtaaaaaagaacagaacttcaactatttttcactgctgctatgatctgaatatttgccaaccctacacctgaaaaaaaatatgcatgtgttgaaatcctaatccttgaggtgatggtattaggaggtagggactttaggagctgactaaatcatgagggtagagcactcattgttggaattagttctcttataaaagacactccagagatctagcttgttccttcacccatgtgacgacacagtgagaaggcacccttctacagatcagaaagtaggccctcaccagacactgacaccgccagcaccttgatcttgaaattcccagcctccagaactgtgagaaataaatttctgttgtttataagccatgagtttatggtattttgttatagcagccctaatagactaagataaaaaaaaattggtactgataatgaggtgctgctataacaaatatctaaaatacagaagtggttttggaactgggtaatgactagcagctggaagagctttgaaatgcatgctagaaaaagcctatagtgccacgaatggatcattaagggctattcttgtaaaagcccataaagagaagaggagagctttagagagagcctcaatctttgagaatacctaagtagttgcaaacagaatgttcttagaaatatggacagtaaaggccatgaagtctcagatagaaattgttattggacagtgtaggaaagtccatgct

SEQ ID NO: 12083 - DNA, 1035 bp, Homo sapiens
cctctctttttatcatatctttaaaattgcagttttctctttcttatcccttcttatctacacaaaacataaattctttgaagacaattttcaattgaagtgcataaagcttcaattgtgtcctagtgaaacttcctaaagttggaggccatacataatacaatatagcccatttctttttaggaaaactaagtaaacatttgcttccaattctcattctgcactctgaagtaagaatcaatcaaattcctcctctatagggcaaatatttgaagacagttgtttctctctgccttctgctttccagaaatccaagtctttcctcccctagaagtaatctctaatcctttcatctatatcttttgatatttaccctccatattgccaaataataggcttattcagctgtttctggatatatccaaacaaatttacctattgactcccttttatagaggttgagaattccaaattaattccaaatcaattttgattaagtcagcagtgctgtaatgtcagtgtggaaccaagtagtgtactgtactttgaaatgttgctcctttcttacacaactcttcatttttcctagggaggattgccttgttttaaaatttgcttagtttcgttatgttttaatcactgtttttttccttaagggcttgaacagctatgtaaaatctccatgaatggtttttctaaatgctcagatatttcctctgttttggactccttccagagacccctccaaccccagtctgcctcctctgatctggcacagatgaccttaaccctgctgtaccagtctctcatcctgtgttttggttttgataactttttcttacatcacatatgtttctctttttttggtttaccctctcatactaaaacacttcttcctgcctgtaccttccttaaaaatgaaaaaaaacgagaggtgcaattttccttctgtgcaaacctggaactgactttagtcaatccttatattggaataattgactagctataaaattctagcttgaagataatttccct

SEQ ID NO: 12084 - DNA, 1051 bp, Homo sapiens
aggatattgcccatgggaatttcttagttactaaaagattttttttaaagtattcactttttccatagttgctcataaaaatttgggattctcttaccttttcctgtattactgaaaaatatgctggggttctgtgttgtaagaatagaggccgtgatttctcatgatacccttggagctcccatggaaaatcagaaacccctacaaatgtatcctctgaaaaaagattctaaatgtacccctcagaactcctggtgtttctttgttatctgctaataaggacctgagtctagagttgcctctgttagtttgaccacatttaatttcctagtcatgccttgagaaatcattagaacattcaaggggaataataatttcaaatggagataatttttagtaaacgatcatctcttcagttccctttttgcatggttatatctcataatcatcaacaagctacacactttattttgtaagttgtttatgaagtcgggggataggatgaacagaatatctgaggacagtagaagtattgcggcaacatctgggtggcactatgtgctggttttcaaggctactaaccagtagaagacgatttttgcagagagtactatcttagatatttgttttcttcctgagaaactctttaggtgtctctagtatatgggtaagttgtttaatttaaaagattgtttaaatacaaattttagcaggcaaggatctgaattaagtggtttcagtgttccttctaaacttgagcttatacttgagttccccccaaattgtataggatctgctgccaacctgctaattacttaataattaagtcatgaagatgtgactgccctttaggaatgtttttattattctagttctgttgggcatcacttaggaagtatggacctaaaatagtatttagggtctttcatataaaatagatggatactgtagaatggtgagaattggggattcacgaagttcttgtgatattgtagccatagtcaatggtctagaatttagtgtggtattacctttacctaatctctatcca

SEQ ID NO: 12085 - DNA, 1030 bp, Homo sapiens
tatcaatttactttaaggtatcacttttttgtgtcccataagtttttattggtattttccatgtcattaaaaattctaaatgtatgtaaatcatatttaaattccatcatgatttatttgctgcttcatgaattacataaaaatgcatttaaatatttatgaatgtgtggagacttgttatttttatttattgacttacaacttaattttattgcagttagagaatgtgatctattgatattctttgcaatcttgatatttcctttatgatctattatgtagccaatttaagaaaatactccatgtatactttaaaagaatgtatattctttgagttctgtatttgtctattaaatcaaatttgctaattgtgtagttcaaatcaactatttatttactaattacattactaattgaaacatgaagtatatctctatcactttcttcatataattttacaattagttacctcgtctagcttaaggctaacttattagatacatagtttagtgaatagaaccttttacaactgtgtagtgactctctttatctctgataatgctttttaaagaaaaaatagagttggtgtgtctgagctgttgtcactcataataaatgtatgggttctttccacatcaacaaccagttcttcaactctccagacactaaatactctacaattcagttcatttctgatacttaactaccctgagtttgtgccagactccgcaggtttaagcgctcagtcctataaaaccgtccttacttcaggcaccagttgcaagtatgaggtgcccagggtacctacacatctgtctgagttagctgcaaagtcagggattctcacaacccactctttctaattcagtaatttactaaaataactcataggtttcagttttttcctgatttaacaggcaaatactcttattttcaaaatatatttttctagttaccaattctaggttgacagttattttctctcaatatcttgaatatatgattgtgttgtgcctgccttttgctattg

SEQ ID NO: 12086 - DNA, 1050 bp, Homo sapiens
ctggctctccacatgtaggcacaagcagcagccccagtgggaagcagaaggcagctccctggctgctggagtaatgttccggggaggagcacagctgcctctgctacacaaaagaatctacactgggaggtggcagtaagccccactcagctcccacactcttgcaaggcaagtcttacacccacagtgatctgctaacagcagctaactgggtttcaggcagcttgtttcagaactcgaaacttccccagactataagccttccctatggagatggagtgactttcacgccacaccctttcctgtctgcccatgaagcaaaggtgtccagctcctgcccccgtggtgacaacacacttcaggctcgctcctctggtctggccaacgaggttcgttcccacttgagattatattgcaaacctcatttgggagcttctctcaacctgtgaccactgcctgaattagctggccaacttttgcgaggttcgttgtgagaatggatcagaaatggctttcttccatccctgctggagactgggagtacacactgatgccgttccttctcatatattccccgctgctcactaaatcagctgcagcactgggtagggttaacgccttctccccatggcctggatttcctggcttcccagtgggagtgtgtgtcacggtggcaggctctccccaattcacccttgggaggctccattttccgtctggttcatgatgtaggctgttgcccattgcttccttcaaagggtctgtggtttctttccatttttcggttaagttcctgtgttgcttcttggaaaaaagttcacagtgtgagttccacacgctattttgtctttccgggtgggagaggcatgccaaaaatacctccagttagccatcttggagaaaaaaaataaaacaaaaaaatgacttttattttctattgttaaagtaaatgttttatgatgccggtccatagaaatgcaacagattatttggcttgttgatttttaaatgcagccacctgattcatcactttaattaattctcatagtt

SEQ ID NO: 12087 - DNA, 1056 bp, Homo sapiens
tttcatttataggggaaaaagagcttttataaatacctttgaggtttgtcttttaccttgtaatttgacttagaaaagcatccacttttaaactcacaggatcaaagtaactccaaaatcataattacaggtgtgctttttttttctccatggtagatgtattttaaaacattgcctgtaaaatgaatatataaattcaactgtaaattcacagctcctattttaaagtgagaaatactgcattgctaacagacctgcttgaaatcaccaatcagctgaccatcccagtcttaacttactgtcaaccccactggggctacctccactcttgccaaaacatgctaccaccagagccaaagtcatcactataggtacagatgacaaacctgtaaatatttgaggctgcacagctataacagtagtaaagatgctggattatgtatttatgctcatgctgaccctacagtgtcagcagctctaaagatgcttttggctctagttctggtagtagtccttttggcacaagagacattggtagcagtcatgttatatgttgtggtgaagcagctttgatagagtgagggctccggtagtgatacttctaacaaactgtaagcttcataaggtcagggcctttgtcctcttatctatatctgcttctctagccaacaaagcaatgagtagatactgaacatttctttattaaacaactgagggaagtagcacaccctggagcaattgctgccttgacttaggcagtggccaacaagaaggtgatctagggtttagaagcagatttcattgcacaggtagcccagatccagagtgggatatgcctctaattaagtaccaggcagaggcattggccatggaagacacccctactgcagtggcaacctctataatggctacaagaagagaatatgaattagcgaatgggatggcactttgatcatgaatcataaatgagcccatgcagagcccattcagagtgcctaacattctccaatcctggaaaattgaggaccaggttgtgactcatgacctcttctaggg

SEQ ID NO: 12088 - DNA, 1034 bp, Homo sapiens
aatgtctggtgcctagcaaattctcagtaaatttcagctagtattattacagttagtattactttactatgctccctgataaaatttttataataaaatggttaatgactttccattgaggtctgatctgacttagttttagcataaagtaattacaattcatatttttagaggtttttttttttgtagtagtagaaacaactatttctaaatctggggattcagtagttcattcaaattaggatctttaagagctgtctaggtcaatgttccttaacgttttctacctgggagtaatctttaagagaacaaaaagaaaatgaaactctatataatttaatgcaaagtcttttacattaatgtaagggtaggaaaagaggttggaggaagatatggggaggtaggaaaatgggacttttttcctccatttacttttgatgtttgaatttcaaacatgagtatatttgtgtattattttgcggttaaaaacactgaagattgcataaagatcaaagagggaaatttaagggaattaatgggttatgattgcatttgttcagaatggttttggtggctcatgacaacattttgagagagagagattttaatggcaccaatggcagctaggataactagtttaaagtttagggcctgtgttaatagattttgctttctagtttcagaaagattctcttatagtactgttttaatctgtttttctaagccctctgatttatgtatatttaataggccacaaaataatgtcaaatatatggcataataaccaacaaatatttgaataagtgaaaggtactctacaaaatgctatgggaaagacaaaaataaataatatccctttctttgagggattaacagtgttaatatcccttgttttcatttgatttgaaatgccacttgcaagtggaatatgcagactaaatggtaaagagaaaaacaagcagcatcttttcatttcacttacagctcactgtatgaccaataatatgttacttgacctctcagcactccattct

SEQ ID NO: 12089 - DNA, 1109 bp, Homo sapiens
aacctacccaaacatctcaaacctaccctttgctgaccttctatagccccatttccaaagttttgctttatttttattttttcttccaacttttattttaggtttaggggtacatgtgcaggtttgttacatgggtaaattgcattttgtgggagttctgcatacaaattatttaatcacccagataatgagcatagtacctgataggttgtttttctatcctcatctttctcccaccctccaccctcaagtaggccatggtgcctattgttcccttcttagagtccaagtgtactcaaagttcagctcccacttatgagtaagaacatttggtatttggttttctgttcctgcattaatttgcttacaataatggcctccagctacatccatgttgctggaaagacattattttgttcttttttatgactgtgtagtattatctggtatacatgtactacattttctttatccagtccactgtaatgggcatctaggttggttccatgtctttgctattgtcaatagtgctgtaatgaacataggcgtgcatggtctttatggtagaacaatttatattcctttgggtatataaccaataatgggattgctgggtcaaatggtatgtctgctttaagttctttgagaaatcttcaaactgctttccacagaggctgaactaatttatattcccatcagcagtgtatagcattcccttttctctgcagcctccccaacatctgttattttttgactttttaataacagccattctgactggtgtgagatggtatctcgttgtggttttgatttgcatttccctaatgattagtgatgttcagcattttttcatatgcttttggcccatggatgtcttcttttgagaagtgtctgttcatgtcctttcttccgtttttaatgggataattttttgcttgttaagttcttcatagattctggatatcagacctttgttcatgcatactttgaaaatattctctcccattctgtagattgtcagtttactctgttgatagtttctttggctgtgcagaagctatttagtttaattaggtcccacttgtcaatttttttttttttttagatgg

SEQ ID NO: 12090 - DNA, 1019 bp, Homo sapiens
cagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacaggtaatttaataaatcatcatccattttcttggataagcttagctaaatttaaaattgtgaaaatgaattgaacagacttggctagagagattggaaagaatatatgatttacctttagggagaggaattgctgataagcaatttaagcaactctaggaattcttatttattctgttacttactagaagatgataaaaccttttaaattacactgaatttaaaaattagccttactgataacctaggcatttatattagcctattcacaaatgtataaagttgaagcagttggttcgtgtttaataagttttattgaaggtaaatcttgatttcatattttggaagtcatctcaattaaaattaagtttttagagactagaagaatatatttactgtgcttgggaaagtgaagagatactctgtaatccaaaacaaattatatttccctacccaaggtagggaacctgaaaacttggtcctgctggtctttagacaagatgttctgaaactttagcatgcatataatcatcaaaagttcttgttaaaacagatttcagagctccattctcagtttctgattctggggctttcacagatttc

SEQ ID NO: 12091 - DNA, 1045 bp, Homo sapiens
ggcatcttggagattctagggcacagctgagttctacaagtctcaatcgaacagttctgtctctaggaatatgttaggggctggagatatgatgacaaaactttaaaatgccactaggggtctaagaaatggttgagtctgtcactgccagaatatgaactcagcttaataataagttagaaaagatgcaaataagttaaactgataatattcttcttggatatatactggctttttcctcatcagtgtgctttagcaaaggctagactatcaaaatcttttcaggtttccttttatagaaacaaagacactttcagtttttatcatattaaagtataatgcatttcaatcatcaaaagccaattttctgagagaaactatataatggaggatgtattttagagtcaggctagcctgagttttaatcctagctctaccatttactagctgtgtgattttggacatgatatttaagctttctgatcttcagtttctgaatctaaaacgtgtgactattaataggaatccaactgggaatgctgtgcggttgaaattagataatgtattttaaatgcctggcaaagtgtctgacacagagtacacacttaaggaatggagggatattatcatcatcacggttttaaaaacgatattaacattatctatgagttagctggttgagaaaagtaagagtgcagggaatcaaaagaataggatagaaggtttttcttctttgtacaacactatattgttttgataccttatatcaaaaactaattatgcatatctggcccttccctgcctatttatcctatttcatcaccacagttttcttccctaactgaaaattcttacccaaagctttttttcagtttcttaactacacaaaactctcctctgtgcgtttggccaccttttcatgcagtctccaggtctcggtttaaatatcacctcacagaacagtctaccctggacattgactaagtagctagtcttttattaatctcacacaaccacctagtgtatttccttttgtcttagtcag

SEQ ID NO: 12092 - DNA, 1045 bp, Homo sapiens
gtaataaaaattatgtgaatgtgatctctgtctctctctctatctctctctgtcaaaatgttttatcatacattttactcacttgtttgggccatggttgaccacaggtaactgaaactgtggaaagataaactgcagataaggaaagactaccgtatttaccatttctggtactcttcatttcttcttacatattggagtctccatctggttacattcccttcagcttgaataacactccttagcattttccttattgcaggtgtgctagtaacaagttctttcaactcttatttatctgaaagtgtctttatatttgaagaatattttcactggacatagaattcaggattgacagatttgtttccagaactttaaaggtgatattctattattttctagtttccattgtttctgatacagtgatcatttgtttttttattcccttgtatgcagtatttcttttttcccctactttttcctttcatgattctctatctttgtttttagtagtttgactatgatgcacttaggtctaattttttttttttttggtctttattttctttggtgtttgctgggctttttggatatctaagttgatgtcatttcaccaaacttgagaaaagttgagccatcgttttttcacatattttgtctgccacatttttttctctcatagttttctgagactccaattaaacattcgcttagatggtttaattatcctaaaggtcactaaagttctatttttatttcaatatttttgtctttgttttatggattggataatttctattgctttgtcttcaaatttactggctttttcttctgccatctctaatctgctattaggttcatccagtgaatcttttcatttcagatattgcatttttcagttccagaatttccacttaatttttagtagtttaatttctctgccaagttttaccatttattcattcattatgactgtatcttttaacatttttgagcatatttatgatagatactttccagtctttgctaattacaacatctggat

SEQ ID NO: 12093 - DNA, 1019 bp, Homo sapiens
ttcaatatgctagtcagtagccacatgtggctatttaaattttaattaattaaaattaaataatatgaaaattttaatttattagttacactagccacatttcaactgcacaatagccacatgtggctactggctgtcatattagatagcacactgtgtaaggccattcttgcattgctataaagaaatacttgagcttgggtaatttacaaagaaaaggggtttaattggcttacagttctgcagggtctataggaaacagtaccatggtctgcttcggggaaggcatttcacatggcaagagtgggaacgagagagagagagagagagagagagagagagagagagagagagagagagaaagtagttggtgggtaggtaccagacatttgtaaatgttgcctttatctatcaaaaactacaaacttgaagttgtgccagtggacctctgttctaacattagaatagataactcgatctaaggaaaaaatacctataaataagcaatattataataaagcttttaatatatgatcaggactttgcagatcaatggaggaagaaaacattatttcacaaataatggaatgactaaataacaatttgagggaaataacacacagttataaaaattatgttacatatcaaaacaaattccacatggaaaaagtgttaaatattaaaataaattaaaataaagaaaatataattaaatatttatcaaaactctagaagggagatactttttaaaatttatcagtgataaaatatacctgaaagaaaagattagtgcttctatagatacataaaattagcaaaaaaaaaaaaaaagtcacaactacatactagaaaaacagcttcagcagatttggtttctttgttagattaaaaacataaacattaataagaaaagcacttactgctgggtgcagaggctcatacctataatcccaactgctcagaaggcccacttgagcctaggcgttcaaggctgcagtcagccatgatcatgccactgc

SEQ ID NO: 12094 - DNA, 1032 bp, Homo sapiens
aataatagaatttctttcaaaggagagagagagagaaagaaagaaagagtcctttttttcttttttgagctatgcacgttttgctatgatttctctgctctcctcattttcttttttgtttgtttgcttattgtgcttattgtatacatgggtggctgtaatctacataccctgagtataaaattcttatggttaatattgatccagagttcctactaaataaagttgaaaacttagaagctgttttagaactgaatcaagagaaatgaagttctatagtcaaattattgtgcagtttatttatcttatcgtcatgggaccccaagaaaaaatatctatgtctaagggtaacaacttctcatattgcacatatgatgctgaaatgcttcaaaactcattttggtgtttcaataaaggtatttaccaaatatgaaatatcagcattgggcataaaattaattcattcatttgatcaatttatattggatgcctacgatgtggcaagaactcttctgaagactggagactccctaatgaacaagataacatcacttcccagacagagctttactttagaatgaggtagatggacaataaacctgtgaaaaaataagtaattgctttactggattcttaataagcattctcaactttcaccatataccatttcaacccagtcattgcagacctgagagctgagacagtatattagtgcaggctaattgctgactcatgcctgaattgtgtgctctgggtgacagaaccattcacactctgctaagccaagaaggcactactatgcataaaaatatataaagaggggagaataaaagctgaaactctttaacgattgccccatttactactctaccatctatagagaggaaatggttataagggctgtttaaagactgacctccatggtagattttcctctcactgctaagatggcttttgttcacacagctgttttaagaacttctttataagattctacctgccttttttctcttagtatataaagtatgtgct

SEQ ID NO: 12095 - DNA, 1057 bp, Homo sapiens
agcctgggcaatagagccagacccagtctcaaataaataaataaataaatatatagaagtgtatttgagccatgatgggggaactgtatcacttgtacctttaaacactttaagcattttctaaaacacttagtgttcatttcgtatgtttcctagtgttggtttttctagaattaagctcctctatagagtgaaaatttcataaagaaatataatgtcataaatctttgttttttattaataattcacacagttcatgacatatggtaaatgtctaatttgtagtttcttttatttattcattggtttattcatttatcagtgtgtaagatgtgcccactactatctaaaccccaagaaatagtagtgacctagttgaaaaggtctctgctctcataagttttactttctggtgttggcggggtgtggtgtccaggcaacatccatggaaacaaataatttgtagcatcaagtactatacggaaaataaaatagactaatgtgacagagtgtgaacattagtggttagggaagcctttttaaaataaatggagtttgagctttgaatcttataccctccaaccctccttgtcaactttcattcattgaagattctgacatgtggttaatgacattcttccaccgtaccttccttggctcattcagtatgcaagtggataacccgaatgttttagtctgttttgtgtggctataacagaataccacatactgggtaattttagtgaaaagaaatttatttcttaccgttccggaagctgggaagtccaaggtcaaggggtccacatgtggtaagggccttcgtgctatgtgcttcatcccatggcagaagttagaagggcaagtgagcacaagagcaagaaggggccaaactttcttttatacaagcacaccctcaggataacacacctactccgagaaaatgacatcaattcattcatgagggcaggatcctcatgacctaatcacctcctgttgggccttatctcccaacactgttgcattagaaattcagtttccaacatatgaactttgagtg

SEQ ID NO: 12096 - DNA, 1040 bp, Homo sapiens
catttttctaaaaatgctttggctatttcttctcacaaaatgagaggcagattttccattaagctaatgaagtttaagtttctgctctcttaatgcaaccaggcttctttccagcccttggaaagagccctagcaatgtgctcacttggccatatatttttgtaaaatctgcaatagcacatatcttggtaatatttttttcctgaggggccctcaaaataaataggcttctgtccccagagactgacccctgcacaaagttctttcttaccaggtaggtatttctcaccttacagccctccattttccctggactgtttctctttttatcctcccttgtggctctcaatttcacatctttacatttcctctctctctctatctccctcttgttctgtgtctgtctatctacctaactatctaatctttttcctctccaccatgctctgggaagagggaaacaaagcatcactttctctacccaaagaagtaatcaagatattttcctaaatcaagaccttttcctttattatgacatataccactgtcctatttatgcatttattattttgacctgcctttctaaattttctgagatatcagctggtcattactgaaaacttaccacatgccaaacattgtgctaattgctttacatttattaaatcatttaaatcataatagcaactttatgaggcaggtataattttttctgatcattttaaaaccaatgcttagggaggttaaatcatgtatccaaggtcacacagctagcatttggtagactcttgatttgaatagttaaacttagccacagatgtgtgcttttaccccttccccattttgccatccagataccactcttccgaaaaactctccttggtttgtctaacaagaagtatccttgccttgctctcaactcccatgtttgtatcaattttatcctctttcttcaaattaccttgtattgttattaatctttaatttttaaaattttaagtggcacataatagtagtacatatttatgaaatacaaagtc

SEQ ID NO: 12097 - DNA, 1048 bp, Homo sapiens
gttaagagttacaagtaggcttggaggatggctctctggctataaatctaggctctgcaaatgacttctctatgtggaatagggcaaattacttaatatttatgtgcctcaatttccttgttttaaaatggagtgataataatacctattttaggcaggatgtgatgtggcttatgcctgtaatcactttgaggcagatggtggaggatcacttgaggccaggagttcaagaccagcctgggcaacatagcaagtccctttctccaaaaaataatagtagtttaaagaagaaaaaaaaacctgtttcatgacattgttgagagaattatattagttaatatggtaaaccaagcaatggctcagtaaatgttagctattatcatgaccttactgcaatccctacaataaccctctgaagtggttattattactagatgaggaaagtgaggttgaaaaagattaagtaatttgctctggtctgtacagccagtaaaatggaatagaaaagaataatttctaggactgtcatattaaaattttccacgctctttctgttctgatatttggcctcccactgcaccataggatgctaaaatgactgaaatagcagtaaactttgtggaatatgggtgccaaattatccacattaaagatttcttaagttcttgtgtgtgaacagcacaacatgatgtgtatgaagatgcagaaagtaaaatgcagttcttttctcttggggcttaatacctctgactgtcaaaatgcacagagagcattttatctcaatgacagagaaacagatgggtacaaaaataatactaataccttttaagtgactgctaactacaaatcttgtcaggtatggtaaccccagaagaaattgctcttaagaagaatgaattctagagctataatcccaatagttgtaatttacaggggaaggctttatgataaacttctactggtgggaaccttaggaggcaagcaaacagctgattaaatgtgtgaaaatatactttcaagtgttagacaaagtttccattgccgattt

SEQ ID NO: 12098 - DNA, 1273 bp, Homo sapiens
cacttggcccataaatccatatctggtgtttggcttcttatgccacataggaattttcattttttcaatgaggtcagttataagtttaatattatatttttaagccatgtgtatgtagaaagattttcaggttatgcaggtctcagtattgctggaataagaaagaaaatcacctgttttaaacataagtatgatttcactgatgctcagtgaatgactcctaagagtgatgaactttggccattcagaaatctgcagactgtgaggtgaaacttatgatgagagaatgtaaatgaggaggaacataggaaaaaacaataatgatatgaagtttatgaggtttactaggaatggagctgggggatgaggctgtttttttccgttcctaaatttctaatgctcccagagtctgtacttcttcccaaagggttctcatctatggtcagtgtctattgctttctgtcatggaaactttctggaagaagccactaggacttaggtacaaaaaaaaaaccttacagcagtcagccctatccatctaatagataactctcccttaaaaacttactgttttttttttttttttttttgagagaataaattatattccaggttaatttttttagacttacagtaaaatgtggtgcacaaggatcaagttaaatagcaaataatggattttgggccaagttaaagaagaacaatcaaatttgtgaatgacagttttgagagggtagcttatatgacaaaagacaggatcaagattcagagctattcaaattgtaggaacaatgggatcaaataacattatgacacttgacaaacaaaagcatctcctgcatttgtcctgctttcagccctcaacatttctagatccttaattctgatctcttccatctttggcccacactcattgtgttctttgcccctttcctttagttttcttttctttaggtgtctgtctttcctcccttacctttttcctcattccctcccactggagtatgagttccatggaaagtagagatggaacctatgattttgtgtttttcatagggcttgtcatcatgctttgcatatagtaggcagtccatgaatattaataaagtataaatacactcttgcatttaggttagaaaaaccaactgtgcaacatagagggaactaagtttaacagtttttatgctttatttggctactgattcgaagttaagtatgagccaaaagtataatgtgctagctttaaaagaaaatgcaaacttaacctataatt

SEQ ID NO: 12099 - DNA, 1035 bp, Homo sapiens
ttttcctttcattgaaggtgttattattttttctaattaatgcttcataatttctctctttacatcgtttcgtgttcctatagaaaaaatactgggtatcacaagggaagaaagacagagagagagaggagcaggagggagggagaaaagataaaggaaaggaagggggaagggagaacagagagagggaaatagagaagagaaaaatatggaagggaagagaaggaaagaaatggaaaagggaagagaaaagggaagagagtggaagagaaaacatgagccaagatgcttgaggcccattcttcaggatctctgcaaaagtaacctattttgtttatgcataacaaagtttcttgattacttatatggacgaatggctttttttggttcactcacgtaagcattaattaaattgggtagatcttcttgagttttactgggaatctcttcttggaactggccttgagtaatggaaaaagcatgaaacatctctagaaacaaagatggaattgttaccagtggcaaatatctgagtcacatgtcactgtgttactggtggaagacattcgagttaccggtggtgaatccatacaggtctgcaacaacctcactgattacctcctcagaagaaagaattcaactgaggactgaggggcataaggcagaaaaagagactgaggcaagtttcagagcaggagtggaagtttattaaaaagttttagtgcaagaaagaaagtacacttgcaagaagagtcccagatgggtgacccaaaggacaagtgctgtgtttaaccttgatcctaggactgtataagctggcccacctccaacatcttgcccccctttcccatgattcttcccttaggatgggctgcctgcatgtgcagtgccctccttacgcttgggaagtgagcatgcacagtgtatttaggaagttgtatgcatgctcatctgaggctttcttcccttttccactggaatgcccctggaaagtcatactatgtcattttgtctcttaatgcacatgccagggaa

SEQ ID NO: 12100 - DNA, 1039 bp, Homo sapiens
tcttcatttttccatttaaaatatgtttctgcttgctatcaagacttatatttctggatatgtgcggtatatctattatatagaaacataatagaaggttttcctgaacgctttgacccgcactgttgttcttggctgctattaccctgggagagtggcagctgagaaaagaatgaaaaagattccttttccatgagcaatggtcacctgaatctagtgaatttcttggtagttcaagttcccaattacttcatgttctaatagtgaaattttagccttggtaatccttacctgttcatagaataaactgatttttagagttgcttcattttgcttgctttacataatatggctgcatgaaagccttataaagcccataaaacttcttgtttcctgtcagtgaatcctctagcattaatgtattaggaaacatctaccatcttttgaaagtctccaaataatttgtcctaacatgtaattttaaaagaatgtaccttcctatctgtctacctgctaggtaattatgggcttctctgaacagcatctgctgcagagtccataaagaaacatacttccccttttcatttgatctttaacagtacacatttgttaactttatttttgaagaatgtaaaaggaaaacataatctctgctgggtggttttctttctctttgaagaatgacacttttctagttccaacctttgcagaggaggggacttttcttattgcaatgagcttggtgtatatactctctctttttatatgttccctctctttctctatatatcttgatatatataccttttctaatttctcctttttttttctccctgctagtttcctggtttacgtatttcttctcctgctcgtaataattaccttgttgtttgagaatattttccaacatttctgttccttgtatactcactaagtgacaggttttacgtagtgcacaagatagtgcttcttacattgtgtctgtttctttttatggtgttatttgcccttctacataattacattttgaatgatggca

SEQ ID NO: 12101 - DNA, 1050 bp, Homo sapiens
aaatgtgttttgtggattttattatttttcatgtcccattacactttctcaaaagaatgtctctgcacatataatggcattgcttaagtgaccaaagacttttcagaagaaagcgttatgcaaatctatctgcaataataattaaatcaaactgtctagcacagttctaggggaccaaaatgggattctttaggtgatcagaaggctagtcctccttcttagtatcataaggctttgaaataagtaagaggatttcagatttataccaaagcaaaagagtgataatctaggtatcattcataggagacccaatttaagagagaagaaaaacactcaacctaggcagaaaatgcaactttttatctccagtgctgttaagtaattgtttaaaaatgagcttattttgttctcaattgagataatacaaaattgcattttgaagtaagaataggcaagaatgagacatatgcaatttaaagcatcttagaagttgattttggcaattacgtggaaagtagcaattccgacaacccaactgcacaataaaggtaaagggacaacatagtgcccactggagaataaagccacagcacccatgtcctcaaccaaacgtacaaaacaacaacccagctgcactggcctctccaatggctaccttgaaaatggtatgtggccttcagttttctgtacatatttataaatggtataaagttattatagattaagaattaaagaaaacaatgatataggagcttagtatgaggaagggacagaaaggaattcactttttcaatttagagatgattgtgataaagcagaattcagatgcatttctttcttttttttttttttctgatacggagtcttgctctgtcacccaggctggagtgtggtggcacaatcttgactcactgcagcctccacctcctgtagctgggattacaggtgccagccaccatgctcagctaatttatgtacttttagtagagatggggtttggccattttggccagtctggtctcaaacacctaaagtgatctgcccacctcg

SEQ ID NO: 12102 - DNA, 1029 bp, Homo sapiens
atcctgaatatctttttttctctatcttctagattcttctgtgtttgttttgtatatgatgtctagttgtacttagtgggagaactaggaaaagtacatctattccatcccgtagacagagatcacttcaatcgtttttgaactttatttttaatgtgtcccatgtggctcttctctctgcaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataagtaagtgtagtgtcctcattttaggaaatggaagattctaagaaatgactgtctactcacgttccttctttgatgtttcttttttgcagaatttatgaaagggtagtagaaaagccctccacagacttgcctctaggcacaacattttggctaggacagagaaataatgcgcatggatattttaaggtatcttttggcaaaagtctgagaatgaaatgtaaatgctttctaatgagtttcaaaaagtagattttactttttatggtgtgaaacaaaataatttgatttgtaaattagaaaatttgtgtctgtttcatttttttaaacagtaatattttagccagcaaacattattttctcttcttttttcaatgagtttaattgttagatattacagaaatgatcacaaggctgcaatcagggcagttaacaggtcattctttgaattaacctttcaaagcaataaaaatctaaaatgttaacatacaaataaactctccaccactgaaatataacctttgatgatacttttacaaagatgttaatagcggattgaaagctttttagtatatattattcatggtctccttgtactgcagaaagtgagaaaggaatacacatatgtgcacaaatctgtcaaaagagaaagcagttataatttatatcttttcc

SEQ ID NO: 12103 - DNA, 1048 bp, Homo sapiens
ggtattccattatatatacataacttataactgattgttcgtatagtcattttaccagtttgagtgatgtatagaaattttagctgtctttatgtttctttaccctcactcatttataacataaattctttaaatattgtttaacatacatttaggacacagactcttttgcttcaattttgagctgttgcttcagttgtcaaacatactttagaaaagaggagaaggaaagcttattgtatttacccatttttcttttttacatactatgttctttctaccttcctgatgttccaaagctttttattttatatttttctttctgtttagaggtcattattttgctgttcttttaaaataggtcttctcatgataaattctcttagttttcctttatctgagaatgtcttgatttctcttcattcctgaaggatgtttttgctgggtatacaattctacgtgtacagctctttttgcttttgtcacatgaaaaatattttaccacttctttatggctcccatggtttctactgagaaacacactgtcactctaatttttccttgtacttaatgtgcaagattttctctgtctactttcaaattttttctttgtttttagttttcagaagattaattatgatatggcttgatatgaagttgaaaattgttttgagtttatcttgtttagggtttccttagattcttgaatctgtgagtttatatctcttgccaaatttgggaggtgttcagccattatttcttcaatattgttttttaagctcgcctcctttctcctctctttctcggatgctagtgatacaaatgttagatcttttgttataatctcacagctctttaagactgttcaacttttttttcagtctatcttctatttgtcacattggatgcttttttttctgtcttccagataactgattcttttcacagtcacttccattctgctgtttagctttatccactgagctttcatttccattattgtatttttttggttctgaagtttctatttggttttaaattttttttc

SEQ ID NO: 12104 - DNA, 1050 bp, Homo sapiens
tagttatttaggtatgtacatataatatagatattttaagtatactgtgtgtaagagaatcttggactcccacatcttcctaattagtcccaagagcaaaatttgtctgtttcttctaattctttcacctggaaccaccactctcctcctaaattgcacttcatacttcctgatatctttggctgttctctttaacattggcatctatattatcaccgtagccaagggtttatgcagtccctttgggagcagattccatttaatggtattgcaagggctttaatggtattgcctatttattcaaattatttgttttgttgctgggttttatttttctgtatttcagtttggcagattttgcaatgactctgaggtgctttagtttcataaacttactttatacaatgagccctacataactgttttagtatatgtttctgacgttaactttttacgtaaaaagaattactgttttgcattgatgtcttgtttgataaatgaaagataaactctaattgactgtaatcttcaaaaattaaattataacaatttaaaaataacaacttgttaacaaaccactaatatattatagttttagagcaaataaaaatattttttaaatggctctcctgattcttttaaaagaaaaattactaataagtgaatggaatagacatccttgtcactctatctctaacactatctcatttacacagataattccttttctacttaaatcatttttgtattgctggaattttttataaatttgcattacttgtataattaattatgaaaaaataataattaaaaaactattttttaggactactaaattagaagttatgtccctcaaaattatcactatccctatgaagttatacctgtctactctgtgtttatatctactttcactgaggtataattaacatgcaattaaatgcacaaatcttgagtgcttagtttgatgagtttagataattgtatacaatcagataaccgccacccaaaacaagatttagcatattaccattcccagggaaagttcca

SEQ ID NO: 12105 - DNA, 1030 bp, Homo sapiens
gtgtttctgtagtggtgttgttgcctgatatagccagtatgtgtcaccatggacactaaaaccaaagcttagagttgggaaaggaggaaattcacatgtgttacatttacttaaaacaagtttgctcttataaaaaattaaaatgcaattttctggcttaaaaattattgtttaaattttatgtttaagttaattttttattgtaacaaatatttatggtaatgttttattcacttaagggtcttttataagagggtggggcttggatattgaatcctttaaaaacaatgaccaaatataataaagaagataaggctacattgtcagcagaatttcacacagttgaatagaagtgtcagtagggttaaccttctgtttttttttttttgttgttgttgttttgtattgtgttgtttttatctctgatttttaatccctatgaactggaaacaaagttatttcaggactgccaattcgagtaactggaaagctttatggaatctaaagctcctaataaacaaatggtattgtagtgctcttaaaatttacaaagctcctttaaattttattagtattctacctagtttcctctgaagagtgtctgatctgtcacaaatagaaaccttcaggactgtgcattttatattctgatgctagaaaattaaaccatttttaggaaatagtctcaggaatcgataacttttcctggttaattaaaaatgtttagttattcatttttatttaaattgtcaaattcttcaaggtaggtgttcaaaatacataaggcatataaaatgttttgtttgaattgtccatagtaactagatatccatgtacattgatgaattggttgtttttccttccttgttgatgccgagctcaatatttagacagagtaaatgcctaacaaatatggtttatgagatttgaaggtgtaaaatttcattttctgccaaattatggactttatttaatataaccaatcaatcagcaagtatttcctgcatgccatgttctcagtaggcatata

SEQ ID NO: 12106 - DNA, 1905 bp, Homo sapiens
catcactctatataaagttaccatagctgatttcatttttaataggattattcattttgtcaaccagctattagttgagaatatgtcaggggcacacttttgtgaggtatgtgaacagtcaacttaaggtactaaaattgtctctgaaaccaaagatcaaaaagcctataggagtttttagacttttagaaccaaagcattcaggaaaaggaaaggaaaacaaaaaggttgcgtctttttgtaaaaattgctgactattttaatgccttcttgtttataaatgatgcacagatgactagatttttcacttttctttcacgtgttcagggaccatgccataacaaccttaattttttgttaactctaagcgaccatcagaaatagaatatatagatttccacaaagcctcttgaaaaggctcaaaatttcttgttctttaaaaccttaagtctctattatttttaaaattaaaatatgtgaaggagttaataagtcattctttgagaaaatttatgtacattaaaaaaggaataaaaaccgtgactgctggcaagtttttaatagataacctagggctggattgagtttaggtctattgaacaagttttgtggttatattgggtctgaaacaaaaaaagaccatctgattgtttaaagctagaacagaatgacacctatttgtttacatattttctatagctgcttttctattgaatagtcataatggagactgtgtagctcacaaagcataaagtatttactatcttgctttttataatagaagtatgccagcgcttgctccaacgtgtaaatggcaaattggttaaatttaaaactacctatagctctctgagcattcctgtatttaaaagtctagattcaaggtcttcagattactgattctgtaaccataaggaattcatataacctcacagagcctctctttcctcatttcaaaatgtgaacagtggtagagtcagcatttgactttaaagcacatacctcaaaagcgcactggtaagatacaggaaaagatgtgcaggactccttcccaccatttcaccataagcaaattattggtaaaaggggcgttgtgtataagaaaccatcccaaaactcagtggcttgaagaacaatttattattttctcttacagttttgtgggctgactgggctcagttgggtggttcccacttagaatcttgagtgatgttagatgtcaactgggactaaactcatgggaaggtttgactgagctggatgtccaagatggctactcacatggctggcactgatgccatctgttgactggttgctcaactggagctgtttattgcagcattcacacttgggctttccaagtttcttggcctttctatagcagagtggctggattctgaaagggagaacaccaagagcacacattccaaaaacccatgtggctttggaactttggacattctgatacttccaatactaggtcatatgaagccttgcagtttcttacgacttagtcttggaagtgacattctggaacttcataagacttagttgcagaagtttcagagtgtcatatctgccatgtctcttggttaagcaagtcaccaaggccattccaaattcaaaggaagaagaaacagacctcacctttcaatggaaggagtaccaaataatttgtgatcatttaaaatctgtcccagggtgaaatcaagataaccaatatcagatacacttcctgctaggtctgtcttctgctggagtagaccaatgcaggaattaatcacacagagtggtatagccgggagctcagggaaccttcacaaaggcttatagtattctcttctgtgacatagactttataataaaaagagcaaggaatctcctcgagtttagatcattttttca

SEQ ID NO: 12107 - DNA, 1034 bp, Homo sapiens
cctgtttctgtctataaagccaattcctctgctcagctcatcggaacactcattcttgttttatagaatgcagtgttgctcaattataaaattgcaaataaaaggcaattaaagtatttaagctaaatttgttgattttgtcttttaacacagctcataatgtcaactgagaaagaatgccctggcatgttagaggaaaaatcaagaaatagtactgtcccagacactaagaaaggagaaagtggtttgtttttggtgttttggttttttgggtttttttgtttgtttgttttgttttgtttttgagacagagtctcgctctgttgccaggctggagtgcagtagtgcaatctcggctcactgcaacctctgcctcctgggttcaagcgattgagaggagaatgttttaaaagaagtccacagtcacaaatgctatgagaggataacagaaaattgttcttgggatttagcaactaggaagtcaccgggctagagctgtttcagagtagtgaaagggaccagaaactagattgcaagagatggcagcatggatgggaggttagggaggaagataatgcctggaggctccttttttagaatctgtgaagaggagaggagagatagtgcagaagctggagggtaaagggcgggcctggtttatttaaagataaaggacacttgacctcctttctatgttgacaagtaagagcctagaaaaagggagagaagatacagaatagagtgtaaacaaataataaaacaggattcctgagaaggctgaagaggtgacatccagtggaggaatgtgtcttgaaaaggaagagggaacacctcttccactagccaaagtggaaacagatacatctgaagggatttgaagtaactgatgagttctctgaggccaagtcatctgacagcatcaataaagggggtggtgggattgaggtatgggaatttgaaaagaggcatggaaattatgagaaatggcagtgttgccatttggtgcccagtacttcgtcagtgtcccactttag

SEQ ID NO: 12108 - DNA, 1028 bp, Homo sapiens
tataattacctgaaatatgcatttttctttagtactaaggttggtttgctttgtgttttttaatgttatttctaatgcatcactaaaagacttctatcgagtacaagtaattcattaactgatgataactctttaaaacagggtattcctagttcttctcatgtaagtaataacatgagtacaccagttttgcctgctccgacagcagccccaggaaatacgggaatggttcagggaccaagttctggtaatacttcgtcatcaagtcacagcaaagcctctaatgctgctgtaaaattggcagaaagcaaagtaagtgttgcagtggaagccagcgcagatagctcgaagacagacaaggcaagttcaaggttgagagcaaccttcataattctgtatatgataaaggagaaaaaatatcagctttttattgtatgagtggtgaagggaatttcttattggctgtctaaatgccattattatttgaaggattctctctagatgtgttgatgtccagtaaattactggtaatattttataattgtttttagaaatgtttgatatgttttagtaaataaactgttttatatttgtcacgttaatagttggagagtctcttattgtaaatatgaagtattttcaatttcttgtttgggattttgtgagagcagtatgactggcaaataataaattatacattttcttctcatcagaaattgcaaattcaagaaaaagcagcacaagaggtaaaattggccatcaagccattttaccaaaataaagatatcaccaaggaagaatataaagaaattgtacggaaagcagtagataaagtaagttatggctttagtggagtatgtgcacgttgttttgaaccacctctgttttaataaatgaatgctgaagtttaattaaaataataaaagctagctcctactaattcctgtctacttttttgccttttgattagtttgtgtgagataatgaaacatgaaaataagtctggttatctctttggggttgttttt

SEQ ID NO: 12109 - DNA, 1035 bp, Homo sapiens
ctgaggtgggaggatcgcttgagcctgggaggttgaggcttctgtgcgcgatgattgctccagtgatcacgccattgcactccagcctgggtgacagagtgagaccctgtctccaaaaaaaaaaaaaattaagcaagtagcagttacaagaccaaaagttattttcctttttttttttctctataaaattgcccatttggaccaaatctagttataacttatttcagtgtcattaagaaagttgatgaataagtcatattactcagatgttagtagctatgcatttattaatagttttatttataagtatttagtttcactctgttgcagactattttatgctaaaattagctaaagccaaattactatttcttaaaacatattttttactttttttttttttttaaatattattaggtacttcttgcaagggatatgcattagcacatactcaagaaggggaagaaaagaagcaaacttctggtacatcaaataccagaggatcaagacgaaaacctgcaatgacaactcctacaaggaggtctacacgtaacacaagagctgaaacagccagtcagtctcagagatccccaatatcagacaattctgggtgtgatgccccaggtaacagtaatccatctttaagtgttccctcttcagctgagtcagaaaagcaaacaagacaggctccaaaacggaagtctgtaagaagaggaagaaaaccacctttactgaaaaagaaacttcggagctctgtagctgcccctgaaaaatcatcttccaatgattcagtagatgaagaaacagcagaatctgacacatcacctgtgttagaaaaagagcaccaaccagatgtagacagtagtaacatttgtactgtgcagactcatgtagaaaaccagtctgctaattgcttgaaaagttgcaatgagcaaatagaagaaagtgagaagcatactgcaaattatgatacagaggaaagagtaggatcttcatcttctgagtcttgtgctcaagatcttcctgtgctagttg

SEQ ID NO: 12110 - DNA, 1035 bp, Homo sapiens
gaagggatattttatcaatgatacaagaaaaataatatttaagaaaaagctttcagaagttaaaaatattacagcaaaaatacaaaaattcaacaggagtagaagataagttcttaagtctcaaagtaggactaaaaaagagatgataggatattcatttaagagattcaatatcgaataataaaatttcaggaaggaaaaatgcaaaaatttatttttaaaaaagtaatacaaaggaaattttttccgtaatagtagagcacaggtgtccagatatgaagaaataatataatacttagtaaatgaaaaaaaaatcataccaaatacttcataaagttctagaagtctgaggatgacaagagagagagtaaaaacagaccacatagaggattggggttacagagtgtcatcaacaatagttggagtagtgaagcaatgccttgaaaactctagggaaaataattactaacctagacaattctataacctatcaaactatccatcgtgcactaactcagaattcccacccttttccacttctgctggaggatgtatgtatatacttcactaaatgagatagtaaatggaagaacaatgtgagattcagaaaatgagttccaactcaggaaaagattaaacaggacaaagaggattattgggataatgacaaaggacaatcccaaaatgactattgaacagcagctttgagagttaccagttcatattggaccaggacaaagaaagagttttgccaggagagtggggaacaaaccttatggatgagttgttgtgtttgagtgtattaaactcagatttatacttttgttgtagttagctaaattaatgatggataataaggaagaaaaggaaaagagaaaacaaagacattattaaccctaggaaaatacctgaatgaagctggctgggcgtggtggctcatgcctgtgatcccagcactttgggaggccgaagtgggtggatcacctgaggtcaggagttcaagaccagcctcaccaatatggtgaaaccccatct

SEQ ID NO: 12111 - DNA, 1073 bp, Homo sapiens
tagagacaggggaatttcaccatgttggtcaggctggtctcaaactcctgacctcagatgatctgcccgtctcggcctcccaaagtgctgggattacaggcgtgaaccactgcacctggccaaacttctttaatttcttaaagttttgtgaagcaggatgggactgttctttaaacataggtgtgtgactttctatctgaagtcatttgttatacagtaatcaaactaatgaatagagtttgtgaagttgcgaattcttatatcttgattagagattattatagcctataaatatagtatactattagttaaaacttcagcaggtctaatagatggttttactggaagtcaagccccttgagttttgtacagtttttaccattaaaacacctgtgactttagtaaaattatataaactgtctagttttctcatataatgaagatgatgttgccacactagaggtatagtgaaaggttagacagcaaacctattagcaaatttgttgaggaaatatcactttctttcttctgtcatactagataactgaattatacatttttgtttttaatctcctttatgttcactttgtttcttggaatgaacattaatctttggtttgggatagtagtttataattgatatagtttacagacaggatctccctttcaggcatttcttaatgtagtacttctttaagtacatactagatccatctaattatgtctttattaaactttggaatcaattagtcagactttaattggatgcctgccaagtactgggttctaagctcagagcctttattatacttgtttgtatcgtacaaaaggatgttttcatgaaacatcctttcggattagtgtttcatgaaacatgtttagggatatgctgaattaacataaataaaacaaggttctagttaagcatagcagattgagtacttgtttaatgctgtgatccctctcatcccaaatctctactaaaatgacaataaaggaatgaaagaaaagtgtgttttttgtttgtttgtttgtttgtttttttgagatgcagtctcgctcttgtcacccag

SEQ ID NO: 12112 - DNA, 1054 bp, Homo sapiens
gttctgcctttgaaattttactattaaagtgaaattgaagcaaaagttgttttgatctctggacttctgtggttaaaaaggcatttttcttttgtcagctttagatatgaaaacagtctttgcttttctatgtcattgctgtagattagcattctttttttatgaatagcatttgcttgccaattctaagaaccaatataaaatttactgctgaggaagattaaatgatgttacagattttttctaggtaatttggcccactaaattatgctagtcttagttttaagaccactgacaactgtaattttcttaaagtgtttatctcttgcctgggctcatttttagaaggtgaaatacaggaaaatcttaaattccatatgcttcagtatagtaaagctcatttataagcatctatgattaattctgatttgagattttgttttactgtttagaatgtggcatattagattggatagctattttaaaattataatgaggaaaaaaacaatttctgccagaaggttagcattatctaaggcctgtaactcaatgctgtatctacttaagatgcctgaagtcgtttgtttggtttaggataggcagaaatactcattatactttgagtgggtaatacaagagtgctgatgctgaggtaattatgagcaaatgtcttcactgaccaacctggactgatttgaagggaactgggtatggtagttaccccttgtccatgggggatatgttccaagtagatgcctgaaactacagatagtaccaaactctgtgtatattttgttttttcctatatgtacatacccatgataaagtttaatttataaattaggtggtggaaagattaacaataatgaataataatatagaacaattataataatatactgtaataaaagttaggtgagcgtgggctctctcaaaatttcttattgtacttactcttcttactcttcttgtgatgaaggtagagtgacacaagatttcatcatgttattcagaatggtgtacaatttaaaacttaagaattgtttgtatctgg

SEQ ID NO: 12113 - DNA, 1032 bp, Homo sapiens
tcattttcacaaataaggttactgaggcacagagagactgtaacttgctcgagtttattaaaaagatacgaaagtagcacagtaaattcatggcctctatacatcttagtttttacgaaaaaacaaattttcatttattaccacataacctttttttaatgtttctctaaatttacctttaaaataggaataaaaaacattttgaagcttttgtaaaaataggaagcactagaaatattacacttttaattttatttatctatgtttcagagatgggatctcactctgttgcctaggctgcagtacagtggtgtgatcatggcttactacagcctcgaactcctaggctcaagggatcctcctgccttggcctctcaaagtgttggcattacaggcatgcaccaccatgctcagccagatttcaacttttaaatatttttgaaaaccataaatgtagcattaatataatctcttaagaaatttcatacagggtatgccactgggataaacagcaatggttatgatgttaagttcttcgaactagacaatgcattattaaaaaatatatgaacttctttgttgctgaagcaaaccttcttaaggtcaagttttctatagggaaagtaatagcctcctaaatccatagtacttaaaagtaggctgaactggcttcttccagtctgaaccaatttaatatagtaaggtcacatttcctaattcagatgtggtaaagcttttttcccattgaagcccacttaaaagagaaagaaaatagtaactcagcccatattttggctgctcccaaagtgacttgtgagctttgtgaaaatgtgttaaatgatcaaggaccatacacaatctgctctacttttacttgtataagcatgtcttgatacgtggtaaaacccagaaaggcaaagatcacattttttacataggaataatatatctagtttccattactatctttgctctttgagactattgctattagattgttaaaattccgttttatttttgtaaccataggta

SEQ ID NO: 12114 - DNA, 1059 bp, Homo sapiens
gacaccctcctccctgcagtggaaacgtgtcctgctgagcttccgggcgctcccgaccgcggtgtcggcttttcttgggagactttggtcgcgagcgtccaagcccgctagtgaaaccaaactttactacgccgtgacctctcgagtgcgcgaatggggaagagccggcgcttctaagcatcagcctttttcactccttgatctgaacttcaaactactcatccacccccagtgttttaaattcgctacctgggctgacaactacggggccgggagatataaatttagcctaatcagtcgccccttctgagacctaggaattttgaaccattaaaaagatttcctacagatggctggcggtcttgccaccaacacgtattttgaagtattgtttcaaaagtagacgcctgatttagagtacttgatttagacattcacggattcaaatgttgaattttgaaatacttccaatatatttccgtattgtattacatacagtgtctaccagctgactgttgttcattcattttggattacattttggctaacatgctaccactgacctaagatacttaagcaaaactgctgaaaaatgtttttaatgctttgtgtagtagatgctgatgttaaatttttttctccgatttgggaattttccccgaattttgggaaaagcatattaataaatgcattattttttcgttttaaaagaaaaattaatttctacatatcaccacctacctcagcagcagaatatcagggcagtacattttaaaataacggttggtttttgtattttattagtaattgtattaaaattttgacatgtaatcaagtctgtttctaaacaattgctttctctttcctgtttctttggcagttggcttgatcatgtcactattttggttaaaagatgcaagaaaaagttcatgggccttttgtttttgttgttttaactaagcaagagaaatgaaatcttgaaactgtctttggatttcttttgttttatattatcctatcggataatctgaatttatattttttatgcaatgtgagttt

SEQ ID NO: 12115 - DNA, 1040 bp, Homo sapiens
ggagaaagatgaacaccagaagactcagcaagccagcttagcccgtcttcttccacctgctttgttctagccatgctggcagcttattggatggtgcccacccccattgaggatgggtcttcctctcccagtccactgactcaaatgtcaatctcctctggcaacccccttgcagatgcacccagaaacaatactttaccagctatctaggcatccttcagtccaatcaagttgacacctaatattaaccatcacggggcttaatgataactttgcaactcagatgtcctgttttcttactttctagatttataattgtgttctacctagtttggaaagggtggatgaggcccaaataactaggccaatttttgaatatcaatttttaaaaatcttttattagtttacatgttaggctaatccaagttggtagaataatctgctcattgggagagtcagtacaccaccaaaataacctgacaaattacccaaattatataaagccatagcacttagaattgaactgggtacaaataaataaatagatcataatagtgaatgcataaatgatccaaaaaataccagaaaggtggcctttcaaatcaatggggaaaaataaaggttacttaataaatgataggaaaaaatacatagtttttgaagaaaatgaaaccagatttctatattaccccttatgtctaaagagaacttagatatattaaagactttaaataacacatgtgtaaatatatctatttttataagcatgaaaccatgacttaaataaagtatgtgtcaaaaaatttagttagcttattaattaaggaacaagtaatatgtttaaaaattggtccaaaggagaactcaaagaacagatacatatatcagcaatcaggaattctaaaatgaatttgctaatagatgcaaaactggcctgtccacagggggaaattaattgcatctttttttttaatgtactttaagttttagggtacatgtgcacaatgtgcaggttagttacatatgtatacatgtgacat

SEQ ID NO: 12116 - DNA, 1031 bp, Homo sapiens
catttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagtatttaaaaatgttgtgtttgttcttttgcaatgcaatactaaaatggggcagttgtgtactatatacactattcaggattgctggagaagggttatacatatttgtcagtgttctagatcatagaaggttatatatttaagcaccctaacgtaaatatttttaaaaatacttctgatagaaatctatctggtctgaaacatataccacatttctccattcttcataatcagagtagattcaccataatattttcttttttaagtcaagtttacctttataagtattaatttctgccctgtgttgtaggaaggagttgagtcttcctctacccacattgctgccacctataaaagaagaaattctatcaacacttcatttctcagtaactattgggtcaaagctagtgcagccttgtctttttatccatcaccaactcctctccagcatcttagaaaggctt

SEQ ID NO: 12117 - DNA, 3342 bp, Homo sapiens
acaaactctgaataccagaggacacaaagggagaggaaaaactgttctattttttttccccaggtacatgtggaaaaattttgctgcactgaaaataacccttgcctttctcttgctccaggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaa

SEQ ID NO: 12118 - DNA, 1038 bp, Homo sapiens
actgtagatatttgttaaaatactacagttagtattaggtagtcactaaataatggctaacatttactgaacagtatctatatatgctacactatcttaatccccaccaacaacattatgaggtaggtattagccccattttacagataaagtaactgaggcttaataacttacctgtgatcacacattagaaagtaggggagccagcgtcccatccaggcttgcttgactctagagccagcgtgatctaaaacaccataccgcctttggtgatgccttcttcagacaccaaagttgcattattactctacaacttgagaaaaactttatttttatcaacggatgcttgcaagttagtacttaccttttactttccaatataatgtacctttaaaatcaccttataaaatcagccagtgttcctgaattatcttgctagtgttccaccaataaccatcccctttactgtcatgaaaacagcttggcaatatcaagtgtaccaaactgtagaccgaggatgtcaggttcctgttcacaacaagtaaaatgtatgcttaaagtatattgtgaaaccaataaacctctcagtggcttcatatttgtcatgtgggttcctgcatgtgcaatttaagatttcccattgctttcaggagctgttgaactcctgaaagaagtaactaaacattttgttattaagaattaaacaccaagtgatagcaaaatcaaataataccaagtttaaccctaggaaacttgttaaataaccatggtactttcataaaatagagtattagactactacttaaaagagtaaaatagacttatatgggcaggtgaggaaaaatctcctaggttgtaacggggaacatagtgtgtagcactatgttactgcgtagcatagtattattaatactgtgtagcatagtactattacatgaatacaaactgaatattgggtggaagtgagcatggaaggagggtgtgtctatatgtatacattatattgcccagaatatttggggagggtacacaagagaa

SEQ ID NO: 12119 - DNA, 1055 bp, Homo sapiens
gaaaacttgcctctagtatccttttaaataccaggtttatagtagtcttgatattatctaattttccacttagggaaaaactatacaaaaattaatttatgttgcatatagtgtttaaatttattattaaaatgattcaaaatgtatagctgtttttgacttacggttgtctttcatttcatctcaagatgagcacctgttattggcattgttttgtacaaggtagagtgcaggatataaaaatgaatgaggcaaagtgcctgcccttggggcacttatagtttatttggtaaaacgagaatatagacaactcataatggcaaaagaaaaaaaggtggggggagttggtggttgaatagggctgtaaactcttagagagctgattggtaactgttcatgtatgttttgatgagtaacatatcatttagtaaagatgtcaagcttcaaatcattatcataaggttaaatatattacgcatgtctttacagcaagtttatttctgatcgtgaaagtagaagaagtctcacaaacagccatttggaaaaaaagaagtgtgatgagtatgtaagtatcattataatgaagtatgcttatttttttaatcatataaattgggacaaatctttttaattcaagtagcatagtaccaaaagcataactacctgtattcaccaggatattcctcataccttatgtattttctcttgaaatccattcaaggaaataactagataactaagaatggattttcttgaattttacttccatattggttcctgagagtgcattaaaggctttggcttgatgaactttcttggggattattttgcttagtgtcaatgtttgtttctttgttcagattccaggtacaacctccttaggcatgtctgtttttaacctaagcaacgccattatgggcagtgggattttgggactcgcctttgccctggcaaacactggaatcctactttttctgtgagtattgacgtgccggtactttccattttaaaactgaactttttgtatgtttctgttattacatagaagaaatgtg

SEQ ID NO: 12120 - DNA, 1030 bp, Homo sapiens
tgccaggcgtggtggcgcatgcctgtaatcacagctacttgggaggctgaggcaggagaatcgcttgaaccagggaagcagaggttgcagtgagccgagactgtgccattacactccagcctgggcaacaagagcgagactccatctcaaagaacaacaacaacactgcttcatatcataaaagggggtctctgttacctacagctaacatgatattcttataaacctgatcagtaagattatggggcatgattcactgtatagttaaaaatggaaggaaatctataaaaggcataaaatttagatacacctccataacttgatagacaaagattgctttaatgcatctagtagcaacatgtaaaattgtataatcagtaaattaactacttgtttatttgtggtaatttatttttaatcagtagcgtttcatatgtttagttatttttttattttgctatattttaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaataggtgagtatttttccactaacatttctatccagtgaaagaaatggctcgtggctcacacctgtaatcccatcactttgggaggccgaggtgggtggatcatttgaggtcaggaattcgagaccagcctgaccaacatggtgaaacccaccaacatggtgaaaccccgtctctactaaaaatacaaaaaattagccaggcatgtggtgcatgcctgtagtcccagctacttgggaggctgaggcaggagaatcgcttgaacctgagaggcggaggttgcagtgagccgagatcatgccactgcactacagcctggatgacagagtgaaactctgtctcagaaaaaaaaa

SEQ ID NO: 12121 - DNA, 1053 bp, Homo sapiens
ggggtattattcattttttccataagttagacattggagtaaaagcacaacaggtttttcttagaggaaaaaccttctcatgatctgtatgttattaataattataattgttacataaaattactgtgtgcacagaggtaacccaaatttcctagtcaatcgtggctttaatagtggctgtcctaaaagattttgttatccacagacaatcgttttcttgttttaatcctctttaaaaggtggttttataatcaacaataggactttgacagatgttctaaaatgcaagcttctgataactttggaaattgtgacattagaatagaagaaaaactttcagaactctcacagagaggtgaaatgttcatgaatatcaagaacaggggttaactaaattaaccgaaacaatggaagactaaagtaatctttttgactttgcttaaaatgttgctgaccctttgttttgtttttcagagtcaaggaaacttttgagctatttacagcttgtagcaattatgtaaagtatactcctctgaacaaaatttggagcatgtttgtttctctctacctgatttccccagaatctggaaactatctgtgagtattctcaacttttagcaatatagttatttgcataagtgcaataagaatctgttttcttttgtaacaggacacaattggagaaactggttattttaccaaggctttgactggaacagcatgctttcctttaaggaatcaaacctgacttgtaaagccaagcaaatccctttggggaattggcctcatacttgcctacacagacctcaaaaggagagaaatttacccaactcataggtatttgagggttcaaactcattgcaaggcttggttctaaaaagtcttatctgagattccttctatggagcagagttccatcaaagcgaaattacaaaaggcttatgtgaaaaataattattcttgctgcactttatacaaaaaatcaggccaagtataataaagcaaatcagtgttactatgatttgtctttagtaaaaaatgggaaactggaga

SEQ ID NO: 12122 - DNA, 1115 bp, Homo sapiens
tgctgtaagaattcatcacaggtaaacagtcaagcaggttctcaactggaacaattatgtccctctccctgcccccaggaggtatttggcaatgcctgcgttggtcattggagaaaggcatcacagaagagttggcttgaattttttaaaaaagcaagcaagctgggctttgaaagaaaggtcatacttaagttagcataggcttcatgggaaggtggagagggtgtgtccaggatcagggggatggtgtgaacaaagcagaaaactgcataagagtagacccattgcaggaatggaaaattagaaggaatatagtgggagcataaattaaagagaaagctgtctgaggttctagagattagacctcatcctgtagagggaacagttatgattggcaaggcagaaagaggaatgtgcaagactgtcttttcaggaagaatctgcctctataggtgggagagggcaagaagcaggaggtagcgtggcggagagtgactgtggcaaagttcaggctgtgaaactgtaaggaataagggaaaggaaaaggattttgtgaaggaatgttggcaggacttggcaactgattagatatgaggttgtatgaaagccatactcaagtttcaagtctgagtgacaaggagaaggtgcattatatctttaacagaaatagaatgctggcatgtgaggtcaggtgatgcgttctgcttcaggcatgtggaatctgaggtaatgataaacatcctaatggagcagtccagaaggcagcaggagtctgaaaagaatttatggaaatgtttctgagaaggaaagaacctgagagataacctctctttcatgccctctcattttacagatgaagaaacatgtgacatgttaagtggcatgatcatgatcaagttgtatttatgagggagatcctatttcataacgcaaaggaattctagttttataaagtgaaaaagactgggaagaaagatctgaaagatgcctttgtagaatgaaacttgacactacagccctgaagccctaaaaaggaaagaatttggaatatgtggagcaagaagagtcgaggcccaaagagctacttctacacagaaagttgggaggaggaggga

SEQ ID NO: 12123 - DNA, 1050 bp, Homo sapiens
gcatggggctccccagcacccactgggacccagtaggttacccggctgcctgggcaccgtttgcctgccaaatcgcccgcctgaggtttgtgctgaactgtagttagagaaggcacaagtgcatatggcagcaaaaggaatttcgcggtacccgcgtcacgccgctcccagtgcctttcacaggctgccttgggctggggaaggtggtgctacaattcagagtcctttgtcttgctctgcggcgcggacccggggtttgtacaaaccctcgttctctgttagaaacctaactgccgccaggatcacgtactttctcggacgaatccgcggtgatgtgtgtagcaaaagtgaaaaaagacgcctctgctagaaaacggtatttatttgcgtttggaaggggttttgacctctctgcagtgggtttttacatttttcaatataagggggaggaggaaaataaatttatggtttgcagaatgcagggcccagcgagggtgtaatttgtcaccttgataaaagaaactgtgcagcaactcgtgctttttctgacgtcagaaggacaacggaaataaaacctgagctcggtgcatggctggcctcgttgtcaaatgtctcatgccaatttggtactcccgaaatcttgcaaaacagccaattccggggtactgacctggtgtggaccccctggattttggttcgaccccagcctcaaaatggcctttctcttgagagtcactcgatttctcagtatgtcgctgtaagcaattggaaactggaatagtttggtttgaggtcttaatcttgaggtttattcgctttttaaaaaaatgtggccaataaacattttctacagagggcttactgtgcgactggcagcaactaacaagatttgtttcaccttctatgaagcttccgttctcagggggaaatagactatataaatgtaggcatatacatttcaggtattcttagtgcaatgaagaaataaaacaggatcatgtgatgggggaggatgcttgaaatagagtgactcaccgggaggggcggtgt

SEQ ID NO: 12124 - DNA, 1550 bp, Homo sapiens
tctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagacttttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctgagtagcagtgttttttgttttgttttgttttgtttttttcaggtaatgggataggcagtgtctaatgcaaattgcattgtaactgcagtacctagcacctagtaggtgtccatatgtttgtgatgaatggtcaggaaaaaaagtttaggttcccagagattctaagtttccaaagtgagaaggaatggaaagtcttggagagttgggggaagatgctaaaatgcatcataagagcccaggctcagccctgctgatggaaataaataggtcaataatgtatcagaatcaactggagagccttttaaaaccacagctttctgaaacgtgcctagtttgtctgattgcaaaggtccagctgtagggtagcccaggatctggttttttacttaagaaggccactcgggtg

SEQ ID NO: 12125 - DNA, 1345 bp, Homo sapiens
aaagggaggaggataataggtgctttatagaaaacatgtgattagctaattattgaggactgtgaagaaagttttggtttacatctgaaaatagattgagaattgagataatcatatggtgctaataattgacacattcagaagtgaggatattgatcatacttcatgaacagattagaagaatggaagctaattacacaaaggaaacttaggctttgattctaagattgtttacataaaatatatgctgcggaaatgtgacagcatgagttcgttacatcagattaagtagatttttacgttttctttcagactgtctatgctgtgccaattctgatcttttcatttgtctgtcatcctgctgttcttcccatctatgaagaactgaaagagtgagtatttcatttttacataaatttgagaaaatattagacaattgctgtaactgctgctgaaatatatatttgaattttctcttgaattacatagccgcagccgtagaagaatgatgaatgtgtccaagatttcattttttgctatgtttctcatgtatctgcttgccgccctctttggatacctaacattttacggtaagtaacgcctcctttaccaaaacaaaaacaaaaacaaaaaaaaacgcttattgaaatgaagctgctagttttctatgtgtagttccatcactttaaaaatagtctgttttaatatatttcatatttgtgatgagaaattaaatttagagcttagaattttctgtagtgtatttaatcagtaatttctagaatccaggtttgaaaatatcattaatcatttgatggcatatttgtatgatatgccagcctctgagttcatattgcctgtctcctctcccatcaccttcagactatgtaacacaaacacaaattgcaagccaagccaggagatttagctgcttaactcctgttgtttttaatgggagtcatgtggctaaatctctgtggtatttagaaaaattttccttcaatgttactttaattgcattaactataattccaaacaaatcttattagcctcttagtttatagtcgttttgtgagtagctaaataactggtgcacattttgctgttaaattttctacttggtgtccaatgaaaacagccaatcaaagtttttttggtctttccctgtagaacatgttgagtcagaattgcttcatacctactcttctatcttgggaactgatattcttcttctcattgtccgtctggctgtgttaatggctgtgaccctgacagtaccagtagttattttcccagtaagtaatcacttgctctgctttcagtaggaaggagtttttagacatgt

SEQ ID NO: 12126 - DNA, 1072 bp, Homo sapiens
atggcatcactgtcgaatatttgaaatccttgttagcacttggtataaaaactggaggcagttttagagtgcagccagtgtagttaaagtaagaattgaaatgatactaaatggcacctctgtttcataagtgaaggtcaaattctgatgtaacccttgtactcttggaattatactttaataggtgcttatgtcattgatttaccattttgcttaatggctaaataagattgctaaagtgtgattttattcatcagtacttactttatatttagaggtatagaggaaaatgggccaaaaaccacatggctgccacggtgcacttcagcaaccctgtagctaacctgtttaagtagaatcaatctgaaggttgaaagtgacctcaaaggttataaagtctattcatcccttgtcatttcagtataagacatggaaggacttaatttggtttgtttttaattaaaccaacatattttctccagttagaagtgaggttgatagtgtcacttcagactaggtcctgtaaaacttctggcatttagaatggtagtgtaaagccacttcctctgtttaactaatagacatcagtttctttgtcagcaccttacatggtactgcgtgcagtttgttcatacggaattaaaaaacatgtaactcttctcctttgcaaggttttctatgagtttccctgttttgttatttaatttctttaaaaaattagtctgtatctctgggctctcctaggtggaaggaaagtaaagctggaatgagggagaacccttaccctaaaggaaaattaggtgacattagggtccctttagtcactctatgttaccttatttatttattttttttctgttgctcaatccaagtgaaagggtcaagggaggaaaggcttagagacagtcaagctgatagcctacttgttctagcacagacattgtttaactgtgacaatagtgggcctgtattccttgccatggggtgcaatgtagtatgtcatcacaatggttagttctctgatttgtgcccagttgttagtaaagcttgtagtgcctcttaaaatgttagt

SEQ ID NO: 12127 - DNA, 1030 bp, Homo sapiens
ccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaatgtcttatgttatcagattatgctattttgtataaagcaccactgatagcaaatctctctccaaaattcttaaagttgatttttttaaagggggaggggaaggctttaatgtgttctagatcaatttataccttccgtatgacgttttactctgatatcattgtgcactttagccagatccagaaaacactcaaatttattttgcaacaagtgagagcccaggagacctccttattatcctgtctctgctttgaggcaatcaagtaccctctctgaacctaggttccctcatctgtaaaacaaaggtttcagaccagatggtgtttaaggtttctccccatactggaatgaatgatttcttggtggtattagcatcatcacagacctatacttgctttctgaaactctaccacatactgaaggaatacaggaatgggattaagatgactagcatagcagtgtacagcttgaagagatgtt

SEQ ID NO: 12128 - DNA, 1068 bp, Homo sapiens
acagggctttgattctttccccgcctgtggagtctgcccaccggattcgccccctagcccgagttctggccaggaggcttctcacccggttcaaattgttacaaagtccagctggagacttccttctccctgtggcgtcttcccccatgcctctggtgcctccaggagggtccctgtggttccaggcaggagtggctgcttggggacccagtgagctcccagggcctttcccactgtttcttctacccatgtattttgcttggctctctaaattgactcagctccaggtaaggttggaaacttctcttgagtatgactttcattttccccagtgcgggtgtgtgttcaggagtggagggtctccctttcccacttccacagtttgagcactcacagtatttggggtgtctcctgagtcctgcaggagcagtccgcttccttcagagggtctgtgggttctctcgggattcctggtttgttctcgcagtcattctggagctaaaatgtgcgatgtgagcctctgtatgctgctctgtctgtctgagtcagagctgcaatctagtcctgccttctgtccaccataatgatcaacaagttctaattttttttaatttttaaaattttattttaatttcagggatacttatacaggtttgttatataggtaaactcgtgtcacaggggtttggtatacagattttgtcacccagatgtactaagcatagtacccaatagtaattttttctgatcctctcccttctcccactttccaccctcaagtaggtccctgtgttttcctcttcatgtccatgtgttctcattatttagctcccacttataagtgagaacatgcagtattttgttttctgttcctgcattagtttgttaagaataatggcctccagctcctatccatgttcctgcaaaggacatgacctcattcctttttatggctgcatagtattccatggtttatatgtattatattgtggctgctttaaaatatttgtcacatcattctgacatctgtcattttggggttggcatctagtaattgtctttttttcc

SEQ ID NO: 12129 - DNA, 1091 bp, Homo sapiens
ctggaattcgattttgtccttttttactcaccttaccactttttccatccgagaatgcttgatttggataatcagagtaagtcagtcaaaatgttcaaattgggtataaagtctctcaggtgaatatcagcccttacaatctgaaatgttatcaagtcaagctacactgcatgtttgccatctcacttttcattacacttgatttgtccttgtatttgacaaagaagcagaacaaagttttcaccaaccaaccacatgacagcattaaccaccagaggattttgaacctaagcctggtggaaattcagaagcaaggaaaatcgtgtaaggcaatgaggctccttagagaaacttcaaagatcttgttaataggtcagctcaactaactgtaaatgacctgaattcaggactaagatttccataaatatagtgatcaatgttgattttaattacattacctttaacacttgttagaaggaaagcaaagaatctcattttcatgtataattacttttcatagatctgatatgctttttacttagcttggagcaatgggtcattttttaaaggactacattattagctttgatctaatttgcctgggctgagtttaaaatgtttgtgtttctgagaagtctaagacaggattttcaggcatgagatggctctgtgctttccattttggtacttggatgtgaaattttttacctcttattcccaagaagctgtcatgtataatagggtggtgcattgtgaatttcatgatgtattcattggtccactacattaaaacataaaaactgaatctgaattgtaggagtggggtcatattataaattcataaaaattaaattatttttatcaatcaaataatgaatatttaatataatactgggcattggtggtaaaacagaaattttaaaagccatcattgcttaaaacctgtaagtggggtcataaggctaataaaaaggaaacaagacaaatatgtgttaaatgaattaagaattaggataaaggagagattactgtggtcttaacatcagcaagaagacttcttagtgggaggtgatacttaaaaagtttggggg

SEQ ID NO: 12130 - DNA, 1036 bp, Homo sapiens
aaagtcattctccgtccagcttagttccattgctggtgaggagctgtgttcctttggaagagaataggtgctctgatttttagaattttcatcttttttgctctggtttctccccatctttgtggtttaatctccctttggtctttgatgttggtgacctcagttggaaatgtagaaatcacccttcttctgcgttgatcacgctgggagctgcagattggagctgtgcctattcggccatcttggaacgccccctaactcgtaaaggaaatgttgaaatgtcttactggggcactttttttttttttttttttttagaatctttaaaaaatacttcctaggattactgatgtataagggaaatttagcagcgtttagagttttgggataactttttaagtgagtattttaatttaacactatcaatttaaatatttctgcctatttctcttatattaaaggaatttcaagcagttttacattttatagaaattaaatgtctttgtatttttattactgttcttttctgaagttgggataaacacccttgcatcaagtaaattatgaaatatacatacagaaaagtacgcaagacaaattataatttagagaataattacaaagtgaacacccatgaaatcaccgagtcagaaaattaagacatcacccctaaaaaacctctctatgtacccctgactgatcaagatcctcttcctgccctcttaaactgttatgcatagacgatcctttgcataacagttttcttcattagaaataacaatttcataaggaagtcagaggaggtatttttatcctctttttataaaggcagaaaaggaaagtttgttttgctatgtttgtactagttagtagtagcaaatagatttcttagtttaatacttttccagtgcatttaatatgactgtattcttttttttttttttttttttttttttgagacggagtttcactctttgtcccccaggctggagtgcagtggcgcgatctcagctcactgcaacctctgacttctggg

SEQ ID NO: 12131 - DNA, 1022 bp, Homo sapiens
cctatttggtgtttggccatttttttttttagggcttttcctattgatttattttgagagttctttattctggataactaatcttttggtcttttccataataactatcttctctcaatttgtagcttatcttctttatggaattttaatgaatagaaacattcaattttaatatatttcaacttcttgattttttaaaaagattaggactttataaaatgatttgttcaaaaaaatagtttgctgcttgagttcctaatagtctcctctaatttcttctaaacatttttaagatttacttttcacatttaggtgttttcacatatgctgaaggtttttccagctctatttttggaatagccctactttcccccgtggatctgccgtgctactattgtcatatgtcatgtttgccgagatcactttctcatctctgttctttacactggtctgttgcctgtccttacatccattccacactatctttaattattatagcattgtaattgtaagtcttaatatttagtgtactgcatattctcctaccttttattattcaggaatgtcttgggtattcttggacttttactcatcaatataacttttagaatcatcttcccaaattcgttaaaatatcctgttgggattttgattagaattgcattagatttataaatcagtctggagagaatcatattgtatgtttttgtactttattatagatgaatgtgaaatatctccacttagattgtcattaatgtctttgaaaacagtcttacaattttttgcatctgtgtttggtaggtctttgttagatgttttgtttgtttgtctcttgttggtctctcgtagtcaccttactaaacttgtaatacttccagcaatgtctctagattgttttgagttttctttttggaccatcttatcatttgagaataatttcaggcctttttctttgtttctagtccttgtgtttctttcttgtggaactgcattggtaaagacctgtatgtaataccaag

SEQ ID NO: 12132 - DNA, 1031 bp, Homo sapiens
cagggtcacctctccactcccgcccctcccatttctcccctcccaacctctaggttttggatacatgacgcagcaactgatgaacctggcaggaggcgcagtggtgctggccttggagggtggccatgacctcacagccatctgtgacgcctctgaggcctgtgtggctgctcttctgggtaacagggtgagccgtctccctcccccatccatgcttctgtcaggcaggtaagcccggctctcaggactacccaaggagcaggcagatgggatgggacagggtgggagtggccaagcctgaaacaaggtaggcgaagcggaagcctctgttccaagttaggtccaggcagcatctcctggcctaggtagagtgtgcttgtggctagaaggctggggcccctggggtgggagtgagctgggcctgtgggtccctgagagactggtggctgatgtactgttttctataggtggatcccctttcagaagaaggctggaaacagaaacccaacctcaatgccatccgctctctggaggccgtgatccgggtgcacagtaagtgtggagatgggacactcgctgagctcagactgaaggatcttggtggtaccctgccccaccgtggccagatcctagggcttccggtgccagccaggtgacctgctgttggtctggagtaagattcctgtgagtgacccaggcagcaatggtgagcaccccccagtgaggggttatcctctgagcccccccgatggagccagcagggcctaccagacagtggcccctcaaggtagggactggcctccatctctagcgacagccctagaccagggccaggtcaagagcaacactcaggccttgtttgccaaaaggcctggttcccatccctcccctcagtcctggccacaggcgtctcaggagctctgctggcttgggggctgcgtcttgggataacccccacatttgtaaagtactttaaattttcaacttcaactcaacatctattgagcatcttatgtcaagacccataatct

SEQ ID NO: 12133 - DNA, 1090 bp, Homo sapiens
tttcattaatgtatttcatttttactgagggatcccttatcagttagacatttagattatagcttatttgaatttccttatgcataaatctttcctcatgcttgggattatttcccaaggttcactctaaagaagtagcattcctgggtcacatggtgtgagcattttgagagtcgttggtgtcctagacgcacagaaattgaccctcccacccgcaatgagcaggaccctcctctgaagacttcccacgggtcagactgaaatagtcacttctccaaagctggatttgtctatcacatggtccagtgtcatcgtgggcttcttagctcccggtttgggggtttcctaggaattcttttccctcctgctgccccttggtagcctctctgggttcatgacacgtgtgtgagatgctgtacgttaggcctcatgctttgctctgagcacttgagggcctggtgctgggccctcgagtcctgggccacccagcagtcgtgtccgcatgtgggaaggccgtggctctgtggcagccatgttggctggagctgtgttgatgtgttggctgctgccacctggggaagtgtctgggcgtgtgtggacaggtgtgaggggctggggctggggtaggggcaggatgaaatgcaggcctgtgtgggtgtgaggggtgtgtacccgcccggctccatgtgggtgcctgctgtggcggtgctggcgtgttctctgcagccaaggccatggggcgtgaggactccctgggtccccgctctgacccttgctcctgcagggctgatctatgactcggtcatgctgaagcaccagtgctcctgcggtgacaacagcaggcacccggagcacgccggccgcatccagagcatctggtcccggctgcaggagcgggggctccggagccagtgtgaggtgaggaggcgcgggtggggcccgaggaatgggtggagggaggagtcatgggaggggaggggtggggggccctggggcccatgagagatgaggggcacatggggtggtggtgatgggagggaaggggcgagcatgagctcagagctctgtggtccccttttcagtgtctccg

SEQ ID NO: 12134 - DNA, 1050 bp, Homo sapiens
tttcaccatgtcggccaagctggtctcgaactcctgacctcaagtaatctgcccgccttggccagggcagaacttccccaaagttctgggattataggcgtgagccacctcgcccagcctgaagtaggtattcttatctcctgattacaggtggggcagcttaagcaggttaaattgtgtttctggcttgctttgccagtcaccgagggagtcggggcttaaacccaggcccatctgaccgcaaagccaatgtcctgtgtgctttagaccttcaattccctcacagtttgtggcctgccagacttcatgtggcaggggcttccagcccactctcagctccctgctgggttctggataaatctgagcaagaagcattcagtgccaatcaatgagcagtatagagaatttctggaagggagacacaagaagctgttagaaagggcggcttccagggaagttctagggagtctgggatgaatgagaaacttatcctaacaacttttgggctctctgaattttttttagtatctgcaagtattgtacttgttcaaatatgtttaaggctgcaggctgtattctaaactccttgaaagtgagaaccaggtttcactcatatttccatcttttcaacccctagatcagtgacttcccagggaagtagtacctgcatttggggttgacctttgggtttcccctgtactggtctggcctggcctggctggaccactggctggctgggtggctgtgacctagccccttctttctctttgctcctctgtcaaatgagagtgttggtctgaacgatctctaaagcctggaagaggagcagatcctctgtgctcagcccccactctgtgtcagggaggcctggcaaccacagtgttctttctcctgtttatttgttcttggatcttcctgaagccatttcaccaccagccttcatcttctctgccagccccatggagactcaagctttttccagcctatgtcagggaaggagaaccagagacagcaacctcgggtgtgaagggagtcagctctgaacccagg

SEQ ID NO: 12135 - DNA, 1029 bp, Homo sapiens
gtacccagcccagtgaacctagactggaaccaggtcttggacctattgggactggtcctctgcctttagtcccctgatgtccctccttgcccagcagggccaggctcagaggcaagctcagagctgcctcctgatgttgcacctggaatggtcctggtgcagtgttctccagaggcctctgtgtcccttattcggcgggtgtctctgtggccaccgggtcttacagtgggttttggggcagggaagtttgcatgtctaagctgttcactccactttgacactgaagttcagtttccccatcagtaaaatggggagaaaattccaagcacacttctcagagcagagcagaagaggttgactatggagaggagaatgaaggtactgtgctattatccaccccctccagtttgcttagggataatggacctcagctttagtccttggtggcctcttggcatggaagctggaactttctcaattctgatataaaacccttgagcaagagagaaactcatgtgtgatggggtagggagtggggaccctctggtagctgtgggcaagcatgcccaaggacttggaagacagaagcctgtggaaccccatctcctctttgccttctttctcctggcctttcattaagggctggtaattttgaagtcggcaggggcctgagagaaggtgagctaatgcaaggcccagggtcacacagccagggaatggcaggcggagggggccagaaccaggccttctcactctgccagtgcccattctgctggcccaccctccacagcttggctctccctggcctgccctcagttagacttcggactgaggcctccagtggggtgtggggtattgctggaagcagggcctgaataaagtctggggctagcgggagggcatctgtcctcccggaggctcccaggactgtgcatttgtgtgtgttggatttgttcactagatggggcacttcctttggggcaggaagctttgatttcctgtggtgatggtgaggaggggttggtaagg

SEQ ID NO: 12136 - DNA, 1029 bp, Homo sapiens
tgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaatttgccttatccttataaggaccttatgggagatgaatcattattacccccatttgacagaaaggatagcttgagcaatgccacactagcaagggatgggatttgaaccttcagcagctaggttcagaagccacaaattaactgctacattgtc

SEQ ID NO: 12137 - DNA, 1004 bp, Homo sapiens
cactcggcttccatcctcatgtcaggcagcagtccttgtctacacaggcttcatccttccctgctctagtggggagtaggacagagggcccccacggccctttccagatacagtgattccaggttcagtgattccaatggtggctgagattgcatacacgggaaagctgccctaaaaagaaagttactcattaaatcggattactccaatgctgcccccttcactaaggaaccccagcctccaatttctcccatgctcaaggcccctatccattgccctcccacatgtaccctgacacaaatagcactactctcagtttctcttcccgaggttaagttgaagtctgccctcttcctttcatcatgttctcctctgtcccctagtctgtccttgcaactcatggctaaagtgaggtacatatggcaggtacaggagctgcccagccattgatgcaaaatgggttaaactgatcctgaacatgctagggttggcttctctgtcttcagtatgacttgagaagtcccagagcagaaggtatgccaatgaaaatggagcaggccttgctaagagagcttgcagggacactggtatggacgctctctgtgactggacagaggtgatgctgagcctggactggagcccaaacctaggctccaactgggcccagggtgggccagcccagtagctctctggttctgctgctttccacacttaggggttctattgttccaagacatagaagaacagtggctgcatccctggtggctttgatcttgctgcctgcaggcaggggcggagggtgtggggaaggcaggatgagacttctgtgtgggtgtgtgggggcacaggatgagtctccagtgggggcatgagaccaacgtggggcagggctggatgggctgttcttggtgtgaactgtgctacagtgtggccttggcctgctctctcctcccatctctcctcccttagcctctcagtctcaccccacaaatctccctccctgc

SEQ ID NO: 12138 - DNA, 1985 bp, Homo sapiens
ggtcccaaagttccaagcagtcctttccgtgaaagcaggggtttgcatgtgctaccaacacatgatacggggaagacccacccagggagcggtttcagtggcgcaacaaagcaccacttttactgttgcctacttctgaccaagaagaaaaaggaccttagtatttagcataaaattccagcgctggatgaatgcagatctagtttggtctgtggctagtttaaatatgtttctaaccacagagaatttcatatatatatacatatatatatacacatacatatatatatatatatatgtatgtataaaatttcacagggatatgcttttttttttaaagactgaatgtgttcaccatttagcctgtagatttatttccattttccaaattccagcacacagagatcccagcccctatgagtagggtgtttgtggactacctaatggaatatttttgaggcctggatgaactttgccatatgggtagaggttacagagggaggtgatattttcagctaaaaaaaaaaacgggtggagtttggactgatcaacttgagatttaaaaactgctattccttttgttctttctagcatctctccccaccctctgagagctcctcaggcttagatagtgaagtgatcaaatgccagtgtcattttgtacttaagttccaaagtaggaacattttatacttttttctgtattgtaataggtagttttgtatgaaatcttttctcctctcccgttgtaccgcattctttccagcattgtgctttttccctgggcttatttgaaaattttactgttttatacaagctcgtttagtacatttttctatgttttaccacaagttacaatttgaaaagaaaactattttttttaaatattccattgttaactgaatgttactgtttccactccagcaactacatgtcctcccttcaactgcctgccttttggggaaagaccaccttttgtgtgtttgttttttctctctctttctttccctttctctttctatctctctttatttttctttctttttctttgtttttgagttttctataggaaataaatagctttctatatatgagttgctggggaccttcacattctcttttagaaagctgtggcatgcagtctcattgcaggactcctggaatattgtctggttcttggtatttactgtatgtaagcaacaacttgaaaggtggcaatatggtgtcgatttggactatgaatcaaaagacctttttcaggttctttcactattgtctgggggactcagaacaagattgttctctgtatttattgtttgtccatttaggtaacatctgtcttaccttcctcacagactttgtacagaccaaagcaacaaatatttattgccatgtatagcagaaaatgaaacatgcaacaaaagcactttgaaaaatatataaggaattgttgagcctgtctgaatttgggccccctttctgactaatgcagttttgcacaaggtagaagttagtgaccctgagaccatcttaccaccctggacctggtccaaatacagacttacacagtggaccattctttcctgagctagccaacaagagcaggagtagtatctggaaactttcccctttgtttaggggtaggctttgatgaccaggaaaaaaaaaaaggtatttctgcattttatggcccaaaggcatgttattaatatcttatgtaatttactttaaactaaataagacttttttctcctgtgttcccctttctcctgtgtccactgctcatattcacctgccttccctaaaaaaggaatatttgagggatgataagcactagatgccagctatagagacctcaacagaaaccataatcccaagaatcactccgagaccctgaacagagaatatcagacagacctttcttacccatttgagaaacacatggtctgaggcacagaggctagttacatcccatttgtcacctg

SEQ ID NO: 12139 - DNA, 1048 bp, Homo sapiens
ggtatacaaagcacttctttcacaagcctcactttctcacttttaacaaatatttactgagagcctactgtgtgccaggtactagtataaatattgaggataatagggaacaatgtgaagtccctattctcaaggagcttgcattctacttgaggggaaggatgaaggacaatgtgaagtccctatgctcaaggagcttgcattctacttgaggggaaggataaacaaatgtatatgccttgtgataagtgctatgaagaaaattgaagcagggtaatatatagagtaggattgggaggatactatttgtatagggtggtcatggaaagtctctgataaagtgacttgagcagagacatgatggaggtaagagggagccatatggaaatatgggactctttcatgtgtttttataagctggactattttcagtttgcaaatacaataagcatttcttaccttcacattcagtgttctttttgcctggaatgtcctccgtacctcaactttgtctgtcagtagtgttttatcttttaggtctcaactcacatgtgaacttctgcatgaaactttacttatctggaggtatcaaatacttcttcctctgtaatacagtaatagtaatccatagtaaccattactatgattgctatgcctttgccatatatggctttgggaattcaattgctaggatgagaataatatcagttttccgttgagaagattaagagtaatgaaatattctttctcatctcagttcccctacttctttgcagctccccatatgttctaagctttaaatatttcttaaaattctctatttgttaagtcttttggggagacttcatagtttggattctttatttcttacatcttttttggagtcagatctgccttctgatcttgggttggaaaaggcttcatgtagctttggacaagttactcttatgaacctcagtttccttatcaataaaatgccagtattgataccttacacttaattgtgaagattaacttacagataaaacacttatttttataagtgctt

SEQ ID NO: 12140 - DNA, 1090 bp, Homo sapiens
aattacaggcgtgcgccaccatgcccagctaattttttttgtatttttagtacagatgggctttcaccatgttggtaaggctggtctcgaactcctgacctcaggtgatccacccacctcagccttccaaagtgctgggattacaggtgtgagccaccacgccccacctttaactcattttaaaatctgcaaattttcctaaaactgaaagtacattttattattctgaattttaattttttcctagttttatataaatgactccagggtagttatacttttgctttccttacctattttagaatactacctcaaatatttccttttttttttttttttttttgagatagagtctcactctgttgcccaggctggagtgcggtggcccgatctcggctcactgcaagctctgcctcccaggttcacgccattctcctgccccagcctcccaagtagttgggactacaggcgcccaccaccacgtccagctaatttttttgtattttttgtagagacggggtttcactgtgttagccaagatggtctggatctcctgaccttgtgatccacccatctcggcctcccaaagtgctgggattacaggcatgagccaccacgccctgccaaatatttcctttttttcctcttctgaacacatttgaaaatgtttcagataacttttcattattaagatatatttgctccatagccttcttcctctcttttcacacataacaatcacttctatactgtttagtcagtcgaccaaccaatatttgttaaatacctaccttttgtgagattctgtggctggccttacatgggtgaaaaagtagaagacaaagtccttgccttccagttgattacagtttcgatggagaaacaatatgtacataactatattgcaaggcccagtgttataaataacttaatggtggtgctgatcataaaaaccacaaaaattcaaagaaggaaaataatgttttttgacctcttcagccttttaaaaatcctattccttgcctagtcgtttgtaaaccacacagagctccacgggggtcttagtacctcttggggaaatctcgtgcta

SEQ ID NO: 12141 - DNA, 1137 bp, Homo sapiens
cctttgctttttgatccttcactaacccttgaagatcatttagtcaaagaaattgctgaagacccagtggatattttggcaagtgaagaacagtcccacctgtttccctcatgtagtgacctggccaggcagagggttccctgctagatagcatgtgctcctggaggggagtggggtgtcatcactagtataaagatgctccacatgtctctcacttattgaataccatataagcaaagcacttttaaaaatgccctactctgctcctgtgtacccttgttgctgtagttctccagatgggctcttagaacacctaatggcccgtgatcctcatatcccagagtaggacatacatttatttaaataaaagcttgagacaaggaatctagggaaatcataccttctgagggagagttcatcactgaaattgttctcattgtagaaggaccagtaaagtaatgtgatttgagttctgtccgtgagccttgggtagaattccagtggccctgactgaagaccagcagttgtactgtggctgttggtttcaagcagaggcctaaaggactgtcttcctgtggtctgttggctgttctgggacctcagtagggaatggctatttcatttggaagaaacaacctacagctcaccatcccattggaagaggctcaggaataggctcttccaagggactaggatagctaatatgggaagagcatctgtccagaattaatttctgttgtattgttcttattgctagtttaagtggccactgataagtcagattcatacttcagaccacagtgaatgaattactaactgaagtgcctttatttcttttaacagggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggac

SEQ ID NO: 12142 - DNA, 1053 bp, Homo sapiens
tgttagcatattcatttagagaaatctaccctaccttatatttttttccagactcttcccatacctttttagggatacaatttacatactataaattgcactctttgaaagtgtataattgagtgatttttagtatattcgcaaagttacgcaactaccaccactatctaatttcagaaggttttcaccatctccaaaagaaactcagtacctattatgacactcttcattttcttctcccctcagcccctggccacgatgaatctactttttgtctctgattttgcttattctggacatttcatatcaatgtaatagtatatgtatccttttgtgtcttgcttgtttcacttagcataatgttttcaaggtttatccatactataatatgtatcaatacttcattcctttttgtgactgaattaatattccattgtttggaaataccacgctttaaaaatatatcagttgatggatatttgtgctgtttctactttctggctattaaggaatatactgttaagaacttttgagacagagtttctgtcggtggcatgagccaccacgcccagcttagttatcatttttataacttttttttttttaaattggggtcttgctctgttgctcaggctggagtgcagtggcatgatcatggctccgtgcagcctcgaactcctgggcttaagtgatcctcctgtctcagcctcccaagtagctgggactataggtttatgccaccatgcccagccaattttttattttttgtatagatgagatctccctatgttgcatgggctggtcttcaactcctaggctcaagtgatcctcttaccttggcctcaagtgatcctcttaccttggcctcccaaagtgctgggattacaagtgtgaaccactgtgcctggccactataacttggcttttttttttttagactgagtcttgttctgttgttcaagctggagtgcagtgatgtgatctcagctcactgcagcctctgccttcagggttcaagtgattcttgtgcttcaccctcctgggtagctggga

SEQ ID NO: 12143 - DNA, 1044 bp, Homo sapiens
ggctcatgcctgtaatcccagcactttgggaggccaaggcaggcggatcatgaggtcaggagatcgagaccacaatgaaaccctgtctctactaaaaatacaaaaaaaaaattagccgggcgtggtggcgggcacctgtagtcccagctactcaggaggctgaggcaggagaatggcgtgaacctggggggcggagcttgcagtgagccaagattgcgccactgcactccagcctggacaacagagcgagactgtgcctcaaaaaaaaaaaaaattttttttccagctttgttataatcttatgggaccaccatagtatgtatggtcaatgattgattaaaaagtggttatatagtgcatgactataattagatttatttctgtcttggtacctggattgggggtcatttgcttttgaaactgcctatcttatgcccaaggattttcctgtttacttgttgacttggagacgtaaccttgatggattgcttggcaaataacatcttgactcttgtaactctaggcagtagtctcctgactggcccagagggacttttggccaaagaacgagagaacttaaagcgattaaaatgtctgcgacgataccgccagcgctatggagtggaagccttactgcataggcagttgaaggaacggagaatgctggccacagatggtgctgcccaacaggtaatttgtgtgtatacctttaaggtatatacgttcactttatttattgtttttattttttcgagacggagtctcgcactgtcactcgggctggagtgcagtggtgcgatgtcggctcactgagatctctcaacctctgcctcccagtttcaagcaattctcctgcctcagcctcccgagtagctgggattacaggtgcccaccaccatgcgcccagctaatgtttttgtattttttggggtttcactatgttggccaggctggtctccaatgcctgacctcgtgatctacccacctcggcctcccaaagtgttgggattgcagacatgagccaccgtgcctgttcatgttcac

SEQ ID NO: 12144 - DNA, 1050 bp, Homo sapiens
aacctctgcttcctaggttcaagcagttctcccacctcagcctcccaagtagctgggattacaggcacattccaccatgcccggctaatttttttatttttagtagagggggggttttgccatgttggccaggctgctctcggaactcctgacttcaagtgatccccctaccttggcctcccaaagtgctgggatttcaggcatgagccactgcgcctggcctataagcttttttttaaagagacagaatcttgctgtgtcactgaggccagagtgcagtagcgtagtcctcactcactgcagccttcaactcctggactcaggctatcctgcctcagcctcctgagtaactaggactacagatgcaccaccacactcagctaatttttaaatttttgtagagacagggtctcgctatgttgcccaggttagtcttgaactcctgggctcaagtgatcctccgaccgtggcttcccaaagtgctgggattgattacaggcatgagccactgcacctggcctttataaacttaaaaaaatttttaagaaaaacttctggactctgtaataacacttagcttaaaacacaaacactgtacagctgtacaaaaattttttttatatccctataagcttttctagttttaattaaaaaaaaatccttttaaacttctgttaaaaactaagatgcaaacacgtacattagcctaggcctacatgggcctagtgtcactgtctttcacctccacatcttgtcccagtggaaggtcttcggggacaatctcatgcagcgaactgtcatctcatgataacaatgtcttctgcaatactttctgagagaactgcctgaggctgttttacatttaactttttttttttaataaatagagtggagtacattctaaggataaatatagtaaatatataaaccagtaacatagttgtttattatcgagtattaggtactgtgcataattgtaggtgctagatttttttttttttttttgtgatatagtctcactctgtcgccaggctggagtgcagtgtgtga

SEQ ID NO: 12145 - DNA, 1054 bp, Homo sapiens
gtaattagcatattcatcagctcaagcatttagtgtttttttgtgtgtggattttttttttaaaaagaagaataaaaaggtattcaagagtttggtttcatgcctaagaaagagaaaccgatttagaaacccaaaagtgattatatcttaatcaggtttatatcttagtaagcttctgctcttcacttaacccatcatcaccgtaggagttgtagaagcataaaaacattaccactctggagtctcatatttctgtgtctcaaggtctgggtgtagtttttaaaaatgtttgcctgctgacttctgtgtcttaacactttgtactgacagtttatgtaaagggactgtaaatagtggaaggggtaatttctagattgactattgggcttttgttcttgcaatagcattttcttcattactttggattctttggtttataagaagtcatttagggttacattttctcctgaccctgcttagcttctgagatcagaggaggttgggcatgttccggatagtatggccgtatgttagggttacgttttctgagtagaataatttcatccatttctattgagtaatctcactgtggtcaactattcaggaagtactagtttagaaaacccatctaagtagttggaaagggaatgactgttctcttgcaggattctctcacaaatagtaacttaaaccaacatattcattccttttttttttttttttttttttttttgagatggagtcttgcactgtcacccaggctggagtgcagtggcatgatctcagttcactgcaacctccgcctcccaggttcaagcaattctcctgcctcagcctccctcccaagtagctgggattataggcacccaccaccacacccaggtaattttttgtatttttagtagagatggggtttcaccatgttggccaggctggtctcgaattcctgacctcgtgattcacctgcctcggcctcccaaagtgctgggattacaggcatgagccatcaggcccagcttcattccttttttttccattgtggttctagatggcc

SEQ ID NO: 12146 - DNA, 1047 bp, Homo sapiens
tgctgttagctgaactgtagtgaagcatcgatccaaatcggtcttctgaagtatcagttatgcttttgagtttagaaaatacttaggtgttagtctagtcttcccattcatgaatcagtgtatgtccatatcagagagcctcaacttcttttttcttcctttttaaaaatgattttagtgttttgatttagtgtatactacatagttcagtattattggctttaccagtgttgacagaaaaattttaaatctccagttgcaaacagcaatggattaggatatggaaataaaatcatggtgacatcactgctgagttatcttaaacctctgctacttaattctccatattgaaatgcatactcctccacatacatggcttccaagtaaaggcaattgtagaggggccctgtctatcccagtatggttggattttaaacatatctgtgtttccgttattttgggaactgattaatatttacaattttttttgtttatgagttattttgatactaagaaaagagagaatctagaacatcttgcagttgaaatacaaattttattcttttggtcttgggagaatttaagcagtctatgcaactcatcaaatggtgagaaatagccctccgaggttccagtaagctttcagtgactttgatacctccccaagtttcttgagttgctgcttgttaacacccagcttttaactgagtgtttgctcctgatggtttaggagattttcatgttgtatcacactgtcaagttttattttgtctttttatccctccgtggatgtgagtttgaaacaagcacggtacagtaatcctgcctgatagagtagtctggaatgagaattactttttgggtgagagagttctccattttaatgtttctaaagtttttcatatgaacttggcattggaaaagggaggtaaagaaaaaggacgtttactaaaagcagtgtctactcttcccctttgtgagtgtttattcatggctaatgaaaaaaagagaaggactcttgggttttgtgttgccatgttaagcatg

SEQ ID NO: 12147 - DNA, 1029 bp, Homo sapiens
ggagcttgtgaatttaacagtactggtgccatgagaatgagcaaagcctagccaatggatactattgtgtttagattgttcatctttggtagctttaggttcttgatcgaggttcttaagatttctaagtcctttataaaaataggtcaagagtcctgttgttatggaggcttgattatcccagatattaggagtgaacatttttaataaatctttcagaaaatcttggctagaaagaattctaagttagttgtctaaccactgaaaactacctagccagagatcatttaatgagatattctttgatcttcattgcattttttttgctctggaaaaggtggttcaatttgagtttgttttcatgatttgattgcagcttacttcatgccaaggattttttagggagaggtcgaattatttttcatttggaagtcatagggagacaggagttgtacttatgctgctacttgccaggaacaggttgggaagaaaattgtggctgttggaattgatgatgtactggcctaatatagaaaggaatttgtaggcaggagtaaacgttaactgacggtgggttagtgccctgcatcttgcatatttgaactgtctagagttcctgccattgctgggtataaaacgaggagctctctgttgacctgtaaatcattaatacttcttgacttagagtgtcacttcactttatagatgacattttcctctttccccttgatattttctatgttgtgttagataattggtagatatatagttgtggtttagtacatttagggcttctatttatttagattttgtttgttggagtctgtttccaaaagggaatgtgccatttagtctgcatctgtatctttgtggacttgatgatcactggtttgattttgaaaaatgtcttttccagcttttagttactctcatcaaatgtcacatattttctaatcacatgcactcctttaccacagaggcacataatcatttggcctcatagcagttatccatggccgtactgtagta

SEQ ID NO: 12148 - DNA, 1201 bp, Homo sapiens
ggctgtgtttgatcatccagccaagattgccaagagtactaaatcctcttccctaaatttctccttcccttcacttcctacaatgggtcagatgcctgggcatagctcagacacaagtggcctttccttttcacagcccagctgtaaaactcgtgtccctcattcgaaactggataaagggcccactggggccaatggtcacaacacgacccagacaatagactatcaagacactgtgaatatgcttcactccctgctcagtgcccagggtgttcagcccactcagcccactgcatttgaatttgttcgtccttatagtgactatctgaatcctcggtctggtggaatctcctcgagatctggcaatacagacaaaccccggccaccacctctgccatcagaacctcctccaccacttccaccccttcctaagtaaaaaaagaaaaagaagaggagaaaaaaacttctttaaaaaaacacataatttttcttttttttttttggactaagaaaattacttatgaaatatgtcatccttggactagggaataaattgatattgagacatagttaggagggtggtagaaggccttggctatatatctgctgtctcatgcatttaactattttcttacagtttttactggtattagagaggtgttgaagctgtgaaggattaaggacacattctgaattcttggcctctccaccatctaattaggttgattggagttgatatcttccctcttcttgccagagctgaaaaatggagggtttcttgtatcagacaattgtggatcctttcggtgtttaatatatcagaagagaggaagtatttaaacgtcaaatcttttaatagacttaataatttaaagaaagtaagttatctgtttagtttttttatataattgggaaggggatagggattttgctgtgtgtatatgatacatagcagtaactcctggtgggtgggattggagggtgggaatgtgtgagggtgggtgggaggctaggtttttggctaggagttctgaaataggctcaggccacttttttcagacttttaagtgtgtatgtaagtgtgggtatgtgtgtttttaagtgtgtgtgtttaaaaataatgttttatcttccctccctgttccttaccgttttcattttccaacagtctactagagaaaaacatggttggccttgagaa

SEQ ID NO: 12149 - DNA, 1046 bp, Homo sapiens
taatatattacattatttgatgatttggggattaattaattaaatcttaattagggctacttaattaaaaacttttttttttttttgagacggagttttgctcttgttgcccagggtggagtgcagtagcacgatctcagctcaccacaacctccgcctcccgggttcaagcgattctcctgcctcagtcttccgagtagctgggattacaggcatgcgccaccaccccagctaattttttatttttagtagagacggggtttctccatgttggtcaggctggtcttgaactctggacctcaggtgatccgcccacctcggcgtcccaaagtgctgggattacaggcgtgagccaccgtgcccagccttaattaaaaactttcttaacagcaaaagtcacttttcccaaatatgtcaaagtcttctagattctgatcttgcttctagatcatcttagttcatcctgtagtttagtgattctcagtgaatccttacatcagaatctctgggttacttgttaaaaaatgcttgcacccttctccaaacatttaattaaattttagggagcaggtccaagaattgcatttaaacaagtacctcagatatgtggtgtgcagaataaagcttgagtacctagatctggaagcagcatagttattaatgttaaaattaaaaatcattgatctgtctactttggcagaatgtaaacgtcaggtttacagggaccatgtgtgtctcatttgccactatattcacagtaccttgcaaatattaaatgcttactaaatatttgttgagaatgaatggaactaataacttttttcctcccccacccctgactttttttttttttctttagcaagcaaggacttagcacagacttcttacttcatggcaaccaacaggtttatattttaatttttttttctcttcgatttttggtataggactttacttgagtttgatacagtgtgctatagataattctctggtgaatgttgatttttctgcacagttttcatgttgtactttaaatttccatggta

SEQ ID NO: 12150 - DNA, 1031 bp, Homo sapiens
ggaaatggctaggggtgagccaggcctccccctcagttttacccaagaggaaactgaggtcccaaagtttaagtgacctgcccaattttgcaggactagttctagttcaagttagagcccagaacctctggcttccaggaagtgcttctgctgtttctctcccttctccttaaaccagagccctgccccatccaactctggggtggagccgcaagctccaggttaattcctgagtttccagaaacactgaggccagcttcccttagacttgctctctagccagtgccgctgatgatgattgggggctgaacattcctagggtggggccctaggcctagggcctggcagggctgagtgtcagagggagttacaccttgaggggtggccaggcatggtggaccccatctccaattaggggacatcctttgtatcagtagaactgatgactctcaagccagggctctgaggttgggcttgagagcttgactcagtagagtgagtaggaatcttggaaacctggaatgcactacaaagtatggaatgcagtagatagatagtaggattaggacacaggatttggaatctgattgtcctgggttcaagtctcacactagccactaacagctgtgtgatcttggggaagttacttggcctctctgtgcctcattcccttacctttaaaatgggatattgttacctatttcacagagttttaagaaatgtgttaggggccaggtgcggtggatcatgcctgtaatccatgcccgtaagcactttgggaagccgaggtgggcggatcacttgaggtcaggagttcaagaccagcctgaccaacatggtgaaaccccgtctctactaaaaaaatatacaaaaattagccagtcatggtggcaggtggctgtaatcccagctactctggaggctgaggcaggagaatcgcttgaactgggaggcggaggttgcagtgagccgagatcaggccactgcactccagtctgggtgacagagcaaggctctgtcaaaaaaaaaaa

SEQ ID NO: 12151 - DNA, 1079 bp, Homo sapiens
ccagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaagactgttagatctagttctagttaaacttcccagcttctccctggcaggagggacaccactgggtgcggggtgggttggcttggaaaatgagagacagccacattaagagaagagtagaggggtctctgctgatagtcttgagtct

SEQ ID NO: 12152 - DNA, 1072 bp, Homo sapiens
tccagcctgaaaaaacatatgaattctgtaggggacatagttcagtccataaccgagtccaaggcctatttgtgttttcctcaacaggcttaatgcctgagcaaatacttttgggttccctgccatctccccatcagtgatgtgattgtaccctgctcccagatcctttgttgacagttccaatctcttttgtagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttgggtttgttattctaccctgtgtagcccctagatggaagaggaaagagtgggatgagatacagtgtctcttaggagagatagaaacctgttcactctggagtttggaaaggggaaggatggtgggagtttatgagaaaacatttttctgttagatctccatttaccccatatcataagtctacccctttttttcttcatttggggttcctcgtctggattccctccattccctctcctcttttcttccatgagctcttctgcagctttgctttctttggtctgcagaagatcctcaggaacgggaacgtcgggaacgcagggagaggatggaacgggagaccaatggaaatgaggatgaggaagggcggcagaagatccgggaagagaaggataagagcaaggaactgcatgccattaaggtgcaggccttggctccatcttcacttctctcccacacaaaaatgaggtttagttatttggccattgtgatctctgcatgtgagaattgggcctcaaagctcatgtgctttgtgttctgtccctgggtaggagcgttacctgggtggcatcaaaaagcggcgccgaacgagacatctcaatgaccggaaatttgtttttgagtgggatgcatctgaggacacatccattgactacaaccccctgtgagtggcttcaggcctgagttctaggtcttttccactaggcagtcctagagagctgatgactacggaggtggagg

SEQ ID NO: 12153 - DNA, 1051 bp, Homo sapiens
tacatcctggaactttctccacagatcttctactctgttctccaggtgcagtcttagaaagtgcttctcttctaaattctagcaagtgaccccaaaatagcaaatgtttggaattaccttattagtgccctttcacttctaccagcaatcccaccctcttgaactgtttgtagcatagtttagtacagaggtctcccatgaaaatgcctacacaagaccaggcagatgatataaatatgttttgtgggccgggtggggcctgtggtgaactggagaggaaatgctgcatttgggaggaggaggggcagtcactgagctccacgtgagccttgccatttggaaatgtggcccagtgttgccagatctttaaatttttcaagggaagctgaaaatttggatgtttttgtgaaatctccaatttttaagtgtaggatgcttattcaaaaaattgtataaaacactgtggggtaaataaaaacaaagaactccatacccaaacctaggtctgtgggctggctaagattgcaacctcgaggacagtggaaagcactttggatcaaggggcaggagacctagattctcctgattctaccacaaaccagcagcatgactttggcaggtcattttacttacttgtgccttactttcttcatctgaaaatcacaggggtgaagccagatgatctccttggtgctttttagctctaaaatgcattcccttgacaatttagaatggtcctccctcccaaccaattttcacaaaattacaaaaagcattagggatacctacagggggcaatagatgttttattgactgtgttggctaaaggggtctcttctacttctagtagccttgagcatttttctttttttctttttttaatttttttgagacagggtctcgctctgtcacccaggctggagggcagtgttgctatcacagttcactacagcctccatcttctgggctcaagcgatcatcctacctcagcctcttaagtagcttggaccataggcacacactaccacgcctggctattttctttcttttt

SEQ ID NO: 12154 - DNA, 1023 bp, Homo sapiens
atagcaacatccctacatttctcaaaaaaaaaaaaaaatctctaggagttgaaagatttttttccttagatcacaggttgtggaagatcatctgggctgcttcaattatattttaagtggttggatgttgtttatcacctggatgggctatacgtatggacaagggctggagtaagttgctttgatagttgactataaagagtgggttgagctggctcagcacttcgtcactcactgagatgccatccaagtactgcttcagcatctcccgcagcttcccattgatatctagcagctgggctcgtctatgttggaggctcagttgctccagtttcactttgttgtaccttttccagaaattctccattcctatgtagtccaccatcacctgggagtggagttacagggagaaggtgtgcagcgagacccattagcaaatgctgcccaatgccccaccatcccccgggctttaccttggtgagctcctcagtaagctcttctagattattcttctgaatcccctcctgctccttaggagtcaatactgatgaataaaaaggcagcactttttcttcttcggtttcaaatttcctacatatttcagcaagtttaaggatcttttcaccctatttgaagcgggaagagagtttatattaggaaagggagtgaagagggaagctagtggagttggttcccctgtttgaacccagggaagctactcatccaagtgggaaacaatagcaataaatacatatagcaaatggaggttaccatgtaacacacactattccaagtattttcttattgtaaaattgattcatagcctgggaaacatagaaagaccccatctctacaaaaaattatttaaaagccaggcatggtagcacatgcctacagtctcagctactggggaggctgagatggaaggatcacttgagcccaggaggcagaggctggagtgagacgagatggtgccaccacactccagcctgggcaactgagcgagaccctgtctcaaaaaaa

SEQ ID NO: 12155 - DNA, 1072 bp, Homo sapiens
aaaaaaaaaagaaatctggtggctcacgcctgtaatcctagcactttgagagaccgaggcaggcggatcacctgacatcaggagtttgagaccagcctggccaacatggtgaaaccccttatctactaaaaatacaaaaattagccgggcgtggtggcgggtgtaatcccagctacttgggaggctgaggcaggagaatcgcttgaacctgggaggcggaggttgcagtgagtggagatggcaccactgcactccagcctgggccacagagcgagactccatctcaaaaaaaaaaaaaaaaaaaaaagtgaagtctttacataaatggattacgtgtgctgccctttgagaagtttgttgatgaaaggagaaaggaaatagtagcaccagaggaaaagatcagggatttaccctgttcttacaggataacagctccttgctcttttcagctagcttttcaaaggacagggataggacagccccctgccttatttcggatacttggatctataacctccagaaattcaagctgaagtagctggaggtcggagaggaatgagaactgcctgggtggggtctgccagccagacactgccaggatagccacaaggagacgacttggaagaacagacagcaaccacgttggactcaggcagtcctgggtttgaatcctgtctctgtcaccacctagcctgatgaccttgggcacatcctgagcaccctgtgccttatctgtaaaatggaaacaatcatgccgacctttcagggtggttttgaggattagagactagctcctgacacacagtaggtaatcgtaaatgggtgctattgtttggcccgacccacgttataggacagaacgtctaacggatgcgtcagaacctgcgccctccggatcttggagggtacagagggcgcccctcggcctcctccctttcggaggtggggacaaggtggaggaagggctgcaggaggaggagctctagcatcgcgacccgccccgtcccgtccagtctggcctgggcgccgcgggaacgctgtcctggctgccgccacccgaacagcctgtcct

SEQ ID NO: 12156 - DNA, 1046 bp, Homo sapiens
tgcttctttttgcttcaccatcctagcgtgcagcttccatcctcatggtcatctcatggtctaatatggcttctagagcttaattcatctcatctgcattccagatagcagacagaaggaaggaaagatgattagggggagagagagcagcacagaaggacgctttctagttaactctttaaagggccttcttggaagtccaggacaatacttccaacacttctgtttatgttctcttggccagaacttagtcaactggccatatccagctttaagggagacttggagttttgtggtttttttgtttaacttaaaaaatatcttgatacgtaattcgcaaacagtgaaatgcacagattgtaagtatacagtttgataagttctgacaaatgcatacacccatgtaacccacatccttctgaaaatatagagcatttcatcacccctagaaattccctcctgctgaggggactttttttttttaaacaatacaaatgagagataatgaaggcttcttatcctgaggtgggagggttgtagctatgggaatggaagggaagagctggagagactttggaaggagaatccagagtagacccgttggatgtgggagatgagagaagaacgaatgctggtagcagagccactaacagaaacaggagatagggaggaagtctaggttgttgcaggtggattggaagaatgagtacagttaagactgttggctgggcgcattggctcacgcctgtaatcccagcacttcgggatgctgaggctggcggatcacgaggtcagcagtttgagagcagtctggccaacatggcgaaaccccatctctactaaaaatacaaaaattagccaggcgtggtggtgggtgcctataatcccagctactcgggaggctgagagaaaagaatcgcttgaacccgggaggtggaggttgcagtgagccaagatcgtgccattgcactccagcctgggcgacaagagtgaaactccgtctcaacaaacaacaacaacaaaaacttttaaaaagtgggctgggc

SEQ ID NO: 12157 - DNA, 1044 bp, Homo sapiens
agtgaatgtcctttaggaatgttcatagcagctttctgtacatggactgagctacttcgaaaagtaaagtttcttgttaatggggatgaaagtcccttccaaatctgagatgctttggtgaacaaacttggtgaaagcatgaaagataaattgaagaacagatagatttgggccaaggaccccagtttaaacaacgttgcagaggtgagaggtaaaagcctaaattaaggctgtgatattggcaatgagagagatggatctgagacatttctaacataccagcttagctgataagtgttaagaagacagctgtgcaaaacaaaaaaacaagatgggaaccacagcgagaataataggattggagggacaaatgttttgtttcgtattcaagcatttgaggagtctctgtgacatctatggttgtcaaacaaataattggaaatgtagatcagaagtttggaagaaattgcgagtctatttgtcagatgtagactgtgtctctgtaatattttgtacttgcgtggtacagtggtactttctcaggtcccttatgttattaaaagtagaaaggaggccaggagcagtggctcttgcctgtaatcccagaattttgggaggccaaggtggccggatcgcttgagcccaggagctcaagactagcctggtcaacatagcgagaccccatctctacaaaaaaatacaaaaagtagctgggcctggtggtatgttcctgtagtcccagcagcccgggaggcagaagtcggagaagctggggaagttgaagatgcagtgatctgtgatcatgccgctgcactccagcctgaatgacagagtgacaccctgtctcaaaaaaaaaaaaaaaggtagaaaggagtagatgtaattacataatcccccctctgatatggtgaaacaggcagaaagttaaaagtcacggccaggctcggtggcgcatacctgtaatcccagcactttgggaggccgaggcgggtggatcacgaggtcaggagtttaagaccagcctggccaacatagtgaaacccc

SEQ ID NO: 12158 - DNA, 1033 bp, Homo sapiens
atggtaggggggtgtggggcggacacatggagctccccttgtgggggggccccctccattacccgacctaccgcccttttcctcaccccccaccccactccccaccccctggctgtgactgctgtaagatgggggtatagaggctgggcaattcccaccccctgttgtatagttggactatgttataacgcacaaaagagagctgaccccagggggagccagagggtgatgggttccttgcctccctttccttcccctttctgcccaagcttgtgctgcagttgaacctcttcctgggggtgggagtaggtaaggggtgggtgaggccccaaacccctctctggtagggaaccgtggggatgaagatgaagcttatatgcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgt

SEQ ID NO: 12159 - DNA, 1045 bp, Homo sapiens
tgggggcgcggctttctgccctttcctctccctgagccggggcggctgaaaagcgcctttgtggccggagctgctgagtccgcttctcccagcgcgttcccggcctgggctcaggattctcgctcggttaagtcatcccggataatggccattgtacttcgcgcaacccccgccaccccaatcctttttccagcagccttgatcccgcacagctcctcttgggcacctctctggggggcacccagagcacgaaggggttaatgctaagggcccaaaggaggaggaggaaggaaggaaggaagcgatgcccggtgccagggaaggcaatgaaacaaaagatgaatcaggcggagggaggggagccggtgcctggggcgggggccaggctcaaacaggggctctccgggagcaaccaggccctccctgaccacgcttccattcgccctcctaactctgtccttctcccaggttgagccgctgtccctgaaccaataggggtgagggacgggcattaaaaatggggaaggagctaggtatgggcaccccctctcaacctcagaggtgagcccacagttctccaacgacgtcctgggaacagagtgcagattggtgactaccatcgactcagattctcatttctccaggacactcaaaagctgggaggggtaagagtagggccggaataacaaagaatcaaccctcctatccaggtcccttttgccccaagggtggtggtggggagactgactcctttattccccgccagcgttgtaaggagcgggtgaacgctttggccattgccgtgatgaacatgtggcccggagtgcgcctacgagtgactgagggctgggacgaggacggccaccacgctcaggattcactccactacgaaggccgtgctttggacatcactacgtctgaccgcgaccgcaacaagtatgggttgctggcgcgcctcgcagtggaagccggcttcgactgggtctactacgagtcccgcaaccacgtccacgtgtcggtcaaagctggtacagtaggaggaggg

SEQ ID NO: 12160 - DNA, 1896 bp, Homo sapiens
gcccctggggccctgactagaaggaagtacctgggggatcagaacagaacatacttccagatggaacccttggaagtatggagccttatcttgaggaagtgatggcctggaattaacagagaggcccttggggctgtggagtgtgctgaaggttagagcttctcatcccagctcatattctgctacagatatcaacacttctgtttgcaacactgtacatcctctgccacatcttcctgacccgcttcaagaagcctgctgagttcaccacaggtactttgatttccctccctcctgctagagtccctgttgccatggaccagcctcaggggaatgggcctatggtacccactgggaaaggagcagtggctgtgtggggctgttctggagcctttgcctcttcagcctccctttctgcaagataggggcaagggcggctagatggatgtgtctgctgggcaagtcatataacatttctgatcctcagtttcatcctacaaaatgggcgtaacaatgtctacctactccattgtgtggaccaaaggagatggttaatgtgaaagccctttgtgaacctgaagtgagcaactgctggatgaatgtcattacgggcacaggctctgtgtcatctcctctcctagtgcttccacagccaggaccagagacctccctgatgactggggaacctggtgatggtggcctttctctttatggggagcctgagtatgctcagatcgcagctttccttccctagacattgtgtaattgggggtgggggcacacttgccccagttcctagctccagcctttcctcctcttaggatggctcaggatgagtcccccctcaacaaggcagctacccaagagtaattcccctggggactttctgtgtgaatctccccttccccctcctctcttttccctttcctggacccagccactgatgtaaccaacctcacagactagttgtttattatattaatagtttgagcatataaagaggaacttgtgatgggagagatctagggaggagtaaagaagtataggaatgtctggcctgtattctcttcacctgggaccactgatttttaagctgccaccttggctggagaacaggctatggagttcataatgtgtggtctcctggagcctcctgttcagctctgccttctttgagggggcagggatggggcagggagcacattgtaatactaacggcctcagagctgccccctgatgtcctcctgcctgttccccgtgcctctgtctcttacagtggatgatgaagatgccaccgtcaacaagattgcgtaagtgtccctgcctcagcacctaacatcagtggtctttaggaactgggatctagggaggcctggagctggagggagaagggggaagtctcacacagtgaagagagagtttctgtttccaccccatttctggcttccggctttacctcaccctggggatgctcagaaaagctgctgttcctgtcttcctggttaggccaggagcttgtgggagcctcatggccaggaacgtccgctggggcctgagtcaccggaaatggctccagcttggcttcacctcccagcgaccaatagggagggagtggagtggggatgcacattgatggaaaaagagcagggtgtggggaaggtgggaacccctgagggaggggcatgcttggttctgggagaaaggcccatattccaggctgccagtgttcactggtacatacagaaaaagatagagatatgactcctttgagtcaatagatcagaaggcagccctccacccttgatggaccaaagagctagaagtgcccatcttcaatatatgcagcccggggcatagaccttggctatgaagctaggtttcagttccctcttgtcc

SEQ ID NO: 12161 - DNA, 1071 bp, Homo sapiens
gttgccagagctggagtgcagtggcacaatctcggctcactacaacctccgcctcccgggttcaagcaattctcctgcctcagcctctcaagtagctgagactacaggtgcatgccaccacgcctggctaatttttgtatttttagtagagacagggtttcgccatgttggccaggatggtcttgatctcttgacctcgtgatcctcccgcctcggcctcccaaaatgctgggattataggcgtgagccactgcgcccagccaatttttgtaattttttttgagatggagtcttgctctgtcacccaggctagagtgcagtggcgccatcacagctcactgcaacctccacctcctgaattcaagtgattctcctgcctcagcctcttgagtagctgggattacaggtatgcaccaccacacccagctaatttttgtttttttagtagagatggggttccaccatgttggtcaggctggtcttgaactcctgacctcatgatcctcccactgtggcctcccaaagtgctgagattacaggcgtgagcctcaacgcccagcccaatttttgtatttttaatagagacggggtttcaccatgttggccaggctagtcttgaactcctgacctcaagtgattcatctgcctcggcctcccaaagtgctgggattacaggtatgagccacagtgcctggcggagactctctgttcttgattatagagccaagctggccaatggctcctcctctgggcagcagcagcttacttggagtagagtaggaatgaatatgcagattaacctggctgagttccgccatcactgtcacttggcagtccagccagctctagaaacactatagatattgggccccagctaaagcccactgttaggggtagaggattaaatgagactctggtttggcccagagcagacctgatctttcaggcccctgaataagcatggaatagaagttgtgacttggtctagaaacatgacaccttctttgggtcaaggcagcagtgtgcatggaggtaggagggtggggtagcaatggggtgccaggacaatgc

SEQ ID NO: 12162 - DNA, 1050 bp, Homo sapiens
tgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatcaaaagctttgtttcctgcgtttttttctaaaagtgccttggtttttagattcatctatacttggagtatagagagtctggtgtcaaggatcccacttactgtgcaggcacctctagggaaaagggagctcaacagactagaaaggcaggagccctagattctcagactagtttaccacctcaacgcttgcatagggggtggggaaagtcattctgctaatctaaagctcatttagctcttcagagtaagactgggtagttactaatgagtaatgtataggaagtgtaagttttgaatatccactgagatgctgctgtttaaagtggcctgctaacttgttagtgtaattaagaaatttccaagtgatctttggctggtcatggtggctcacacctctgatcccaggcattcaagaccagcctgggagacatgatga

SEQ ID NO: 12163 - DNA, 1051 bp, Homo sapiens
agcgaggtcaagtccctagtctgaggtgcactgcctcctccagcagctccaggcacaatgcccatgtcaccctttgctgccctggttcccacttccaggagaagaaaatacactaatatttatggaatgttattaccattcttattgcagagtgaaaagtcaaaggcctgtttgggcctttaaaccccttcccccattgcccctcaaagaactcatgtgaatgcgtactgggagggggtaccgccactgaccctttcctttatgtggcctgttttagatgagcgtgatcaggcacaggatctcagcccactatcctctctcttcacctttacccagtccctcagatcttcctgccagacctggcttttgtttgtatggattcccccagctcttagtcacaattccctatcttttttttctattcttttttaatttttatgttttttcttttattccttttttttgaacggagtcttgctctgtcacccaggctggagtgcaatggcatgatctcggctcactgcaacatctgcatcctgggttcaaatgattctcctgcctcagcctcccgagtagctgtgattacaggtgcctgccaccatgcccagctagtttttgtatttttagtagagacgaggtttcacctgggttgccaggctggtcttgaactcctgacctcaggtgatccacctgcctcggcctcccaaaatgctgggattacaggcatgagccaccttgcttggtcctcttttattcttttaattccctatcttttccttccatctttcctccagcccccaacccacatgcacaaagggcagggacccacatttaggagagagtaagacgggcattggggagttgaaaattgagcagggccctgggagatgggcaccatagtcctcctcactgtaactccttttcctctccccttccgccagctcttgacgcatttggccgtggtggggagtcacagggaggggaatgttgaggaggatccctgttcagagatgctcaaagcctctgtcaacaagaaactcgggaggctgca

SEQ ID NO: 12164 - DNA, 1053 bp, Homo sapiens
gtcccggccccgcccccccggcacggagaaccaggccccgcccccgcgccgccgcgtcccgggtccgccccccggggggcggggcacgcctgctcccgcctctgactgacggtcgggggccggcgcctctgcctctccccgctgcctgcgtcctggcttcgcagtcgccggcgctccaggagccgaagcgttcacgcagtgtgtagggtgcctttgcgctgcacagcgaatttaatttgctgtgtagctcttttacagtacttttaagttagttaactccagaactatttgttgagcacctgtgaggtggcagggtctgtctcagggactgagcacacagcagcttggaaaaaaaaaaaaaaaaagacaaatccccgaaatcacgcccttgtggggcgtacacgtgcttctcgcgtgaccctgaagttcacttttgggacctggctcccactgagcgctgaactcatgagagcagggcccactctttgacagaagttaaaaatgtgaggtacatgcttgctgtgcggctgaggaaactgtaacctggagctctgcggggaatgcgctgaaggccttggggctggagagtgacaggccccaggcacacgggtgcagaaaggcgctgaccgccagcctgcaaagccccgcaaaaggcgcttcctgttccctttattcccccctcacctgagccgggactcgcgtgatgccgtgctaggttcctgagagccaaagaactccggagaggtagaaaaactcctgacacgaagagttagaggtgacacctgggaggaaaaggaagtgggattcacccttgtgggctgctgtagagagaaaatgctttgtggtttaatcaaaatgatacccacatggtctcaaatgaaggcccagctctgcggttttcttttcttatttgaggcagcgtattgatctgtcacccaggctggagtgcagtggcacaatcagggttcactgcagcctcagcctcctggtctcaaccggtccttctccctcagcctccgagtagctgggactacaggcgtgtgccacaacgcc

SEQ ID NO: 12165 - DNA, 1144 bp, Homo sapiens
ccaatgctgggtgggctgtcatgaggtcctccactagtatgaggctacagcgttttccttgctcacctattcctgccaggacctggatcttgataagtttgaagaattattcaagacaaaagcgcagggccctgcccttgacctcatctgctccaaaaacaagacagcgcaaaaagctgccagcaaggtgactctgttggaagccaatcgtgccaagaacctggccatcaccctacgcaaggctggccgctcggctgaggagatctgcagggccattcatacgtgaggctcccactgacctggctctggtccctagtctgttggcaacccagttctccacccaggagcctgggtttccctagattccaggtcatctgacagaactccctcacatccccctagtcatccactggcttggctagaatttactgcatctgtgctggcagttcagcccagaccttcacccaaggagctctcagtctattgggaacagtgcagtaacactgagtgataccaccaggatggtagaagtatacaggcagctttgggagaatagggaggttcatgtagctgagcttggtgatgaatgagggaagccttcccagaggaggtaatgtctcaactgggacctgaagaaaagatatgagttagtccagttcagggcctggagggagaagcatagtgccttgggtactaaaaattgaatctggctttagtgtagggagaggagcaggagaaggtagagagttgggcagaagtcttgcaggctggacctcgtaagccatgctcaggtgtttggacttcaccctaggtacagtgggagtacatcaaagggcttattaaacaggagcatggagtgttcccccgggatcattgctggtgctgtgacagatgatgcaatgggtcctttgcctttggctgtgttccgtgtacagtcccctgtccagttcttctaggagcttggagaataaaagggatgagggaaaacgtggagagatgtgagaactgaggtggtccctccctcctccacaggtttgacttgcagacactacctgtggacttcgtggagtgcctgatgcgcttcctgcccacagaggctgaggtaaagctgctgcggcaatatgagcgggagcggcagcccctg

SEQ ID NO: 12166 - DNA, 1026 bp, Homo sapiens
ctggggaggctgtagagtttggcaggaccagggctggaggcctagagtccagggaggtaactgctgcctttcatcctttatattcttgagtgctttggtgtggtggtggggtggtacagctgaagtgtttgcccctactctatcgaggcagggcagggggttgcctgtccttctggccaagtgttattgactgttctgtgatttcctttctgccacaggatatagatctttgcccagaacctttcatagttgactcagcccatttcaggctgtctgtttcaagttatcttctccaaacccgagctctggagaggaggatgggagggagtcaaagcaaggagagcagtcttgagctttgtctccccaggttggcagcgaagccaggcttggccttggtctgtgagagctgcagtgagatctgaccatccatctgttccatttcctcccctgtgctaccccagccagtcacaaggctggggaaaagtgtgggtgtttggaggggctgccgtacttcccatgtctggaccttttaaaattttagctcttggacctttgatcaaactctctgattttttttgattcccttttacaaaggattgcagttttgaggggagttagaaggagctgtgctggaacaatgagataaacaaacagtgacgtggaggcggcggcagcagcagtgtaggcaatgggctgggccggctggcctgccgtctgggcgggctgggtggaggaggactcccgccctgctcactggccagctggcttgtgttaaagtgctggctgaaaataactctcattgtctaggagctgctactgcggcaggactggctgtggccgccaaggggccaaggcagcaggagctggtacctcccacctccttgggctcttgccctttgggagcagggcccaactggccacagctgtgcctactgcccaccagtagagacatgtggaggccgttccttacactctgtccttttggcagctagtaatgggcctttgtgccttgtgttgcctgctttg

SEQ ID NO: 12167 - DNA, 1087 bp, Homo sapiens
agtccgttccaccctcaccaagaacactcctaggtatgcagaattggccttcctaggaaataaaaaacaactactttcttagacttcttattatattgaagcttattgaaagaaaaattgcattcgattttagctagcaactagactttaaaagggaacgtggggctataaggattccttctttaaaaaggttctgaaagtctttactatttcccctctctcgttgttggtgactaagaatacttaagcaactattgcaaaatagttgtctagggtttcctacttataatgggttatatcaagtaatattatagttgtttattcaaccattttttatagaatatttttccagttcattctctttttattgtagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaac

SEQ ID NO: 12168 - DNA, 1043 bp, Homo sapiens
accctgactaactttcaactgcccttataaggtctttgctgaaaaagcaactgtgttgcacctgtactcatgcacacacactcctccgtggaaaccatacaaagtagcctaccacagggtttgagattgtaattgtctctatagtgaagattttgctatgaaattaactgatgttacctgaccagtaggacttgttctgaatgttggtgaattttacattccacagtctaccatgtctaacgttgtattgtttcactgatctagactatcaaccattgatgaatctggttccattttatcagatatcagctttgacaagactgatgaatcactggtaataaacatttgatctctgagaattacctacttttcttacctctgcttccccaggaatatctctcctgtcttctcttctgaacatcctatattactattttattagttgatgtgttatagattctgagctagcaatttaaaatataaatccacatgagctataagaggctggcttatatattagtttctgaagtgagaatatataattcagaatttggcataagttgagttcatttaatagatctctgtgtgccacatgtactaactgattatattttgacttattaaagccccagctaataataaaaatattagcaagactgtatgtcgtcagggtttatttgctgctcttaaatagacttgtgccttatttctgaattagtttggttcttggggaaagcatagtcatacttcacaattagaaggaaaccaaggtcctgggatttcagccagaaaagtgtgattagagtttctaggcactatataatgctttcatcaacaatggttaacatgttaaactatttgttgccctgcttttatggggcggcacacttcttttaacttacagtgatgcttctgcataaaaggtcatctcctgatacagtctttgatatagttcattgatttgtgcatcttttctgttactagctgaaaactagcaaacaaaacaaatcaggaagtttttggtgactggttttctggtatag

SEQ ID NO: 12169 - DNA, 1927 bp, Homo sapiens
ggtatttagtttgcaaacatatatgtttttttctttaagctaaaaaaaaaaacccacaaaaaagtagtatgttccagactaacccagcatattatttcttaaaactatttgaattgtaatatttttttaattgttgatatccgcattgtttaagataactaggtcataataacctattttgctgaaatttgtggtttgtaaaaactaaagtttccttattacttggtttttctggaacaaattggtatcctgatttgtaagtttgatatttggtcaaatgattaaaattgtttaaaaaggactatgtattgtttctatgcttttaggttaaattcataggggaaaagtgcccttactacctaagaatctgctagctgtgtgtgaatttggcctagtttcagttttaactgggttagtttgaccagcagcagatgtacaccttgagaccttcttccttgatgttggtggagagtgatccttagagatagacggaggttaactagaaaattgtaaggcacttttgcaaatacattgcagaacagctttgccaatagcaggagataagaatgaatgccaacagggttatcttcttcctttgagatgctgccttggaagtgatgttctctttgcagacatttgaagagacttcacattctgctatcagggatgttccaaaagctagtttgatcttctcttcctgtttttttttttttcaactggaatgtttacatacccttcagggcagtgttaaacagcaaaagcaaattggctttttactttcaaatcaatatttgtataattatatagccaaatggaattgtaggtctagacatctgtaatattaatctacatctactggagcatattacagcagttacatttgaatttgctgtttaacatctctctggtgcagcaatgcgtgactgtaaaggaaactgtttttgttttatagctgtaactgtcctggtgcatgacagctgccccaaaggtatccccctttgattgccttctgttcaggagctttcagtgttagtgttacatctggagccaggtgactaatgagttacatattccatagcagatgccactggctaagccaaaagtaagtggcctattgaataggaattgctacccacaaagttctcatcagagtgacaaacatatccaggatctgctcctagttattttcagctggatttgcccatagttcagctggttccttaattatgaatttcaaataaagctaaccgtaggactcatttattagagcagttatactctgtttggtgcttgaattattaaagattccccctttcctcagaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggtgtgtattgttttccgtgctagaacagtgatgatgcaggagggggaaggcattgtctgacagtttccacttgccaaatatacctagtttcttcttccacattaaagaactgaaagtgacctgttctttaacagcttgcccatgattagagctgaaattgcagactaggaatcttgttcttcataatttgaaatttaaatgtttttgtcacttagacttgaaacttacttaacagacagatttcaaatgagaacttaaagaattagaggaaaagggagggagggagatcctaacgtacttgatctgtcacaagttattggccatccttcattgtttattttaagtgctacccggaatatccatccttacatgagtagctggtactttgtcatacatacaggca

SEQ ID NO: 12170 - DNA, 1635 bp, Homo sapiens
actagaatgttgaagcattggttaagagaaacacaagaatcctttaatggtatttctgaggacattaaatttctaataaaatttgactttttatttcatttccttgatagttttcataacatccagttaatgtctttctttcttgactgttaagtgaagatcttatttcctcaaagtgttcccagttaaagtctatttggaatagaaccgcctgtaacgacactgttttttctatagtatcagcaggcctttgaggggaaatacaaagtctgaaattcactatacaggacacagtagcaaatgatttttgctttgcccttcgaactgtgaaggtgctgtattgtctctctgatgccagaatgtggtacaacataatcctttgcctctacttagtataaatttattagacgtagttcctgcacgcagcccagcagagagccctgtattacagaaataattcttgtgctgctgagctggcgattttcccacttaatcactcatgtgacgtcatctgtgcttttggtaggaaatgtgctgaccatgtcctgcattttaaaaggcagttgcaacaggggcattagctaaaaatgaaattaaaaatagatattttaagttacattgtaggtcttcaaagcccacaaggaataaactggcaaaattattatattaatcaataggcttgacttgaagaaccacattttcttgttggtcagtcacttgctaatgaactgacatgctctttcctatttgttttctgctccaagtgattggaggggctgttatattcaaaggtctgaaatggttttctaattttcagatgagtcttaaacattccaagtttgtttttataataagaatcacacaaaacatctgttgttagcttgagattcttataatggtagttataaatggaagagtccagatgttggtcactaatggctggattgctatagaatcttttgttgtgggcgagaaggcaggacccctaatgtatatttgatttcttggcagaaagatggatactatgatgctgaatgtgcggaatctgtttgagcagcttgtgcgccgggtggagattctcagtgaaggaaatgaagtccgtaagtcattctgagctggcctgtccaaaggaaaaacagatttcaaatttgggatttttacaaagctgaagtattttccaatcttaaagttgttttccatttgggttacctaaaaagaaagcagtgatcacttacgtggtcaaagcctaatgggcactcattctaaatggtcactaaaattcttttctatagctgctcttaataggttttagccaggcttttttattatctttatttatttatttttttgagatggagtctctctctgtcacccaggctggagtgcagtggcgacatctcggctcactgcaacctctgctccccgggttcaagcgattccttgtctcagcctctcgagtagcagggattacagacacacgccaccacgcccggctaattttttgtatttttagtagagacgggattttgccatgttgcacaggctattcttgaacttctgacctcaggtgatccgcccgcctcggcctcccaaagtgctgggattacaggcgtgagccaccgtgcccggctgctt

SEQ ID NO: 12171 - DNA, 1029 bp, Homo sapiens
aaaattggaagtcagtagggtatgggatagggtaggtcagtgagtagcgtagttgatggacatgaacaggaagagtagaacagtgtcaggaggctgaggccggagaatcacttgaacctgggaagcagaggttgcagtcagctgaggtggcgccagtggactctggcctgggggacagagcaagattctgtctcaaaaaattaaaaaaaaaaaaatggacaagagaacaggttatattgtaatttaagacttaaaaccccccctaaaaaagcttttttttaaacaaccagttttcaacatcctagcaccatgaaattttcctttttgaattcttggacagatagaagttttgccgtggtattgagctgtcttatagtctcacgatatataagtgaatgccgagatgatagaaagtaataccttatattaaaactactgattagagtcttccatttttacctcaggagagccaaaggaaatcaacatttgaattgactacccaatgtcctgcccctgtttctgtcctgtagcacttagggtatgttgcctatttcattatatgttaaatccatggcatctccatgaattccacagctcttcctgccggttttaatgctatccttttagttttgttcttagtttagagaaagatctttgtaataaatttgttggtctggttgcttagcagcttgctgtgattatgtagcttggaacagatacttgccgtttgaaaatcttggtttccggccctgattcaggtatatgttgcatccaggcttggaactgagaactttttttctattatagcaattatcatatgagtataaatgtataattctgcagcatttaatatataaaatatcttcatgtttatatattcttttttttttttttttgagacagagtcttactctggcacccagactggagtgcagtggcaccatcttagcttactacaacctctgcctcccaggttcaagcgatcctcctgcctcagcctcccaagtagctggaattacaggcacacat

SEQ ID NO: 12172 - DNA, 1123 bp, Homo sapiens
catgagggtgaaaatgtgacccagcaggaaaattacaactattttcaattgacgttgaatagggtgagtaaattttagctttttgagttacaatttggctgagatatcagagttagtactgatatagaaagatatttttgtcatctataaataattcctgagagtcacttctgtagaatgttaataaaaatatatggtcccctagcatataaagagaagaggattatattctgctagtgccatttttggattaccctaagtaaatctatgttagaggaaaaaataactcttcagaagcagcaaacctcatctagaacagcttgtttaaaagcctagacctggccaaattttgctgtttccttgattcttcttggtctgggttccagctataatttgtgttttatatgtgttgctgtttgtatgacatgttatggtttgcaggaggtctctgagtaggtctgcaacatatatggtctaattgatatttttgtaacttatctcttcaatgtgttgggttggagagaatatagattttggactcagacctgggtttcaatgagaactcgacatttattggttaatttaaggtttctggacttagttgcccattgtctgtaaaatggagataattaagttagtgaggccaggcatggtggctcacgcctgtaatcccagcactttgggaggccgaggcaagcagattgctagaggtcaggagttcgagaccagcctgaccaacttggtgaaactccatctctactaaaaatacaaaaaaaaaaattagctgggcctggtggtgggcacctgtaatcccagctactcgggaggctgaggcaggagaatcactcgaaccctgaaaatggaagttgcggtgaaccgagatggtgctactgcactccagcctgggtgacagagcaagacaccgtctcagaaaaaaagtcaaattcacttaaagaaaaagtgtacgtgaagtgtctagtttagtgcccgaatcatttcaaagcacctagtaaatactggattcttttctttctaattgtatagtattatttttaaaaatggtctaaaattctgaatttactgatatccttatttggagacagcctaggggggaaaacaccta

SEQ ID NO: 12173 - DNA, 1034 bp, Homo sapiens
ataaccaatacgaataaatgcattgtccacaaccaccagaagatagaagcattgctgacagtcatacgtattgttcgtgttggccttccctgttctttgaagtggaagaagagaaagggtgtctgaaacctaaaccaggtctcagtgaatgatgtcagttctcttaggctggtcctgaaagacacactcctctaccaaagtagcttcaattccacagagaacagaattggagatgacaagggagaaaactagaaagcaggtaaagcatagtcacaacagtagccatagtccagacaatacttctttgagttagatgtcatcagaaagcagaccagactgggaacacagtgcccacacctgggtctctgagcttaggtgtcttacagttctttcctcacttttctgtctttggtctcatcccacccaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccaactccagacttctccttcttttttgcccttggctcttgacactctaaacccctggaccatctgaatggagcagccaagttcagtcccacattt

SEQ ID NO: 12174 - DNA, 1160 bp, Homo sapiens
cgactcctgaaagatctaagtatttccataatctcttggttaggcaggaaggtatccaagatccaggatatctatatgcaggaagagcttagtctcagttctacttttccctccaattaagatcttggtcttttgatgtaaggaaactgccatttattaatcacctcctttgtgccagggtctttcatatacattatctcactgaattacttacaagattcttatgaagtagattagtggttctcacattttaatggacatgtgaatcacctggggatcttgttaaaatgcagattctgattttgcaagtctgagatgggctcaagattatgcatctctaaaaagcttccagccagcacagtggcccacgcctgtaatcccagcattttgggagactgaggctggtgaacattgtcaccctaaagaagtgataaatgttgaaagtgatggatatggtaattaccccagtttcatcattatactatgtatacatgcattgaaacatcacattgtaccccataaatatgtacaattattatgtgtcaactataaataaaatttttttaaaaagaattggcccgtgggttttctccattacagatttattgccaaaccctgtgcactctgtattggcatcgaggacagtggtccttatcaggcccaacccaatgccatccttgaaaaggtgttcatatctattaccaaggtaagtgggcaaagaaacagagaggaatattcacataaggcgttgctccatggggcaggggaggatagagagcacgtacctctaagggtaaggataggatgggatggtccttcatatttgagtagtccatgtagctatatggagagctttatcccctcagggaaaacctttgggccctacgtatgtcaagtttacgtacgtagtaggtttgagttttaggcccagcagccacccttacccctctttccccagacacataccatatctggtttttgtttttccttgttccagtttctgtcactgcctagttgtgtgatcgagatggagacagtactgatagcctttgcagtttgggttttttgttttttggagagacaaggttttgccatgttgcccaggctggtctcggactcctgggctcaagccatccttcggccctcagccttcaaaaatc

SEQ ID NO: 12175 - DNA, 1013 bp, Homo sapiens
accaccctaggtacctattttttttttttttttttttggagatggagtctcgctctgttacccaggccagagagagtgcaatggcgtgatctcagctcattgtaatttccgcctcctgggtaaaagcaattctcctgcttcagcctcctgagtagctggggttacaggcacacaccaccacgcctgtctaactttttgtatttttagtagagatggggtttcaccatgttggataggctggtctcgaactcctgacctcgtgatccgcccgcctcagcctcccaaagtgctgggattacaggcatgagccaccgcgcctggcctagatacctgttttataagttataccaaataccaaccttttgtatgatgtagaattaatactttctcaaaagctataatttcaaataatttcactttcttcagtaaggtaattcattaactgtgtataactaaatctatatatttaatttttatcacaaattagaaaagattattttccaatcacatctggaaaatataataaagcttcattctgtagcacaaaataaacaatcaacaagtatttgtcaaatgttctttttttttttttttttttgagacggagtctcactttgtcgcccaggctggagtgcagtggcgcgatctcggctcactgcaagctccgcctcccgggttcatgccattctcccgcctcagtctcccgagtagctgggattacaggcgcccgccaccacgcccggctaattttttgtatttttagtagagacggggtttcaccgtggtctcgatctcctgacctcgtgatccgcccacctcggcctcccaaagtgctgggattacaagcgtgagccactgcgcccggctgtcaaatgttcttacgctccatatagctggaactgactggatatgagtagctttatgcttttcaccgaactctgaactaacgagggcaggatgtgagctaatgacaattctagattgttaagtccactccatgatccagataatag

SEQ ID NO: 12176 - DNA, 1031 bp, Homo sapiens
gttttactgtgttggccaggctggtctcaaactcctgacctcaggtgatccgcccgcctccgcctcccaaagtgctgggattacaggcatgagccactgcgtctggcctcatttatttttgagaaagtttttgctaaatactcagagctgactaacgttagtctgtcagtcctttcaggtaaaagtggtattctatggaaaaagcgacttagtttattcagcttgcagtagtcatacaaatggttttccttgggagccatatactttggtatgcatcagaagtgctttttgggtacatccattttatcacagaataagtggagactgggtttcaccatgttggccagggtggtctcgaactcctgacctcaagtgatccgcttgcctcagcctcctaaagtgctgggattacaggcataagccactgtgcccaatcacagaatacttttaaaaaatatattcaagggtcaagatttaataaaagtaataatttgtagtgcttcatcaaggacattcttaagcaaaactggcatgttttaaaaattgagaagacctagctctacagtatagtaactactagtatggtttggtgtcactaccttgatttggtctaaagtaccataatgttttacctaccattgatttgcacaatcactgcaaatgtcaacacagtgaaaaaggcaaataataatattgttatgaaaatagtttagtttgtagagcccctgagagtgcctcaggaaccctcagggatctgcagtccataccttgagaccctctaccataactgaatgaggttactgagggtgagcgtgtagagtacgaaaagaacctctaagtgaaccctgaggaaacaccatgtttcaggaaaaggcagaggaaaaataaactgcaaaggagatagaggaatgacagccatacgttatttgataatattagtagttggtataggccgcgcacggcgactcacgcctgtaatcccaacactttgggaggccgaggtgggtgaatccactagaggccaggagttc

SEQ ID NO: 12177 - DNA, 1062 bp, Homo sapiens
atctggaggggccggccgacggctacggttacccccgcggccggcacatcctctcggtgttcccgctggcggcgggcatcttcttcgtgaggctgctcttcgagcggtgagagcccgggagcgagcggctcgggggccgggcgcgggccgggggcgccccgctgtgggaagggccgagggccggaagcagaactgcaaggaaagcccggaagcaggggctgggggagcttgggccgcggcgggtgatgctaggcgcgtgggcgaggtggtagcctagatggagaaggagtttggggcgtgggcaagagaaagagtgagggtctaggggaatgctgggccccttcaatgttagatccggagttggattgggggggtcatataggcctcctcccaacctccaagggtcctacagatgaggaaacaggttcagtgtgagctctggcagaggccccgaagagagggataggaaggggccaggagaaccagagctagttgtgaccatggaagccgaggggtcaacgcaagggccagacgttccaagggaaaggaatggactcatcagactcttaagatttgttaggacgcttgagtttccgagaattggggggaacaggattagtttggccctaagagttggtttggtatgtcaactcatgcacgtttgttggtaggagggtagaaatctggttgggatagggtgtggtggagccctaggcttccaaagtaatggaaagatgtcagattagttgcagaacaggccttggggcctgaaatggaaggaggagtgtgttcgaagggatggaggagagccacagggctttatcagaggacagctatattgagccagattcttttttcttttcttttttttttttttttttttgagacagagtttcgctcttgttgcccaggctggcgtgcaatggcacgatctcggcttaccgcgacctccgcctcccctgttgaagcgattctcctgcctcagcctcccgagtagctggaattacaggcacgcgccaccacgcccggctactttttgtatttttagtagagacggggttt

SEQ ID NO: 12178 - DNA, 1029 bp, Homo sapiens
ttccactcagctttgttccttccttcttaaatcccttgggcactacttgggagtttaccactaattttattaaacttccttttatagatttctttattttcattttatgcacattttctgctctcacttcctgcccaaatctacttggaaaaccatttttattttttgctttacctcctagtgaatcatgtggcaagtgaaccaacagtctgaattttttatgggcctgttttgggttttttttttttttttttttttttgagaccaagtctcactctgttgcccaagctggagtgcagtggctcaatctcggctcactgcaacctctgcctcccaggttcaagcgattctcctgcctcagcctcccgagtagctgggactataggcacacgccaccatgcccggctaatttttgtatttttagtagagatggggtttcactatgttggccaggctggtcttgaactcctgacctcgtgatctgcctacctcaacctcccaaagtgtgggattatgggcgtgagacactacacccagcctattttggattttttttactcaaaattctatcttgcccataacctggttcatttcaggcttaactatccaggtcctgggccttgggattaatttgcattacttaccatcatgtgttttctggtgagagcccaggctgatcatggcagcaaaagcacctcctaattgctgatgagagcttcctggccacctaagctgtctcccgcatctactggttgaggtgtttgtgttgggcaagtcaagggttaactcccatacacctagggactttgcattcccatctactccccaccccttagtagccatgtaactatttcttttctttattttttgagatggagtctcactctgtcgcccaggctggagtgcagtggcgccatctcggctcactacaagctctgcctcccgggttcacgccattctcctgcctcagcctcccgagtaactgggattacacgagtgtaccactacgcctgcctaatttttgtattt

SEQ ID NO: 12179 - DNA, 1027 bp, Homo sapiens
aatggttcctatatttaaatactttatctttccttggagtgggttatggttatacggtgaggagctttgctctccttgatagagggctttgttttgctttgttttttgagagcagaaaaatatggtttagaagttgttttataaagggagatgatgcacacttttggcagttgagtgcagtctgtttctcgggttactctgtaattgagaggcatgttaatatcctcataaaagacattttgctgcctcttgttcaaatgctcagctgttctggtgcccgttatttcccctaggcagccagtgactgactggagtcagcaggtttttatggcattaacagcagtttgctcttttatttttaatatgactcttaatccccctctaactttttttttttttttttttttgtagatttctgcaaatgagaatagcctggcagtccgttccacccctgccgaagatgactcccgtaagcattctttcttagatctggaggatgaggttcttgttttctatctgtatttggttcaggggtgttcccattactgtcagtgctgagaaaataacatagtaaatcctctacttgaatttaagggctaatgcttgaatgtcctttacacacttcatggcttaaggagaagttaaattcaattgaatatagttaacttgggacaaactgaatacttgtaatgcttttctcattgaattcatcctactttttgcaccaaaccctttcagaattgaagctgtataaactaattttgaagtttcattttaacagaagtttggccaatacggattttattcatttataatgttattcataaatacctattctttagtgaataagtatttgaataatctgttaaagatacatattttttccctgtttatctaaatgtatattatagtcaacctcctagccaggttctagggattttcctgctgacagtgaattttgtcacctgtcatcctattttggagtcattttgagcctcccttttcccaaagacaaaaatgttttttt

SEQ ID NO: 12180 - DNA, 1043 bp, Homo sapiens
aaggatcgaacaccttccccccactgtagacctgcgggtgctgccccacgaccgccagaaatcaaggtcatgaagcccgcaaggaccgaacacctccaccccactgtagacctgcggtgctgccccatgactgccaccgaagcccatataaggagcagagttcttaaggactgaagaaaaactagcctctggagaaaaataaaaaaattgcaattgtacttaaaaaaaaaaaaaagattttacttcaaaggccaggcttgaagttctgaacactttgaagtctccaattatgagggatccagtctaagcctctggcttttgctatttagcaataggtgttctatgatgggctgatttggaaggagggagtcagccactcttgagccactgcagtgaagtcacttgatctcagtctggagagaaacactttaatagctaaacattctagctttgatttttctgaagggaatacacctgttttcaattctgggatttttggggtgcttgcttgactgtatatgaacttgtgatccaaggaaaaaataggagaaagaacaatgttggctttttaagtcaggatagttttatgtttgctactagataaggcaaaaataaaaacttatttttataaattcaagaagaaaagtaaggatgtttttataccctagtggtcaataacttagttcatagtatttatttaataaaaggaaggtggcattggtggtatagtggtaagcatagctgccttccaaataatgaaaattgattaaagcctatttctcagttattctctacatttgatgaatagataggttatttaggtcaggtggtttagctgaatatgatggttttatttatttatttttgaaacagagtctcattctattgcccaggatggggtgcagtggcacaatcttggctcactgcaacctctgtctcctaggttcaagcaattctcctgccttagcccccgagtagctgggattacaggtgtccgctgccattcccggctaactttttttgtatttttagtagagatgggg

SEQ ID NO: 12181 - DNA, 1054 bp, Homo sapiens
acgacaaaagataaacttttttagtatgctcttgacaaaagttccgaaagttttctgaaattttactagtttgagatccccaatttaggaaaccgatttagtggagagagctttgcctatttttggccctttgggtcggagaatgtgatataaagccgaagatttactctgccagacagtcttaagaggtcactaacgtttagctattgacattcagcaaaaattgtggattacctattaaatgctagaccaggggacaactgttattaagtcagtgtttcagcattactgaaagaaaagtggcctataaaggtaagggagaggaagagtttctcagataccagccttcgatgattaacaaagtccagcctcaatcattctggaatccagaatattgatggctggaaggctggttgtacaagtttattgttctttggtgtttggttttttcttccgtggaccacagaatgcttaacaaaagttgatcagtaaaaagcgggggaggggctaggcgtcgtggttcatgactgtaattccagcactttgggaggtgggggagggcagatcacctgaggtcaggagttcgagaccagcctggccaacatggtgaaaccccgtctctactaaaaatacaaaaattagccaggtgtggtggcacacacctgtaatcccagcctctcaggaggctgaagcatgagaatcgcttgaacctgggaggcagatgttgcagtgagccaagatcacgccactgcactccagcctgagccacagagggagactgtctccaaagaaaaaaaataaaaacctggaaattttattgaaaaatgaaaccttcaaaatgtgccttgactacttctttagctcctcttccttagtgccttaggtctaaatcaaatgttacgctcgaccagtcctggtggcatgcgcctgtaatcccatctactggggaggctgaggcaggaggatcatttgagctcgggagtttgaggatacagtgagctgtgatcatgccactgcactcaagcctacatgacagatgagacactgtctctaa

SEQ ID NO: 12182 - DNA, 1048 bp, Homo sapiens
atcccaaggtgagcaatgtattgtcctgtttgtctctcacccatgccataggaatctgtgtgtctggcggtatgtgctggcctcattctatagtgagacagtcaaggacttgggggtcagtggccctgaagacagacggtaccaacggaaatactgtagctcctcctgctgccaggccatgttttccccctctttcaaaatctaacttgagactcgcatttcctagaaggttttcttagaaaaactgtgttaccattcactctggcttccagtatctagcaatgcccagcccaaggggaggaggatgctctctctaagcacttttattcatacctccatgttactccatcagtttgcattttatatatgttctttttttgtttgactttgccatcactttgaaaaagtaattttttttctttttagtacaaactatatgtggcaagatctttggatttgctaataattatttttcagtttcccctcccaccgggggctacactgtcctctgcagcttcttctggacattttgggcctttcttaccgttgcctaaggcaagaatgaacactatgtctggaagatatttttaacttagttttgtctcttgttttgtttcttttcctgggtgtgagcaaaaagtatccttatctgcttttcaaaaaaataaaaaaatcttgataatatccccatttactctgatgtgattattacacattttatgcctatatcaaaatatcccatatgccccataatatatacacctactatgtacccataaaatttttaaaaaacaaacaaaaccttggtaatttataatccttctagcttctttttctttctttcttcttattttttgagacggagtctcactctgtcacccatggtggagtgcagtgatgtgatcatggctcactgcagccttgacctcccaggctcaagcgattctcccatctcagcctcccaagtagctgggaccacaggcgagcacgaccacacccagctaattaaaattttttttttttttttttttgtggagatgaggtattg

SEQ ID NO: 12183 - DNA, 1032 bp, Homo sapiens
tgaagggtttcacagtgaaagccagaaagcctgctagacacattctaaaagagctgtaacacttcaatttggttttgaagtcttgccagcaaaatcttgactaagacttttctttttttgttaaatatctgtcagtcatattctgaaaactgtaattattttcaaggttacctaattcagtagaaaaattactcttttcatagtaaggattcagtcatacagagtaacaaactgctggttctgaacttgttagtttgttcttcctaattcttctccctcacttttctcctttccagaatcatattctaagaactcagccactcaggtatccaccatggtgctgggtcctgaacagaagatgtcagatggtaatttaccgctttgtgttattgtctaattttatttgtaattaggtttatgttggtaacagaaatttatcatatttttcctcttgtcatcatctgtcatcatctattctaacaactccattcaaaagtcaccatctggtgacttaggctgtaaatgaaaatggattttttttttttttttgaggtggagtctctgtcacccaggttggagtgcagtggcacaatctcggctcactgcaacctccgcctcatgggttcaagtgatgctcctgcttcagcctcccgagtagctgtgactaaaggcacacgccacaatgcccggctaatttttgtatttttagtagagacagggtttcgccatgttggccaggctgttcgcaaatgcctgacctcaagtgatccgcccgtctcagcctcccaaagtgctgggattacaagcatgagctaccgcgcccatcctgaaaacagaatgttttttttttgtttgtttgtttggttttttttttgaggcggagttttgctctagttgcccaggctagttagtgttcagtggcactgtgtcggctcactgcaacctccgcctccccggttcaatggattctcctgcctcagcatcacgagcacctgggattacaggcacctgccgccacgcccggctaatgtt

SEQ ID NO: 12184 - DNA, 1056 bp, Homo sapiens
aagtgagcttgctaaaatcctccctcccaattaaacttaacaggatgatggacatctggaacttccaccccacccctgactccacccgccccactgcgggttgcttagtacaggacctgtagacaaaggctggcatcccacacgctatgcttaatcctgctggtgcttcagctctcttggagagcttgggaggggctgggccacgggtgactagtttcttctagttgtcagagggttgaggaatgaggtctagaacattatggctgcagactttactttcttaggaagatttgaggctgccaaatagtggccttccactaccagtatgcttgtatggtgctttttcctaccctttctagaagattgaaccatgagcttaaattacatattttagaccaaagagaattacagatttctgtccttaaaaactcataaaataggctgggcgtggtggctcatgcctgtaatcccagcactttgggaagtggggtgggcggatcatgaggtcaggactttgagaccagcgtggccaacatggtcaaaccgtgtctctactaaaaatacaaaaattagccaggcatggtggcacacgcctgtaatctcagctattctggaggctgaggcaggggaatcgcttgaacccaggaggcagaggttgcagcgagctgagatcgtgccactgcactccagcctggacaacagagtgagactccgtctaaaaaaactaaaaaaaaaacaaaaaaaaacaactcataaaatagggggaaatgtgtctggctttagacacttgggataatttggaggcaaaggcagagaatggatacttgcctagcagcctctgtgtagatgcttattaaaaaagtatttgcctggccaggtgcgttggctcatgcctataatcccagcactatgggaggctgaggcgggcggatcacgaggtcagcagatcgagaccatcctggctaacacggtgaaaccctgtctctactaaaaatacaaaaaattggctgggcgtggtggcgggcacctgtaatcccagctactcgggaggctgag

SEQ ID NO: 12185 - DNA, 1030 bp, Homo sapiens
aaaaaaaaaaaaaagccagctgtggtggtacgtgcctgtagtctcagctacttgggaacttgggaggctgaggtgggaggatcacttgagcctgggattgtgcaactgcactgtagcctgggaggctagaaatatgtaaataattgttctgtaagaccctgtctcaaaaaataaaataaaaaacaataccagactttataccttcaagaacaatttggaaattcacatgtctattctaagctgtttctttccccacacctcgaatgggagcagattgagttttagaactaattgggctgggcatggtagctcatacctgtaatcccagcactttggaaggctgaggtggatggatcctttgaccccaggagttcaagaccagcctgggcaacatggtgaaaccatgtctctacaacaaatacaaaaattggcagggcatggcacacgcctctagtcccagctacttgggaggctgaggcgggaggatcacttgagcccaggaggttgaagctacagtgagctgagaccacgccactgcactccagcctgggtgacagagcaagacactatctcaaaaaaaaaaaaaaaaaaaaagttggatggatatttttgatagactcagaaaatgctgcttcttcatgacctagaatggaaaaatagagggagagtaataatctcttattttaaaaaagtgattaataaccttcctcattaaaatacatagggttcagaaaataattagctctgtttgagctgctagaatatttcagaaagttttgttgactgtcagtcatccaaatggcaggagcccaccttcatgaagagcacctggtacaacaaggtgttgtgttaataatacagtaatggtttagtagaactgtcaagtactttggccttgaagtagaccattagggaaaagagaattttagaagaatctagaaaccttttcattttctttaggacaaatataatttttttaaaaaatgagaattctttgttattctctaataaacactttgggtgtcgctaa

SEQ ID NO: 12186 - DNA, 1028 bp, Homo sapiens
gagtgcacggctttctttaaacacctaacttaagcggggggttttcacttgggtgctttgtaagttcatgatcctggtgatcacaaagacacatggatccatgaaattcatggtatatgagaaacaaccacagtatcttgtaaaaggagaaacagggcaggtcattttattcaggtttatggtaacacagcagcaagccttccttccaacccagctacagatggtagccctgaccatcttactggaggttttgattccttgacctttagcagaaggttgggttccagtcaagtgaagaggctttctcctgtgagatgtagcttattactttggactcatttaagaaagagacttatattacctaaactttgcaaatagattcttccagaaaattttgcctgggcagtccctcttgctgctctcacatatgctgtttttttttgttgttgttgttgtttgtttgtttgtttgttttggtggttataggaatccttttaggcctgaaaaaaacttagatctagtactaaaatatacatattctggtggaactgtttattaggtgctagcctgatgtattctgtgctctggatcttaactatttcatataactttggaaaatgttcagctagaaactcttgagaaaagaccattagacatgtagccagaaagtgtcagctgacctttcatttcactggcatttaaaagctttaaagagagttgcattattttctccaaaagcatttgttgagttggtcattttgacagttaactgtcggtttttacctgcattcctaggtgctaaaacttacaagtgtatctcttgaacacaggcattgatcctctaccaatgaataattgagagaggtaggaatgactgatttttctagttgtagtttgaaagattaatttgatgaattggaaagtatggaaactattctgttactattgcaaagaaagatttatttttttaaaaaatttatttttatttattttattttatttttttaggcaggtctggctctgtcacc

SEQ ID NO: 12187 - DNA, 1049 bp, Homo sapiens
agaagctatgtcacttggtttgcagttaagttgtgtcttcccacgttgctacacagagtagaatttgtttttcctaagtcatagggtataaaggaaagatcttcacaaatacacatgcagtcacttttcatggtgtctgcctctctgatttctaattggttaaaatttccttttggtaaacatagttgttaagaaaaatttaactgctactaattttacctgagaaaacattggttctcatgcagtgatcctgatatctgtatgataagttgaccttaagatgaatctaacacaactaatattgtggagtgggacccacttgatgctctattgtttgaatcattgataccaaaacagtagtatagttaataccacagttctgataatacatattacctggccttaactccccagtttgatcattaataggagaaatcagggaatgctatttgaatatctgctgtgtggaatggaaagaaaagttctactcaaacccattaattcttgcttcccttttaagtaaagatttgtcactctgttataggattatttgatgacttggtaagtcagcatcaaccatctttttttttttttttttgagacagagtcttgctctgtcatccaggctggagtacaatggcatgatctcggctcactgcaacctctgtctcccgggttcaagccattctcatgcctcagactcctgagtagctgggattataggcatccacaaccacgcccagctaatttttatatttgtagtagagacaagttttcaccatgttggccaggctggtctcgaactcctgacctcaaatgatccacccgccttggcctcccaaagtactgggattgcaggcgtgagccaccacgcttggcctgcatcaatctttatgttaaaattttcccactttcattcatgatataatgctttctaccttcatatagacactctgctgcaccccttcaatagcaatactcttaatgtgcttttggcaatgaaactaattttcaaactgtagttgaaatagattataaattacagtttt

SEQ ID NO: 12188 - DNA, 1031 bp, Homo sapiens
tgtgcaagttggaagccgcggaggctctcggaacatgacctacctgccggcggggcagtccgctcctccggctgccccatgagggcccaccctgcctgcacctccgcaggctgactgggccacagccccaatgattcttaacactgccttacccccctaccccagaaatcactgaaatttcataattggcttaaagtgaaggaaataaaagtaaaatcacttcagaactcttaaaaaaaaaagaagaagaagaaaagaaaaaaataaccaattagttgggccaggtggctcatgcctgtaattctagcactttgggaggctaagagagaagagcttgagctcaggagttcaagaccagtctgagcaacatgatgagaccccatctctacaaaaaatttaagaattagccagacatggtggtgcatacctgtagtcccagctacttgggaggctgaggctggaggatcccttgaacccaggaattgaaggcagcagtgagctttgatcacgccactgtaccccatcctgggtgacagagtgagaccccctcaaaaaagaaaaaaaaaagaaaagtagctggttggttaacatcaggttacttcaggctactgtttttgtgtgaggattaaagcagagggaacttcattatcatgctgtttgaagatttaaactgtcctgtttgggaaattaggtgtcctctctctcctgatttcttagaagataacatagcttagtttaggtttagcgatgtagaccttaaggtgaatgactccatttttatttttagtctgccctgttggggcctagtataggagtttagtggcctcctataatttttatttcacaaaacaaaagtatacatcatatcagtgaatatttgctaagaacaggaaagagaagtcttcctttcaaatagcttattgttcattggaatgaattaatctaggcacagtggctcatgcctgtgatcccaacactttgggagaagaggtgggaggattacttgaggcttggagtttgagactactctg

SEQ ID NO: 12189 - DNA, 1032 bp, Homo sapiens
tagctgggactacaggtgtgcaccaccacacctagctaattttttaaaaattttagagagatggggtcttgctatgttgcccaggctggtctagaattggcctcaagccatccccctgccttggcctgccaaagtgctggaattacaaacatgagctgctgtgcccagccaacactgtattatgtatattttactacagattttaaaaatggaaaacaaaaagaatgcaaatagttctcctttgcccaagtcctgatccctcagctagctgcgaaagtatcaccaccaatgatggttgccaggggctagttactgttcagtggctataagagtttcagccttgcaagatgaaaagagttctggagatggatgatggtgatggttgtacaacaatatgattgtacttaataccactgaactgtccacttaaaagtgattaagatagtaaattttgttatgtgtattttatcacaataaaaagcagttgggaaaaaataatttcagacttgtataatatttgcatgaatactacaaagaatttgtgaaaacctttcacctggattccccaaaggataatattttaatatatttgctttatccttctctttctcagaatttcttacacactcagaattatttttttctgaatgatttaaaggtaaaaggcagatgtggcgccccaaacacctaaatacttcagtttgtattttttaaaaacaaattctcttacataactatggtataatgatcaaaatcgggaacttaacgctgacacaatgctataatctatagaccttattcagattttgtcagttgtcctaataatatccattatagtaaaagaatatccaatatgatgtgttgattcagtgaccttgtctctttcatctcctttaatctggaacagttcttgttccttgtatttttatgacactgacaatttgataagtgcagggtagttattttgtagagcatccttcaatttgtttttgtctgttgtttcctcgtggttagattcaggttatgcacgtt

SEQ ID NO: 12190 - DNA, 1050 bp, Homo sapiens
gccaccatgcccagctaatttttaaatttttagtggagacggggctttgccatgttggccaggctggtctcaaactcctggccttaagtgatccacccaccttggcctcccaaagtgctggctttacaggcgtgagccactgcgcctggcctatagactaacatttcttagaaacattgatgtaaaaatcatcaacaaaataccagcaaaccagatttaacagcatattaaaaggattatacaccatgaccaataagcacatgaaaagatactcaatgttgctaattaaggaaatgcaagtcaaaactccaagatgctacctcacacccattaggatggctgctatcaagaacagcagaaaataattgttgggaaggacatggaaaaattggaaccactgtacactgttgttagtcgtgtcaaatggcatagcctatgtgaaaaactggtggttcttccaaaaattaaaaataaaattaccatatgtatcaggattttccagagagacaaaaccaataggatatagatggatggatgggtgaatgagaggggatttattaggggaattggcttactcaattatggaaactaagaaggctgtgataggccatctgcaactagagaaccagggatgccagtagcatggctcaatctaagtctcaaagcctcagaaccagggaaaccaatggcataactctcagaccgaggctgaaggcctgaaaacctgagaggctactggtgtaagtcctggggtccaaaggctggagaacttggagtactgatatcaaagggcaggagaaggatgtcccagccccaggagaaaaaatgaatttacctttactctgcctttttgttctatctgggcacccagccctttagatgttgccctcccacattgaggatggatcttactccctcaatcaacctactcacacaccagtcttctctggaaacactctcacagatacagtcagaaatcatgctttacccgctttttaagtatcctttaatccggtcaagttgacacctaaaaatcatcacaccatatca

SEQ ID NO: 12191 - DNA, 1008 bp, Homo sapiens
tgatggtttcatcttcaaatctattaatttgtattttataaagagtcatcttaattagatttatttaatccttattagtggtccttttattattctttttttcttatatttttattgtggcacaaactttatactaaaaggaaaaggagattcattgtgaatacatgataagtgaaggagccagtcacaaaagaccacatacatatgattccatttctatgacatttctagaatgggcagatctgtagagaaaataaattagtggttgactagaactatggaggaggagggaatggagagggactactagtgggaatggagtttcttttcagggtgttaaaaatgttctaaaattgtttgtgatgatggttatgatatcaaactaggttcgtcctgcccacgtgcagcaagccaatcactatgatgatgggttttgcaaaagagacaagattttattcatagggctgctgaatgaggagacaggagagcaaatcccaaatctggcaccctgaaaatagggcttggcagtatttgtggggtaggacgcagggtggtctaaagcatggggaaaggtgattggcaggtaggaaaggtgaggtaatcaaggtttctgcacaagcgtaattgagctacattgctcttcataggccatgtgcagaaaatggcagtgttaacatgatctaagtgtggagtttttgtccctctgacatgaaaaggtcactttttgggcactcatgcaggtccagttgagggattggtggtctcaactgggtaagagctgtcccctaattcctgaaaaacaactttaagcatctgttaatatagtgacccacagtcagagatgtcatcttttttttctttcctttttttttcttttgaggcagggtcatgctatgttgcccaggctgttcacagatgttaacttttatttatttattatttattattattattattttttgagatggagttttcgatcttgttgcccaggctggagtgcaatggcat

SEQ ID NO: 12192 - DNA, 1031 bp, Homo sapiens
aaatctcctttcggccgggtgcggtggctcacgcctgtaatcccagcgctttgggaggctgaggcgggcggatcacttgagctcaggagttcgagaccatcgtggccaacgtggtgaaaccccgtctctactaaaaatacaaaaattagccgggtgtggtggcgcgggcctgtaatcccagccactcgggaggctgaggcaggagaatcgcttgaacccgggaggcggaggttgcagtgagcagagatggtgtcattgcactccagcctgggcaacaaagtgagactccatttgaaaaacaaagcaaaacaaaacaaaaactcctttgaaagcaacattattgcctatataacttgttgcatgcattggctgcttcattcctccagtatagtttatttcatttatagatgtgtaagaatcctgtatggaaatgttgaaacagctgcatcttaggggtagatggactataattgggtttcctaatgcattattaagacttaatctaaataagtgagtcaagagactagaacttaacattttcattgggtttatgagttcataggggaaagatgctttttagggggaaagtagatgcatttttcattctgataatgagatcttttaagagttatataaagttcctttattcctgccaattcaaagtagacttacctcactgaagtaaaattatgagttagaatttaatacttcaggccgggcacggtggctcatgcctgtaatcccagcactttggtaggctgaggtgggcggatcacgaggtcaggagttcgagaacagcctggccaacatggtgaaaccccgtctctactaaaaattcaaaaaattagacgggtgtggtggcgcacgcctgtaatcccagctacttgggaggctgaggcaggagaattgcttgaaccgggaggcggaggttgcagtgagcagagatcgcatcattgcactccagcttaggcaacaagagtaaaactccgtctcaaaaaaaaaaagggggagagaatttaatacttcagcat

SEQ ID NO: 12193 - DNA, 1039 bp, Homo sapiens
ggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgaggtgagtgagattttcccagaccctacaccttctgaataacaaaggcggatagacactaagaaaaggggttgagtgggaaggaggtgtatagagttttaaaaagctgtttacgattggggaaaagggacttgttcttttgtcgctttgagtagttagtgttgtggaagaaatggaaaaagcgattgtaggcgatatgaagcctgtgcagaatcagtggaagaaggaagtggtccctgattagtaaccagatgaatgttgagaggcttttgtgccaatgtgggagacttggggactgatggtgtatgtgtgggtaagtctgacgttgtgtgaagaagggttacatatagcataggaatggtatctaggaagttgggaaattgggagctggtgcttaatgatgaatattggttcgtttcttgttggaaagatatggaagtccttgatgaagaagtccgtacagctctatcttaccactagcttgctttaagactttacttaatt

SEQ ID NO: 12194 - DNA, 1033 bp, Homo sapiens
gacttcgtgggtaacagcagttctgattttccttacagattactattcaaggtcgacttccaaacaaagggtgtgaatgatggaagtgaaccgtgagactgggaaaagggtgcagggctgaggggtgaggaggaatatcctcactggaaaagcgggggatcaggtttggttttttgtttgttctgagacggagtctcgctcttttgcccaggctggagtgcagtggcgcgatctcggctcactgcaacctccgtctcctgggttcaagcaattctcctaccccagcctcccgagtagctgggattacaggcgcccgccaccacgcccagctgatttttgtattttttaatagagacggggtttcaccacgttggccaggctggtctcgaactcttgacctcaggtgatccgcccgcctcgacctcccaaactgctgggattacaggcgtgagcaacctcgctcggccttttttttttttttttttctattccttttttaccccctcaacctattcctgcgttatgggaatcatgttccgacagacacactggtacaaccacagaaaaggggagaagttctgatcccgtcagcgaagggcgagggggtgcgaagggaaggaaaagagacctcacaggccccggcccacgaaccaactccagcaattcagtagttaagttcggccccgctgggggttccggagcgcggcgccccgcctccgccggctctccattggcctacgcgaatgcctgcgctagcgctctatttgctcctgcggatgcccatcatgtcaagcccccccaccacccgagcccgcagctccaaactgcgccacagagtttacggaggaaagggcctggaggcagcaagctgccgtaatttgggtatgacgaaggcgtcaggcgcagcgccctggactgcagccggccaaggagcatggcgcagcccaccccaaacctggcgtttggtgaccctgggctccgaatccgctcgctctgggccagcagtactccccccgacggcctctgccaccct

SEQ ID NO: 12195 - DNA, 1034 bp, Homo sapiens
cctgtccccattaggccccctgagaaagtcatcaagtttcctctcagctagtcttgcttctcctttcccctgtgtttgggaccctgggcggacctttcccagcaggaaaggctgcagggtttttcagcgggcgaggatgcatctagagccccctggtgtgccgctcccctagctgtgctgctttccccggcctcccagaaagtgtgtgggggaagacagcgtgggcattcagcaaggggtgctctcccctttgcctcccaccccatcctgctcttccatgctggcctagaactttggggccacattgtatctctaggattctttccctttcagccaggagtttttgtcagacctgggaaagtgggacccagactgccttgggcccaggtttccagggtgggtgtcagcctgtcccctgacccccatctggctcttcccccacagctgctggagtacttagggaagggcaaaagcatcgtggatgtggggctggcccaggcccggcacccactcagcacccgcagccactacttcgaggtggagatcgtggaccctggagagaaatgctacatcgccctggggctggcacggaaggtgggcacaaaggctgagcttttttgctcatggagctgctcaggtctggggctgttggggcagcaccaggaagctcttaggagaaaccaggggagcccaggctttggagggagggtgctaagctgagatggaacacagttgtatgtgtctgctgtgtaagagtacacaccccatgtgaccaaggacctgagacaggtcatgactgcaccacacactaaggcctggggggagggggtgggacatgccatggctctggccttaaaagcttaactaacactttcctcaccctccctggttcccctgaagccccagtgcctgcagggtatgagtgtgcagggttggcactctctgggctgtggtctgtcccagaggttcagatgctactcgccactctctcctgtcttgtttatgcatgggaccatagattttcttttctcttc

SEQ ID NO: 12196 - DNA, 1067 bp, Homo sapiens
cccaggcaatcttttctaattgatgcagaatcctgtagacatttataaatagccttccttcctccccaccctccccccaacaccttcagccacttatttaagagtgtttttcttttttagacataagctgttgaattgggcccttctctcagaccctcaccccagcttgggccaggtggcagggtgggagcactactcctggggcacccgttcctctggggccaacttggatgtgagcttcctgagggacatgtgcctttttccagtcatgccaactttccttttttttttttttttttttttaagacaggctatcactctgtcacccagactggagtgctggttcacttcagcctccaactcccaggctcaagggatcctcccaccttggcctcccaaattgctgggattagaggcatgagccactgccctgggcctcaacagttgttagatttgagtctttggatatagacagacctggctctttcttgagtggaattcttcccctgcctcctgtggcctgtttccccctcctaaagagtctacctcctcagagctctgaggggttgaggaattgctggggcacttgcctctcacctcatccctgcctccaggcctcgcaaagtgaggtaatgtggtggaggggagctgggggcggtaggtaacagctgggggattagactcattctgtgtttgtgccctgttcacagctcctctgacaactccttagtgacaggggcaacagctttggtacacacagggtggtgaatgaggccccgccctcccaggggtcctccccagacccagcccagagggaggctgtgctggagcctgagctggccaggagagtgtgtacttggttcctgtttcagttgcttctgggccctcagggcactgagcccttccttgctcctgtcaagagggattagggtctctgctggcaaggggaggagggcggataccggcaggggagaagaggctgggaaggtgctactggtagagggagggtgtggagtgcacgagactgtccacactctggtctgcagccgccactctgtggcactgag

SEQ ID NO: 12197 - DNA, 1074 bp, Homo sapiens
tgcactccagcctgggcaacaagagcgaaactctgtctcaaaaaataaataaataaataaataaataaatagatgggtctccacgctttgttgccttaggctggtttccaactcgtgagctcaagtgatcctcccacttcagccttccaaataggtgggactattttattgctctttgaccattttaattgtttttgtaaactgtctgttcatatcctttgcccattaaaaaaaggtagatcatttgtatatttcttattgatggtagaaatcctgtctgtgttatggataataactattctttgtcgtctgcatttaaaatattttctctttttcacttatctttcagcttttgagacaaaagtcatgctttatgggaaaatatttgaaacatttctgtctttgctaggaacaagccagggatgtttactattaaaactaagattttaggagagctcctggccaccctaaagcctccttgatttcatatatattcatcttacaaagagaaacgattgacaatgtatcaaaactatggagttcagcaacatgaccagatgtcagattaacaaacaaaaattatataaataaaatataagaatataaccaacactaaaataccatagaataaataatctgattcacaataaaaacattatattttggccaggcgaggtggctcacacctgtaatcccagtgctttgggaggctgaggtgggaggattgcttgaagccaagagtttaagaccagcctgggcaacatagtgagaccctgtttacaaaaaattaaaaaattaacccggcatgctggcatgtgcctgtagtcctagctactcaggaggctgaggtgggagaattgtttgagcccaagagttcgaagctgcagtaagacatgattgtgctactgcacttcagcctgggtgatacagcaaaacttattctctaaaataataaataaatattttttttttttttgagatggagtctcgctctgtcacccaggctggagtgcagtggcatgatctcggctcactgcaagctccgcctcccgggttctcgccgttctcctgcct

SEQ ID NO: 12198 - DNA, 1034 bp, Homo sapiens
cttgattcactgccctctagcaccacccatcctggtagatggagtgcttaaccccaaccgtgccctatgtacagcctgaaccaccaaacagacaccaaaaaaattcttcctgtggtttctggggctcccctgctccacactgagaggctccttaaaggtgctagcccctgatacagctatccccgccagttttctccttttttcataacttccttcccatccccaaatcattaatttttcattaatattgtacattatatacacaggaaggaaatacattattttttttaaatttcataaccagcctgtttagattccagtcttcctagctatatcacatatgccttgttgatatgctctttctgctttctttagacttaatgtttgacgggggtgggggtgtctggaagaacaggaaaggtggggatcctaaggcagattaaaggactccctccaccccactacagcctcccataactctagtcatccctctcatagtacaggactgatttctctgtgtctgtttgtacacacaaatgtgcatacagacataaattcccccaccccataccaaggtggttacctagcaggaatgagcgtaggtggctgctggccaccattaccaccgtctgcatcagctgtgttgtctctctttggggtaaagtcctaccccagaatgagaaaaggctggggagagtagggcaggttaaaggagcttatgtcctctgtagatgtaggtttgtatcatagctactagggtttatttttttaatggggggctaatagcacagagttatctcaccagcagtagctactggtgagtgatgttttagctgtaagaagtggctatgagcaatagtttcactgactttaccttagggcagtgccacagtaatctgggaacttgttagaaatacacattctcaggccccatcccagacttattgaatcacagactctgggggcagggtttaaaagcactccaagtgattctaatgcacactaaaggttgagaaccatttcttagggataag

SEQ ID NO: 12199 - DNA, 1095 bp, Homo sapiens
ttcacttacggagaatgtaaggttacctttgatgtatgaagtagcagtattttccagtttttccataagctttattccttctctctacctgccaccaaaaagaaagaaaccctcaagagttctaattctttttcatctatttgcagagctatttgggtacctcattttgtcccttgactttagtgtagtggtggggtctttcccaccaccccactaagccttggcaacctcattttgtggccttattattaaagattgcttggtagtgaaaagggaagggcccagaatctgactggctgattctgtctcctcccctccctccttctttagtttaaccatcagggcagacaggaacaaagtatttcaaagcttgttccatcaagttagggattaatcgattcctttatgttttataagagtttaccggccaaagcatattgtcatctttggtcatttttctgctcctgcttctctctcttcattcccctatcaacattaccgcccctgtctctcttctgtaactacttcagactcagccctcctggaggctgtcatgtaggggactctcgagttcctttgttctaccccatctctccccctcacacatctgtctgcttttctgagctagagtcttctgttcacaagtgcccatcaccgtctggactatcttctttctctttcaccaggttcctagcttagccactaggtcttccaggtcctccagagtttcttcaacccatttcttctctcttctctttacatgcagtgctccaggatcttgaagcgtcatagccaagatgctgagtgggtttacttgagtataagattgaaaggagggaggaagaggagagggaaagtgcagaactggtcccagcaaaggaccccaggttctggcctgggaaattggtgactattgctctcaaccattcttactttgaagagttgggttgcagagggagcaattcatctctcttgtccctcttccacgttaaggcttctcatctccccttggctctgaactatgcagtttctaccaggaccataggaagcaattcagagccagaggcctgtggatagataggtcagctttaattg

SEQ ID NO: 12200 - DNA, 1032 bp, Homo sapiens
cattaaattgagttggaaatttcttctccatttttttattttgggagagataatattagtctgaattttaaaaaattatttcttggccgggcagggtggctcacatctgtaatcccagcactttgggaggctgaggcgggtggatcccaaggttaggagatcaagaccatcctggctaacacggtgaaaccctgtctctactaaaaatataaaaaattagccaggcatggtggcaggcgcctgtagtcccagctactcaggagactgaggcaggagaattgcttgaacctgggaggtggaggttacagtgagccaagattgcaccactgcactccagcctgggtgacacagcaagactccatctcaaaaaaaaatcatttcttaattatctatattaatggagaatataattcagtagggcctagagtagagtacaagattcttttttttttgtcagagtctcactctgtcactctggctggagtgcagtggtgtgatcttggctcactgcaacctccatcctggtctaagccatgcctccacctcccaagtagccaggattacaggtgtgcaccaccacgcccagctgatttttatatttttagtagaggtgggatttcaccatgttggccaggctagtcttgaactcatggcctcaagtgaccacctgcctcggcctcccaaagtgttgggattacaggcatgaaccaccatgcccagcatcttttttttatttgtttttgagtcaggttcttgctctgttgcccaggctggagtgcaatgggacagtcatggctcacttgcagcctcaaccttctgggctcaaatgatcctcccactagagcctcctaagaagctggaatgacaggaatgcatcaccatgcccagctaattttatttatttgtagaaacggatctcactatgttgcccagactggtctctaactcctgggctccagtgatcctcccaacctcggcctcccaaagtgctgggattacaggcataagccactgcgcctggcctcacatgta

SEQ ID NO: 12201 - DNA, 1009 bp, Homo sapiens
gggttaaactctgttcatttttctttcacaacaggctgctgctgggccccttgacatgtctctgccttccacaccagacatcaaaatcaaagaagaagagccagtggaggtagactcatccccacctgatagccctgcctctagtccctgttccccaccactgaaggagaaggtaaattctctaccaaggatcatctcaaatgttaattgataaagttttgattcattaattatataaatagtatgtcctaactactcaggaggccaagatgggagaatcacttgagcccagaaattcaagaccagcctgggcaacatggagaaaccccatctccacttaaaatacaaaaattacctgggcgtggtggagcatgcctgtagttccagctacttgagagtatgaggtggaggatcacttaagccctagaggtcgaggctgcagtgagctgtgattgctccactgcaccccagcctgggcaacagagtgagactgtctcaagaaaaaaaaaagtatgtattataggaggaccgattgtatttaaaggaatatttagaagatttatataaattatacctattctccttcccagcaatttcacttataagtctatatggaagagaaattagtgcatatgtctaccaaaagaagtatgttagaatgttcatagcaattgtattcttttgttgttgttgttgttgttgagacagtctcactctgtcacccaggctggagtgcaatggcgtgatcttggctcactgcaacctctgcctcccaggtttgagcgattctcctgcctcagcctcccaagtagctgggactacaggtgcgtgccaccacgcccggctaatttttgtacttttagtagagatggggtttcaccacatttgtcaggctggtctcgatctcctgacctcaggcgatctgcccgcctcggcctcccaaagtgctagggttacaggattgagccaccgcgcccggccagcaattgtattcttaatagccaaaaat

SEQ ID NO: 12202 - DNA, 1051 bp, Homo sapiens
aatttatttttatttttgttagaaatagggtctgctgatattgcccaggctgatctcaaactcccgggctaaagcagtcctcccgcctcagcctcccagagtgttgggattacaggcatgagccaccgtgcctagctcattttccttctctctaaagaacttcttttaagatttctggcaaggcaagtctgtgggcaacaatttctccgtattttggtttgcttgagaaagtctttatttttccttcacttttttttttttttttttttgagagaagatctcactgtgttgcccaggctagagtgcagtggtgtgatctcagctcacctcaacctcctgggcttaagcgatcctcccacctcagcctcccaaatagctaggactataggtacacgccaggacacttggctaattttgtttatttttcattgagatgagatctcactgtgttgcccaggctagtctcaaactcctggacacaagcaatccatctgccgtgctgggattatagacgtgagccacaccacatgtggcctttcttctgaagaattgtgcaggatacagaattctaggctgatagggttttctctctttgactgtactctctgcttgcatggtttctgagaggttagatgtaattcttgtttttgctcctctgtaggtaaggtgattttccctctgccttctttcaagatgtttctctttctctttgattttctgaagtttggatatgatatatctaggtgtagttttttgtttgtttgtttgtttgtcatttagcctgcttattgttcttatggtgtggtgtctgacattgatttggggggacatttttagttatcgctttagttattgtttagcaataccaaatattgtgtgtgtttctttctttctttctttctttcttttttttttttttcagagacggagtctcgctctttctcccaggccggactgcagtggcgctatctcggctcactgcaagctccgcctcccgggttcacgccattcttctgcctcagcctcccgagtagctgggattacaggcgcc

SEQ ID NO: 12203 - DNA, 1031 bp, Homo sapiens
gtgagcgtgcacgtgtgtgcgtgtgtgtgtgtatttgtgtgtgtgtgagagagtgatgacaggagttcctataaaaaagtaaatgcaaagaaaaagtggttcagggcagcagcctgtagaactgagctaaaagcttggctcctgagaagttatcagagagacagtgacagtttaataggatggatgaagactacattttaatgctaagctttgattacctccattttatgtctctgttctcaagctcactgacaataacaaatcttacattggcatagttatttgaatcaagtgaaaagaggtgttcagatagttttaaagatctcagttgtagtacatacctggagtttgtataatactagaatgggtaaatagtattatagacatctgtcacttcagtgaacatctttttttttttttacatggtggcaatctatgcacattaattttttaaattacattatgttcataacttcagacatttgtcattttacttcagtttcaggtattttttaggactaacggagactgtagtctccttaggttgtacgtattgtgagggaacaataaaagtagtctaaaaatttcaggggtctagatgtctgtgtatgttttataaaatatcatattatattcaacactttaactttccctcttcagtctttcctgttctttccttctaggctttacctagataattgcaatagtggataggggagactttatttcagccttctttcactttctgtgcatttgaaactataactagacaggaccttatggaggtttgtactttcagttatgcatatttgactgcccagatgaggagattgtattcacatacatagctgctcttggcagagtcatggttaaaggtttgaacatactgtaccttgttggctattcccatagtcctaagggaggcattttgcttctccatagacagtaatcggcttgtcagagtggagtggctttttgtttttcctttatctagtagaatggagtgggctaagcctttctgggaagcaatt

SEQ ID NO: 12204 - DNA, 1048 bp, Homo sapiens
ccagccctcccattaaatgggccatactggtactgtgggactctggatctttaattctgtccctttggcaagttgccctattatctggcataagcacaaaagaaaagcaggaaagaatgagttggtggtgattactaattctttatgttagggaagcatcttgaattggagaattacgaggggaagcaatggctctggtaggtaaatgccatttgtggtagtatatgctatgtttacatgtttcgacaggtgaaggcaatttcaggcaaaaaaataagccttttttccccaccctctgccaagagttttttaaaattctaatttttattaaataattcatatttcattcaataattcatctagttcccatctggtaagagtgcctgcatgctgtcaggcagctgaaaatacacggcattatacacaaattaggccaaatgctaaaccttattttttgtattatgttgactttgcagtaactttcagttcactctctggatgctgcagtaacctgtggtggaagtagaccgctcttacgtatcatatagacaaaactgggactgggatttttttttttctttttttttttttgagatggggtctcgctctgtcacccaagctggagtgcagtggtgtgatctcggctcactgcaacctctacctcccaggttcaagcgattctcctgcctcagtctccccagtactgggactataagcgcccaccaccatacctggctaatttttgtattttttagtagaaatggggtgtcgccatgttggccaggctggtcttgaactcctgacctcaggtgatccgcctgcctcagcctcccaaagtgctgagattacaggcgtaagccaccgcacttggcctgggactggaatttttaaaatgtagacatgctaagagcaggaattaaactcaagtttcttaatgtcagatctgatactcttgacacttgcccttagaaacatgtagttgattatttttgtttttcatgttatatttaaacaaatatatgtatgttactagagcacagtagattaa

SEQ ID NO: 12205 - DNA, 1120 bp, Homo sapiens
tcagcaagaactctttccctcctctaaataggtagaaaaatgagaaaatttagcatcaaataacagaatcaagataaaagtaaggaatcctgcctgatccttgtgttgtgtctactctagcccttgtagtttacttcctggttgaaaatatattagaggacctcgttgaaataaaattctcattttgtgattatattaggaaagcagattctgggacatgtagtgaaattttctctagcacaggagttaggaatttttgcagagatgaattgctttccagacatgctctaagttttcagccttaatggtcctggtcattgcatttatttacttttgtttacttgtatttattttttgtagcatgttgtagttcccgaaagtgctaaaaaaatcatgtatttaaaacaaaccaaccaaccagaaaacccccctcatcctggggctgtgtgaagaagaatgaagctctcatttcccagtacccaatcatcagcttgagctggcctctcctaggaacagaatttattgaagcaatttatcctggctaaatgtgatataaatccatgtacatgtatgtacgtataggctctgttccattacagtagtgctgtagcatcattttccttcctagttagaccatgtttctatcacactgaaagatgaccaagaaaccccttctattttatggggcaccccacaattttaaacaccgattagttgtggaattactgattagacaacgagaaatactggtttctaaccccacagtgagtcctaagagagtaggagagatgttacctagctaccctctgagttttaagcatggttttccgattaccagattcagtctagcacgttaacattttatttcaacgcgagcctgacagattgtcctgacatttcagtttatttccaagataaaaatttgaaatttggttacagttctgaagtcacttgcaggcatattcaaattgtagttcctctctcatcttccctcgttcgtattcttttgtatacctttctctttcatggaaggatgtttgaaaatatcctttaggagtttataagactattttaccccccactccatttttctcttccaccttccaaaatacagtttatc

SEQ ID NO: 12206 - DNA, 1025 bp, Homo sapiens
tggcgtgatctcggcccactgcaacctccaactccctggtttgagcgattctcctgcctcagcctccggagcacgtgccaccatgcccagctaatttttgtatttttggtagagacggggtttcaccattttggccaggagtgtctcgatctcctgacctcgtaatctgcccaccttggcctcccaaaatgccgggattacaggtgtgagccaccacacccagcctggataatgaattttaaaataattacaataaaacatgcttaatgttaaaaatgtgaatattagctgggtacaatggctcacccttgtaatcccagaactttgggaggccaaggcaggaggatcgcttgagcccaggaattttgagaccagcctgggctacatggcaagaccccctgtctctacaaaaaaaaaaaatgagctgggcatggtggtgtgcacctatagtcccagctactcaagaggccgagacaggaggatcacttgaactaggaggtcgaggctgtagtgaactgtgatcatgccactgtactccagcctgggtgacagcgagaccttgtctcaaacaaacaagaaaactcaccataaaaaacaaactatgagcatcacttaattttcctaaataaaatgataccccagaacatgtagcccctcaaattcatgtttcgggacatttatttatataataagcatatgtaacatgtttatatataataagcatatataacagtacctgttacgctctgaagtgttggtaaaacatgattcagttgtaagtagacaactttttagaggttgtaaatagatgtggtgtccattcttgtacctttttttttttttttttttgagacagagtctcactctattgcccaggctggagtgcagtggtgtgatctcagctcactgcaacctccgccttctgggttcaagtgattctcccacctcaccctcccaagtagctgggattacaggtgcctgccatgacacccggctaatttttgtatttttagtagagatagggt

SEQ ID NO: 12207 - DNA, 1132 bp, Homo sapiens
gtttcggaaacttttttttttttctgaggcagggtctccctctgtctcccaggctggagtgcaatggcgccatcttggctcactgcagtctctgcctcctgggctcaagtgattatcctgcctccgcctcctgagtagctaggactacagatgtgcgccaccgtgcccatctaatttttgtattttttgtagagacagagtttcccatgttgcctaggctggtcttgaattcctaagttcaggtgatctgcctgctttggcctcccaaagtgctggaattacaggctgggcccccatgcccagcttgttttggaaactcttcttttttttttctttttttttttttttttgacacggagtctcgctctgtctcccaggatgcagtgcagtggtgtaatctcagctcactgcaacttctgcctcctgggttcaaggagttctccccctcagcctcccaagtagctgggactgcaggcacatgccaccacgcctggctaatttttgtatttttagtagagacgtggtttcaccatgttgcaggctggtctcaaactcctggcctcagttgatgcgcccacctgggcctcccaaagtgctgggcttacagtgtgagccacctgcccttggaaactcttttaggaaaaaaactttattccctggacatttcaacttagaaatgaaagaattaaactactctctgaaaacaattttatgtagtttccctgtaatgttgacatctccaatttagacctaacttttcattttcttctttttttttttttttggagacagagtcttgctatgtcagccaggctggagtgcagtggtgcagtcttggctcactgcaacctctgcctcccaggttcaagcaattctcatgcctcagcctcccaagtagctgggactacaggtgcccaccactgcgcccggctaactttttgtgttttagtagagatggggtttcaccatgttgctcagggtggtctcgaacgcctgagctcaggcaatccacctacctcagcgtcccaaagtgctgggattacaggcaagaaccatcgcgtccgaccctaacttttcattttctgtttggaataaaaacctataccaactataaacacacacacacacacac

SEQ ID NO: 12208 - DNA, 1034 bp, Homo sapiens
acttttgagaagggaaataatgtctgaaatatcagtaaagctattacatgaagagaaaccagagtacgtagttgtattaacctttggttttctgcaatcagctgaagcctttctccctggccaagaagttgcccctatagcacattgagaccaattcattgctgacccgttagcattaactactgagctgggttctagtatttcacagtaagtgcattgctattggacattcagaacatttccagtttgcctggcagcagtacagaaaattacccagtgagagagcagagtcccttgttttggtcttctgccctagaattggtgattgctttgactagggcactattaaacccaagattttttttttctcactagtgctaccatctagcagaaagctagagtgataacactgctcatctttcaacttgtggatcaaagtttacaccctgtggtagtttcagtgttgtaatttttaaacacgtttgtttaccacggttttaaaatgttaatagctctacttactgtatcttgttctctttcctttcctcatttccaacccaaaatgaaaattgttttttcaaccaactcttaaactacttctttgcctggagtaaagtcactggctctgtctgaacacagctgctctgaagttctcagaagttattgttttgtgcatgtcaagaccgagtttttcctaggctacagtgggagggagttagtgttacagcagcctcctatccacgtctgataaggaggagccttctccttgcaaggaagttttaggtggaacagatagaactccacgtaaatgtctaataaagctagctcttttcttgagactagttagcatactggtatataattgtcccttatcccttaataaaagtactaaagttaaggtacaggtgtttctttgagaaaaacaaatgcagcattcatttaaaaggaaaaagcattcatttcttttgttgttggtttctcagaaaatggtcctacgattttggagttcatgaaaaagtcttctgtctctttaa

SEQ ID NO: 12209 - DNA, 1025 bp, Homo sapiens
tttgggcatgatggtgttaccctaaaagcttctttattatgtgagataatcttgaagagggggattctccctgagcccatcttagatatttatccttttctttgtgtgaactagaaattcagtcttttctcttctccttctaccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagatgtttcttgagtctcctgtgtatatttcttttccacagttggctgagtgccttcgtgagagtacaaggcccgaagggtagtgatggtgctaaactcaacatggatttggctgagctcactttttcttaattctgtttcaggaaagctttatttgaaatagcataacattttaaattattttcacctggcatggcctgctacttgcctgggaagattggggtcagtagcaacttcaagttctggcttaaaatgttggctaataggctttctgtttccactgtcactctcctggctcaggcccttattgtcatccacctcgtctattgcaagaacctcttaactggccttctgcctccagtctcttccctccagcatttacttctccttaccactgccaggtgaatcctccttaagcataagactggttttatcagttaatggttcaaaaagtcacctcaactttctctgctttatctgtttagtcctatacactacataaagtgactgtcatttttcagatgttttcctgtctttaccatatcttcctgccttttcctttctctgctcatttctgctttctttccctgcatctttgctcactttcctctttttcgaactct

SEQ ID NO: 12210 - DNA, 1039 bp, Homo sapiens
tgcccgcttttctttcagggctcaggatgagtgactgcccccagtgggggtgcttggcaggtgggggaggggaagaggcttcagggcagaaggctcaatcgcttttattgaccccaactgggtgatgaaaggtgatcaatgatgatcgatggaaatgacagcctgaggcttggggctgagagggcatccagacagcagtggtcagcccatccttgtgcctcctttaaccctggctgcctttctgtctcagaccatctgtctgtccccagtactaaccatcaaaccctgtgtagggctagatatctcaatgtagtccctgtacttagtcccaaaggctagttgggctagagggaaacaaattcttctggaccacggttcacaatgaagaactggaaaaagacagacaggctcaaaccatagggccaagaatccttgtctcaggcctttgggtgaaggtaggggtagggggtgcaggctggatcctcatgtaaggtataaagaagtcagttggtccagagcccgggcctcaggtctccagtttgaagcctttcatgtctctctccttcctcacaggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggct

SEQ ID NO: 12211 - DNA, 1076 bp, Homo sapiens
gattcccaggcctcacacgggacctacttgtgttgggggtggggttgggacactatggcaaatactgcagtgttctgaggagggaagactttatcaaagggatggtttgagctgcattttgaaggatgggagtgatttggatatgtggacaggttggggaatcaacagtcctagttgactggatgactgctggatgatgtcctggttgacttcaggagtgtatttggttggactgtagaaatggtatgtgcaaggttttgggagttgaggcaggaaaggcattttgaaaatgtgagtagaatggtcaggttggaacactgggtttgaatgggagtggagtgaagcaatggcctttgcagtttacaaagcttgctgtcatgttcctgccccctcccttctccttcctcccacctcccttctctcttccctttcttcttcctctcccatttcttttctcccttcacctaaacataacatctcattccatccttacgtctgtttgtttgttttgagacagtctccctctgtagcccaggctggagtgcagtggcacaatctcggctcactgcaacctctgcctcccaggtcctggttcaagcaattctcctgcctcagcctcccatgtagctggaattacaggcacgtgccaccatgcccagctaatttttgtatttttagttgagacggggtttcaccatgttggccaggttgatcttgaactcctgacctcgtgatccacctgcctcagcctcccaaagtactgggattacaggcatgagctgttgcgcccggcaaatttatttatttatttatttatttatttatttatttatttattttttattttatttttttttgagatggagtcttgctcttttgcccaggcttgagtgcagtggcacgatcttggctcactgcaacctcagcctcccgggttcaggcagttctccctgcctcagcctcccgagtagctgggattacaggtgcccaccacaacgcccagctaattttttttttttgagagagagtttcactgttgttgcccgtgctggagtgcaatggcacgatcttggctc

SEQ ID NO: 12212 - DNA, 1038 bp, Homo sapiens
gagtgcctccaaaggacaggggagtgcatatgtgatttcgattccttcctcacttcccggatttgatgtcagagaagtctgacatcagtctgaagtcggcccttggtggtcagccttatcgcttggtccaactccgctgtctttgtgcttaatgtagtatgacaccgtattttataaaatatctacatttcttaagcctctggctcttggggcgactttgggtagaacttacaagttcctcctttgggttctcttagtgttttgttccgggtattaaagctcacatcacactgtattacagttagttgtttatttgccctcacagcagattatgagcttacagaaagcctggcctacattttactctttttggatttcttcctcatcaagagactgctgcagtgcctgtcatgtaagagactcataagtattgaaaaaaaaaatgagttaacaggtggtaggttggatggagtatgtgattttccatagagaagagagttaaatgagttgctcaagagaaccttcttagagatgaaacaggagtagaattcaaatcaattgacttccagcctgtggctcttgctatgagatcaggctttgaagttatggaacaatgaaagtagtatcttgccactcttttccccagccttgctgtttccaacacaggtgtctaaatgtcaaaggtgggctcaagacttctcgagattctagagctggagcagccaatctgctaatgttggtgttgcatggggagatgcaaagcaaggtcccctgaaacactggcgttctccacagcacccttctcagcttttgtatgagcccagtttgtcctgggtagccacctggacaacagatcagttaaagactactgagacagtcagggaaggacttcctaagttgggcctctgatttcttttctctcccacttcccctaggctagggtgagaaaataggtttatcgagctgttgtgtcaaccttgagttcttatcttggagaagtcactcctgacccaggcagaaagttgagaggaaggaatg

SEQ ID NO: 12213 - DNA, 2174 bp, Homo sapiens
aaaaaaaaatctatttaggtcttggaatggttcctgtacctagagtatccatattgaaccttttttttttttttttttttttttttttgagatggaaacttgctcttttgcccaggctggagtgcagtggcgtgatcttggctcactgcaacctccgcctcccgggttcaagcagttctctgcctcagcctcctgagcagctgggattataggcgcctgccaccatgcccggctaatttttgtatttttagtagagacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgcccacctcctcaactgattgataatggttgaccttgggcaagtcacttctttcaatgcctcagttccccatctgtcaaatggggttaataatactgacctacctcacaggggtgttgttgtgaggcattgtaaatcaaagttaatagaatacttcagggtcctctgtggaggatgtcttgagccagagtttaagcctgacacacaggctttggtcctcactgagctgtctccaagactggaactacttagtgactcggcaaattttctgccccccacccctcatcaaagctgctagttcagatgttgacagtgttttcatgaatgttggaatcttactagtccagacttacttaggatgttgttggggaaggcacttgggattttctgtgtcttgcattcacagagggaggccatttcagattcaagagcattggattagggaatcgtgaggcagggat

SEQ ID NO: 12214 - DNA, 1487 bp, Homo sapiens
gaataaaaaatatagtgttgagatccgtacttttgtaatcagaccaccaagcatgcctgtggcaaggcagagaggaaaggtctggagccagtgtattgcagtttcatgctacctttacctgctaatcataaaaattatgttttcaaaagtagatgatactagccttacacccaaaaacatgttctgaattagatgccccctcacccaatttttattaagctttctaaattccagccacattgctgtacatcaacattggtttcattcaacagacatttttttggcctgaagatacaaggttcagaaagaggccatccctgccctcaaataactttcatactggtgtatgatgaactgaccattaatagtttaagtgcttacaagctatgtttctgttcaaaaaaaaaatagtttggtataataaatgctataaaccaatacacatttctgacttgggggcagagacagactggctgatgttgtatagtttgtagccctggagtaagaagttgacattaatttcggcctatatgtggaaaagacctataacattgggtgaactgagccagctggccatagaacacaagaacatattccaggaaataaatatagctggagggttggaaatgctgttattactgagagagaaaacaggtgagttgggattgagaactcctgattttcatccctggtttagattcttggccaaagtagtggtagagttaatctttgcttgtggaaagcattaactatgttgcagattcagttgtgttacattattgtgggttctataacaacatattcctcatggacactttaccagagttgctcacacctttttcaatttctcatcccttttggaggaatgaacatgagacttaactgcctttaagcctaaaacggacatgctttccaatgacaagagattttctaaagagaagtcttggagcacatctgttaatacctgagcatctactctgagcagtgcagttttattcaatactggagagagggtgatttctttttttttgagacggagtcttgctctgtctcccaggctggagtgcagtggcgcaatctcggctcactgcaagctccacctcccgggttcacgccattctcctgcctcagcctcccgaggagctgggactacaggcgccggccaccacgcccggctaattttttgtatttttagtagagacggggtttcaccttgttagccaggatggtctcaatctcctgacctcatgatccacccacctcggcctcccagagtgctgggattacaggcgtgagccaccgccgggccgagagggtgatttctaagcagagaattgtatcagttatgtggaaacctttgccagaaatacatataccttgtatattaaatctgagtctcagatttaatcatcgaagcgtagctgggttaagaaacagtctgatcgtaaggatgttgtcgattctgacccatggatgaccacaagaaa

SEQ ID NO: 12215 - DNA, 1038 bp, Homo sapiens
atccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgcccagtagaggctaccaaggacagcttagcagccctttgattgctgggctgggcagatggccttcaagttaagatcaaatgccgggaaaatcagcctacatgggagcacccattttaaacctggagagaaccatgatgttttcttcttcaaataacaatctagttttttttcccccagtactaaaattgtattgtctttcagacaatataatttttatttaaaattggaacatactatcttcatgctttctaagctaaatcttcatttagatttcactcctcagtagatcccagagaagaagctatataggatccagattcaaatttaacagtgtcttctacttttttagttatgttttctatcaactcctgctgc

SEQ ID NO: 12216 - DNA, 2318 bp, Homo sapiens
ttacttacatttcttcttgaaaatattgaaagggtccttttcaccttgaaaccaaggtgaggaggaaatcaagtcaactaaatccatataatgacataaacgtatgtctggacagattctttcactcttcctctccttttaagtctcatattctttctctccaggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaaaggaggggatggtctctgtcatttctctttgtacataatacattcacctccctgcctcctctcctttctacccacccctttctatcctaaacacatccataaaaaatgtgcttatcactgtgctccacaggagaaatgttggtattggttctcttgtaacataactgatggtctgattaatgataagtgtctctctgtgaagaccaggcatttacatactgagtgtaatacccacaatttttttttcctttgccctgatctcttccttctgcttccctgtgacctcaagatgagtttcaactttttaatcaccttagagtcttgatcttttcagggttggtcgctttttaggttgggggattttgttacaatgatgttgaattttggtttcttgctttggttcttagaacatgttgctgactagctggcctttgttctgacatgttgagatggaaaggatgttgcccatctgttaaaaagccaatagcaactgcctacctgttggggctttcccaaccttgttcagctctacccaggagaatacagggtttctggtgtggtcttctgggccaccctctgttgttcatcctcactcatcctcccagaattactccatcctttggaagatttgaaattttacactgaaatctgtcaagacactctttttagccccaggactttcggtattgcttttagcactccccacttctgcttctgtaaagtgatatcaatttgtgataaaatgacaagattattaactgtgcagatttgtagctatagtacatgaggatgatggggtagggtacaattgtctttattatcatatatggtatgtatgtatgatttctttccattcctcatatttagactgtatatttatgtaggtgtgagtgattgcctggtgcttgcttgtgccaaggtgctaggcaccctccaaccctgccaacttttgtggcctcccaaagcattcctgttaccaaagaggcttcaaacctgaccctcacttctcagtggacccgagtttcccttccatgccattattttcagtggggaagttttagaggtgagctgttggccacaatatcaattttaagtgttcatagcagttatgtctcctgcattcttggctcctggatttaccaccaagagtccccaaaatattaatgctcttccctttttctaccctcaaacttatagttgtatcttattttttaaaatgaattttcatggccaggcacagtggctaccgcctgtaatcccagcactttgggaggctgaggcaggagaattgcttgaagccagaagtttgagaccagcctgggcaatgtagtgagaccccctgtctctaaaaaatataaataaaaataaaggcatgttcctgaaagactgtcaccttggaaagtgacaggccctggcattagcatgttgacacacccttttcttcttactcagcaaaatacttcgttttggtttcttcttgtgttgctattgagaaatttgtctgatcatatccttctgcctttgtcccccaagaaatgccctactttatccttttctttttgtagttgaggagggctagagaatcacaattaaaagtaaggaaatagcagggttttgaggatccttgtcccagccccaaagctgaggaaataagaataaatgcttaatatagccttaattctagagcgcaccagccatgaggctgcttttcttgttgtttttgatttttaaaacatacagctgtctggccaggagcatctaccatttctagattattcagagtaatgaggggaatggatggattgctccagtccacagatgagccacataatatgcaaatcatatacccattcatagcatttgttaacattgcttccctgctcagctgctgattgaattctgtgtgcttatataaattatgtcaaaaattatactgcataattgaggtgacagctgttgctgcagtgacatgacagactggaacaatgaagcttttggtttaa

SEQ ID NO: 12217 - DNA, 1128 bp, Homo sapiens
ccctggaatatgacatttcctgtctctggtgaggttggaggctgttttattttaaataaagcacataagatattttcttgaagcttaggactcttctaaattcatggaaaaattattttaacccccccgcacctacattttgctactacttcctcttccaaatagagtattttaataaaaacttagtcttatagggcagtaatgggtataggcagttttttaggtgggcagacctatagctaataagttctggagatatggtctccaactatatattcttgtaataatttttaaaattttgctaatttgaagtgaattgataattgccactttttatgtgacttgaacatcattctgaggttagtagtgggccctccctgacccagtggttttctggtcagggtggaaatatttagagggtgctgataaacatctttaaagattacaggaaaataataatggagttcagctaagaaaacaatttctgctactctgtaatccagactgtaggcaccatttagcatggttaaggaagaattcttaaaaatgattatggaacaacaacatgggaatttttaaaactagattctctgttgagtaccccctggtgtgcatatttctgagcttaactcaatttccatttgtgtttccttgcttcagctttccttgggcctatgaatggttcctctgtattttgaggaggcttcatgttgatgctgagtctggggccagacttctttttcctcctcctcttcctttggccctgagtcaacttcagttaagagggagaggtaccttcttaactatttgggttagttgcatcttgggaattactgaataatctagtgactaattttgaattttaggactgaaaaattttttctcctttctgcctccctcccatccccaaattagctttctaaaaaggaagattagtgtgtttgagatgtcagccttgcttttgtgagctgatggatgctctgaagggacaagctcaatttgtttaagggaaatgtaccaagtcactgaaaatgtggtgaaaggtgcctaagcaagccttttttgtgtgctgctaagagactgggcaagatgctcagagcacagaaaactcatattttagtggctttt

SEQ ID NO: 12218 - DNA, 1049 bp, Homo sapiens
tggggtattaacacaggataactaacctgtatttgttagctgtgtgcttaaacctttctgaagaaaagattttctacaagggatgtaatagactagctggaacattttcactacatttttagtgagactatagactgtgtagcctgaattttctttccagtagtagtagttcatcaaaattaaacactgacagatttttttctacctgaaactaggtcatagagtaaaaattttcacttgcagtcttactcttcagactcactgaatgcctgttccatcctgtttcattgctaggaaggacactagataaagccatgagcttgagatggtgtacttgaaaggaccgtttcaagatcaggttttataacacactcattatttatttcttctgtggagaggagaaaccaaattggattcaagtatttttctgatagtaatctatgtttcttagaataaagcaagttcatatctgagccagagggcataattatgtcagaataaaatataattatgtcggaataaaatgccctgtactaaagaggtcaactaacaggctgggaaatcttaagttttgtttttaagacaaatccttgaactctctgtgcctcgtttctcatccctaaatctgtgcaactcacctcacagggagttgtggagggtaatatactgctaatttgttcagtgtttcacaacaataaattatgcctaagatctgataaaacatagcaaacctcatttatgtaagtagagacaagcatggataagacttacagataataaagaaaattcattaaaatttttttaacttccttgattattaaacatttttccttctgtttcctatatattttccaaagtattttcctattgtttttccataatagacttatgagatagggcaaataacaaacaccaggttatataataaatgaataaattcatcaagcggacataacaatcctaaatgtcctaaaagctaataataaagcttcaacatacacaaaggaaaacagaaatgaagtaacaagccaggtgcagtggctcacgcc

SEQ ID NO: 12219 - DNA, 1034 bp, Homo sapiens
ttttcctgggattcttttggatccacgtctcaaaacttttttgaccgcaataagaaatatattttacactaatcctgtacacacattgaaacatttcactaaacgtgcagagtactctgatattcttttgtctgcagtatactatttcattgtcttaagaaagcagtcaatttccattgaactgatttcacagctgtttatagacccagggttttgggggaaaaagactgctgatctgaagaataggtcaccaaatcatgccaactttgattgctttctgagtcagttccttccatctccagccccagccacttgtacagatggtcccttgcttgtgatatttcgacttaagatttttcacctttacaacggtgtggaaagcaatttgcattcagtagaaaccatatttcaagtatccacataaccattctgtttttcactttcggtacagtaatcaaccaattacatgagatattcaacactttattataaaacaggctttgtgttaggtgattttgtccaacagtaggctaatgtaagtattctgaacacatttaaggtaggctaggctaagctatgatgttcagtagattaggtgtaggaaatgaattttcaatttttcatattttcaacctatgatgggtttatcaggacataaccccatcaaggagtatctatgtaaacagattaagcagtgacccattatttggtgtttttactcatgtgttttactttgaaagattataggagccaaaccgagactttctagtttactgtcgtgtgcaagtgaaaactgcttgttttattgtgaagtctcacaatgcttaaagagggaaaacaataaaaatattgcaaaatgtctcccaatgtgataggttttttttttttttttttttggaatggagtctcgctcttgttgcccagtctggagtgcggtggcacgatcttgactcacctcaacctccgcctcccaggttcaagcaattctcctgctccagcctcctgagtagctgggattacaggcatacgtccgg

SEQ ID NO: 12220 - DNA, 1034 bp, Homo sapiens
acataagagcaggatgtctcctgcttgaagcctaactgtccaccagaaaggactgctctttgggtgagttgaacttcttccattatagaaagaattgaaggctgagaaactcaggtaagcacttttgttgtgggtatacttttaccttcttggtctcctcatctcccaggtggtaacaaacagaaatgactaaagcctatatgtgtgtgtagtggaaaggagcagagggaactgaatacagagaggatcctgaatacacgatgctgaatagagagaggggactcctgggggtctttggggatggggaaggaattaaaaaagttggagggcactgggtttactgagagcagcgggatggatatagaagaggactgaggtttggagcagaataagactaagatatttaggcaagagatatttagataaaaacttggggaaatatttgagaatgggaaaggactaagagaacctaaggagagagttagggatcttgagatgaagaggcctgggaatggttcaggaggatactgaattaaggtgaggtccaggaacagtttagatgtccagggtcccagaactgttcaagagatctaagttgaatgctaggttctgattccctcttcctcttccaccctctgcctctttagcctctatcatgtggaacagctctgacgccaacttctcctgctaccatgagtctgtgctgggctatcgttatgttgcagttagctggggggtggtggtggctgtgacaggcaccgtgggcaatgtgctcaccctactggccttggccatccagcccaagctccgtacccgattcaacctgctcatagccaacctcacactggctgatctcctctactgcacgctccttcagcccttctctgtggacacctacctccacctgcactggcgcaccggtgccaccttctgcagggtatttgggctcctcctttttgcctccaattctgtctccatcctgaccctctgcctcatcgcactgggacgctacctcctcattgcccaccctaagc

SEQ ID NO: 12221 - DNA, 1070 bp, Homo sapiens
tgagtcactcctcgggaaggggagaaggggaccaaaacctcctcttacctcagagacagggttggggatggcacatggccaagcatgaccacatgtgcactgctgtatggccccagggcactgccatgccttccaccccattgagctagtgcacacatgaatggggggtgcctcctttccctcgcacggccaagtgttcctcaacatgctggcatgggccccaagtgcacgctgggcctgcagctggggcctgcatgctccaacacactagcccacacctcatcactgccattcccgtctccgcacgctgctgctggctgagctgacactcggtgagtgtgatgccacatctgggggaccccaggaagcctgggttggggacagggtggggagagggctagaaagaagaggcagggcttccccgtgtgcctgtctaactcagtgtccggcctgaggggtgttccttgcgccctgccctgggcactaacaggtctgtccttgcaggcacggccagggtggagctctgtgcacagggctcagcggacctggcacacctggacgacggtccctacgaggcggggggagagaaggagcaggacccccgcctcatcccggtccctgccaacagctactttggtagggacctctccccggcccagaactgctctaaccctctgctcctctctcttgtcctctctctccatgctcccatccttctgtctctgtttctgtctctcaccttgtctctctctgtctttctgtctctggctgtgatctctctggtctctttttctctctccacctcttcttcttccaccattttctggcctttctgtggctctgtctccctactctgtggcccctactctggatgtcccctccctggtgtctcaccccaccccccacagggttgctttttgtgaccaacattgatagctcagaccccgaccagctggtgtataaaactttggaccctgctgaccggctcccaggaccagccggagacttggccctcaatagctacttaggtttgtaagctcccacctcctggactctaggggcatggccca

SEQ ID NO: 12222 - DNA, 1030 bp, Homo sapiens
aggggccaaagaggggctggacttgggctggggccctggagtgtgtggagaatcgagaagtgcagtggtcgtgggctactcctttgtcttcacttagctgagctcccagggggtccctctgccccccagctgccaacacttttttttttttttttttgcttttctctctgcagtggctacactgtggctgtccagaagactggggtggttagggcgtatggcatgaagccaggaaggagtgtgtgtggctggaccagaggtggagggactagagaggatgctgctgggtgctcttgttccactaaggatcgattggtctcttctccaccaagagcggactgggcatatctatgcactcagcttctttcttccacatgggcccctcccctcctccctacttttggcctccagaggagatgtgaacatagaacaaggataacttatctgggtgcttagctatgcactgaccagctgtgacactgggtatctctatgagtccacaaaatgtgtgtgttcagtaaacacattctgacactccctatggggcaagcacaaagatgaaaagacagccccgacactcagagagatggccacttctatgtttggaggctgggggtactgctgacttgcctgaaggttgccatttatttatgcagggctgtatcaccccgtttccttttctgcccagggtaccctcatctccccactctctccttccctttctggggtggtctcagtgttctagagacaggtcagtcactgggtggagtgacaaagtgttggagttaggcccatgtggatttgaattccagcatcactgcttaatgtctttgagtgagttttctcatctgaaagacaagaaaagaatccttatctcataggattgttctgatgattaaatgacataatgcatgtgacttgcctatcctggtgcttggcacatatgtggacagtgatgaatgttagtttcttatatccctggtgtctagcctcggatctgacgtcatagtaggtgctgaataaatatgat

SEQ ID NO: 12223 - DNA, 1258 bp, Homo sapiens
ctatgtgtttagagataaggtaagcagggaataatgggaagggcctgcctcagccgggtctgggaccctggtgcttgaattctgactgcaacagtgctcctccgtactctcaggtgatgtcagagtttaataacaacttccggcagcagatggagaattacccgaaaaacaaccacactgcttcgatcctggacaggatgcaggcagatgtgagtggggttgctgggagcaggggtggtgggaatagagaattctcatctccaaggctgggtgtggtgactcacgcctgtaatctcagcacttttgaaggccgaggtgggcagatcacctgaggtcagaagttcaagactagcctggccaacgtggtgaaaccctgtctctactaaaaatacaaaaattagccaggtgtggtggtgagtgcctgtaatcccacctactcaggagggtgaggcaggagaatcgcttgaacccgggaggcggaggttgcagtgagccgagattgagccaccgctgggcacttgtctgggcaacagagcaagtctctgtctcaaaaaaaaaaaaaaaaaaaaaaaaagaattctcatctccatattgaaggtgaaggttcacttaacaaccttcttctccatatttcttccctcccccagtttaagtgctgtggggctgctaactacacagattgggagaaaatcccttccatgtcgaagaaccgagtccccgactcctgctgcattaatgttactgtgggctgtgggattaatttcaacgagaaggcgatccataaggaggtagggaggagactgtgtatgggacttgggaaacctgggaaatgttttagaatgcaagagacccaggatggaggtggacagggtcagggatggggaggggatctggaaatgctaagggtggggtgaaaggtacaggggcagggaagagactgatggaccaagggagggggttggggtgggaagtttctgatggtgcttttgtcctttgtgcctgccaccttcagggctgtgtggagaagattgggggctggctgaggaaaaatgtgctggtggtagctgcagcagcccttggaattgcttttgtcgaggtaagagataaccctgagcaggggctgggactctgtccagggtgcctggagggaaggggctgaggggaggagggtgctgaacaggaggtactggcctgggagtgtgtgtttggagtctcttgcatgggtctgaggtagctagcccttctgactcctctccac

SEQ ID NO: 12224 - DNA, 1304 bp, Homo sapiens
gtataaggagggatgataagtgagtgagcttgttacacttgaccaggaacagtgcctggcttggttaattcttttggtcgcagagaataacgatgtttcttatttgaatccagtgaaagtactcatgctttgtgttcttgggaattactgagttcaaattcctaatgatgcttgggttacactttgctttgtttctcctagtttctttttatatgatccggagtggcactggtaataagattgaagaaggtgggccgggcacagtggctcacacctgcaatcccagcactttgggaggccggggcaggcggatcacctgaggtcaggagttcgagaccagcctggctaacatggtgaaaccccgtttctactaaaaatacaaacaaacaaacaaacaaacaaaaaacagccaggcgtggtggcatgcgcctgtaatcccagctacttgggaggctgaggcaggagaatcacttgaacccgggaaggagaggttgcagtgagccgagatcacatcattgcacactccagcttgggcaacaagagcgaaactctgttaaaaaaaaaaaaaaaaaagattgaagaaggtgaatgctttcaacacacaacccatgggatgctaattacatcaaattggaccccttttggcagagtaaacagccatggcacacaagcaaggagcagtattctttactgtatttaggataaaattagtaagttttgaaaaatgttctcatgactttatatcttgaagacacaggttgggtttagaaaataaagttagaactccattttgggtagacatagtaatggtactctgctgtaaaaagggaacagacactttagaaaatatctgtggtattcagctgccaattgttgcatctgatcttccttttgcaacttacttcctggctacagtatatatgccatggaaatcattgctaagaacccttaatttaaaatttctagttataggctgggcgtggtggctcatgcctgtaatcacagcactttgggagactgaggcaggcggatcatgaggtcaggagatcgagaccatcctggctaacacggtgtaaacccgtctctactaaaaatacggaaaaaaaaaaaaaaaacctagctgggcgtggtggtgggcgcctgtaagtcccagctactcgggagactgaggcaggagaatggcctgaacccaggaggcggagcttgcagtgagctgagatcacgccactgcactccagcctgggcgacagagcgagactccatctcaaaaaaaaaaaaaaaattctagttataacctgatgact

SEQ ID NO: 12225 - DNA, 1036 bp, Homo sapiens
ggaaactctctgacctcagtttattccatcatctggttcttcatttgtccctgcggaggaacagaacttgtcttttgtctgtaacacaaatacatcatctccctcccttcccagtttcccccacacccacacttcttacttttattatggttccaatcaatgatgtcaattatgtgtgccattcaactgctgttgaacaacttggctataggaatttggaagagcaaagaggcagaatggaatttttctctctcctaactagggcgctagacaatgtattctaaattcaaccagagaagtaggagacaggtgtttctttgctcaacttctctttctactgtcccactattccctaatcctccaacacatactttttacgtagccagtgtatgaggaaaaaattggacaagagacgttagacatataagttgaacattttaagaggaaaggtttggctgggtgtggtggctcacacctgtaataccagcacttagggaggccgaggcaggtggatcatgaggtcaggagatcgagaacatcctggctaacatgatgaaaccctgtctctactaaaaatacaaaaaattagcagcgcatggtggcatgtgcccgtagtcccagctactcgggaggctgaggcaggagaatcgcttgaacccgggaggcagaggttgcagtgagcctagatggtgccactgcactccagcctgggcgacagagcgagactccatctcaaaaaaaaaaataaaaaaaaaaggaaaagtttttaaaatttagagaaacaaggtgaaatttttgatgctatgtcaacattcatggctggtgccttgccctatatttactgtaaactaggtatttgggaaagttatgttagatgtttagacttccctaaaggtgcatggctgagatcattaagctcttgtaccttttaattttatgtatttctctctgatttcattcattgaatttgcacctgaagaacttcaggtaaagaaatttgtagtaagaaaaaactcttttctattttccctggtca

SEQ ID NO: 12226 - DNA, 1184 bp, Homo sapiens
ccatgcctcccaagaggagtagtgtttgggtcagtgccgttggtgaaggacagaacttagcacataggaaaccatttttattatttttttaagacagggtctaactctgtcacccaggctggagtacagtggcgcaatgatagctcactgcagcctcagcctccagggtcaagtgatcctcccacctcagcctcctgagtagctaggactacaggcgtgcgccaccacacccagctaattttagtattttttgtagagatggggtttcaccatgttgcccaggctggtcttgaactcctggactcaagcagtccgccagcctcagcctcccaaagtgctgagattacggccatgagccattgcggctggaaactcatcttggaaaggagtttgaagcctgggcaacatagtgagaccctgtcttctataaaatgtaaaaacaaattagccaggtgcagtgtggcacatgcctgtggtcccagctacttaggagactgaggtgggaggattgcttgagcctaggaactcgagactgcagtgagccatgttcataccactgcacaccagcctgagtgatggagtgagaccccatctccctaaaaaattttaaaaaagaaagaaaagagtgggagatggatagagggaataaagccagctcagttaatctatttgtagtcagaggatattagttttggtaaaaactaagtctgggcttagtactgtagtattaactgctgtgctaatttgagtggattgtttggtatttttcaaacattggcaccctcggaaaggagaaacttcatactttaggacattataggaaatccatctacatgggtatttaaaaaacaaagcaagtctaatcccaggcactaagcagaaaactggaatgtggttgatactcttctccttccccaggaatgtgagggcagtatatgttactgattcttgattactagtagaaggtacaagcattttatatccttattgaccttagtacatcttccttttttatctattagaatagtaccagagtttttctacttccagcccttcatataggtaactgtcctaaagagttgtcttaagtccagtaaaccttgaaggatacttttcccaggtttatgatttttgccactcttctttcctgatggttatgatctgtgttaacacagtgtcacaat

SEQ ID NO: 12227 - DNA, 1036 bp, Homo sapiens
agcataagatgggtatgaaggttctgagagactggtttattttggagttctgatgttcttcttttgatagatatttattctttagatttatgttaaccaccttgtttcatttggttttaggaagaagaaacaaagcccattgagctccctgtcaaagaggaagaaccccctgaaaaaactgttgatgtgtaattatcccttttttataatctgagtacagagcaggcagctcttttcttaatgtatttaatgtttaactttgtttacctcttacatgttcccattggccttttcctttctgattaggtcatttttttgttttttagaagggactacttcaaagtacttggtcccagtgaagtaaagcaaattgtctctgagttatgtaataggtaatgaggaccaggtgacttcaagaccagacatagtttaattctcctagcctttgttgttcttttgtagggtcaccataatagattattctgttactctatagagaatctgtacaattctgtatgcagtgtaaaactgtgtaaactctgttaacttttttttttttgagacaggatctcactctgttgcccagactggagtgcagtggcgtgatcttggctcaccgtaacttctgcttcccaggctcaagcaattctcctgcctcagcctcccgagtagctgggattataggtgtgtgccactactgcccgactgatttttgtatttttagtagagacagggttttaccatgttggccaggctggttttgaactcctgacctcaaatgatccgtctgccttggcgtcccaaagtgctgggattacaggtgtgagccaccgtgcccggcccattctgttaactgttcataagagttttgcacttttctggaaaagtgtaaaactgaggccaggcacggtggcacacacttgtaatcccagcactttgggaggccgaggtgggtggattacgaggtcaggagttcaagaccagcctggccaagatggtgaaaccctgtctcttctaaaaatacaaaaattagttg

SEQ ID NO: 12228 - DNA, 1060 bp, Homo sapiens
agactcttggtagttttttcacacttagatatataaaaaagttaaaaaaatatattaaaaagaagaacattttaaaaagtattttcttttagggtaaattaagatatcttgagtaattgtctgtttgtggtttcacaagtagttttcccattagatgttttggacaaaccaggctgatatagctgaaactgaaaagtgatcctttaaagctcgaaaagtttttttttgtttttgttgctgttaagaaagcttaagggtagtaagggtagggagaggacccttctttagtcacttattagttgaccccaattagtctttctgtgaaactgatgtttttcttactcttggattctaaactctgttagtgggtttttgtgttattctggagttattgttaacttgatgatactgaaatgcatagactatatcagcggtctcttgatctttattgtgatgagttaaaaaaaattgagcaatcatctccactttgtttatatatactgtacttatagaaattgtatacttctggactgttataaaatataacacagaaaaggaatttttgaatgagataaaaaggaactatatatagaagagctaatattttcttcctatttgtcctatttttgaaatccctggagtaagtcaccagctgcccgatgacttacttgcatttatagattgtgttggtttatggagttcctccttccatcaaatctgtatttgtcaggtctatataaaatttgtatttgattggataagtaacttttacgtaaagtcctctgacctgatttcagtgttacagtctaagagaacattaggcactcctgacagcctaaaaaggacttgctctttaatcacatttgcttgtctttgctttttctctagagcacttcttaaccttttggaggtcacagatatctttgaaactctgatgaaaggtatggaccctctccccagaaaaaggcatgtacacatattttgcatgcagtttgaggggcttcataaaactaccttgtagccccgaggagtccatggacctctggttaagaactcatgc

SEQ ID NO: 12229 - DNA, 1049 bp, Homo sapiens
cctttcgcctcccaccatttttcctcagcaacccttacagtctttgcagctcctacctgccagctcagatccccgtccggctatgggcgcggcgccggctaccacacctgaagtctccaggaagtaacgcctctccttctgcccctttcctattggaggaacagaatcagcgctgccaccacccattggttggtggtctgtaatgcagaagcacagttggttgccatttctgtcgttcgcaagatacagtgcccgcccctctcccagttccaccttttgaaagaggtggggcaagctgcctagagaagtgagagcgacgtcagctattgaccaatgggaagagctgatggtatggcgtgggagcaagagtgacaacgattggtcagccttgcatctctacgcctaaggcgggagctcctggaggcggaggccgcgggtgggggcctagtggagtgaggggtaacaagatggcgaccgagacggtggagctccataagctaaaggtaccgtgaatcggggaagggctgagttggacttttctaggaactgaattctacagggtagcttgcgccttctcctacgtcttctccgtgcagccttttccacttcgtttctcggctcccgccgtagctcttttgtgccacccttccacactacgccttccctaatttcccatttctcctcacggctttactgctatatttatttgttatttctgcttccttcatcattgtatcgtccgtcacccttccccactgggttgtgtaagtgccttctacctgttatactcttcgttgcttttcagggctgcattacgtcagttggtccctcctttttgccccatgtcggagccaggatccgtttttcttccctgggatgatgtttccagtctgtcgtccgaagctgagatttccctgttagcaaatggtggcatttttgtgtatttctgtctaaataggtaccagacactcagaaaatacttccactccccttttctaggtgggattacgccccaagccgaattttgaaacagggagaggcctctcaga

SEQ ID NO: 12230 - DNA, 1067 bp, Homo sapiens
cttaactggagactgtaagtcagtatctgttaattgttaatgacatggcaaatgacggctcaagctatttcagtctgtatgactgttacagtcctctttgcttccactccctacagtgtttttgaagattaatatcagttctgcctttatttacttcttttggcagtgtaaaatcatttggttttatttggcacttatcttttctcagtcccttcatttccttactaccaaggaggcagcaaggaatgcttgattacagtattgactgtaatctacattttactgctctctgtaggcttagaactagtataccataatatcttcaaagggttttagatgagaagtctgctttttaacagcttccctatgggcctttctacctggctcttggagctctttctaacccagcatatctcatttcccccatagactcacagcacaataggagagatgctgaggaacttgcgggaagaggtaaactggagcccatagtccatttgctcccagtgtgtcagtagccgagcctttccttggtcaggagtctcaaagggtgtccctttcaccgtatgaaggaagacatacgtagcctgggaacagggaaggtggcagtgtgaggggcagaaagtagtttttcagtcaaagaattatgttaagatcccaaaaggaacacataaatccccaaacaattggtgattttattttgcttttggttgggaaaccctggggtgggtacaagggcgtggtttagtgctcaccaggttatggatgacgttggtcagggtccagacaacaggaatgctgaagaaggggatgctgagtagaaccatatgcagcaatcctaccaagatgatgtaggccagccagatgcctcggctattcatcactcgggtgttggggtttacttcgctgtgtgccacccccacattcatcctagccgtaatgggggatcaggcaggagtccagctcagttttttctcaacccctcttgagctatctcccagttgtctctcagatagccccaatcccctgaactctattgggaatgaagaacttacccatcacgcaga

SEQ ID NO: 12231 - DNA, 1077 bp, Homo sapiens
tagccaggtgtggtgatgcgctgtagtcccagctactcggcaggctgaggcaggaaaatcactttaaccggggaggcggagattgcagtgagccgggatcgggctactgcactccagcctgagagacagagtgagattccgtctcaaaaaaaattttatatatatatatatatatatatatatatatatatgtataaaaccaagccgtacctcaagcacctagggcacatgttctcaggacctcctaaggtcagtgtcagaggccatggtcacttatatttggctcagaatctctaaaaatattttacagagtttgactcttttcatcaacacaggtcaccctcctgagtagctggtagcacaggtacatgccactaaccatacacagctaatttttgtatagttcgtaaagacaggggtctccctatgttgctcaggctggtcttgaatgcctgggctcaagggatcctcccatcttggcctcccaaagtgctgggattacagccatgagccactgtgcctgacctttcgctatttattgataatgcttatcatattcatatgattatctcttcctctcttttttgtttttattttttccgatagtaactgtttatggtaaattgtggacattgagattactaaaataaaaagtgtactgaattatctttgatttcttatcctcttactccttccctagttagtgaattaccaaatgttgattctttgataatgtatctgcccttagtctcttacgttccagtgcccctgtttcagccaattctgtcccttcatgccaggattatcacaatattttttccctaactagtttccatgtctctggtgttttttttttttttccaagtcacccttttattatgctagattaaatactctgaaacactgctttgtataaaggattcattcatttattcaaagccctaagacaatacttcgcataaaggattaattcatttgacaaatatttgttgagtgcatgccatgtgccagatattaaaatctttaactggtattcaaggtctgaacattccagcccttgtctctggctcagcctga

SEQ ID NO: 12232 - DNA, 1022 bp, Homo sapiens
tttcagtgtaagagtttttattgctgacagacttaaggaaatagattgagaattaaaaaacggcagatgtgagaaaatgacaaagcttaaaaagattcttacagtagcagtccccaatctctagtttttgactctctgcaagatattatctgaaagtcctgatattttgcccttggtttttatttctaggggtgggaaccgccaaacctctcccttctttttgacttcacccttggataccatcaaggccagaggatggaaccaagataacataaaataggtgctcctttgtgataatgggctatttgtatctctgagggcttccacacaggatggccattcaagaagcttctgctctgcctttcattacagtctatctttagtcctcctaaaccttcagctataatctctatgcaatcaacttaaatatatgtttgtagtattgtccctttctcccaaattccatgtaaaacacttgcctgaattgaattgtttccacaaagttgttttcccctgtggactttgtttatatcagtagtttttattttcccaattttccaaattcaagagtgataattataaatagttgtgttcttgtttgttatctttctcactagaatgtatactctaagaaggcaagaaccttgcttgctttattcattgttgtattcctagcttctgttacagtgtctggcacaagagtaagtgctcaataaaaatttaaaatccacgtgtgaataaatgtgattaccatgtgccctaccgtatattgagaaaaataagaatacatgtgaaaagcacgagattaaatccactgtgtcactgttttgattatttcctctctaattcacatcttggtaagtctttggatcctgttgatttaatcttcacaatgaatttctccttcattttcctttcattacctgtagaaaccatcgaagtcaagtcttttcacattgcagctgttgttttcattttctctacctttagtttatggtacacatttttcagtttaatcttaa

SEQ ID NO: 12233 - DNA, 1082 bp, Homo sapiens
tctttatggctgtgacagactactttttatttaattaattaatttttttttgttttgagatggagtcttgctcttgttgcccaggctggagtgcaatggtgcgaccttggctccctgcaacctctgcctcctgggttcaagtgatctcttgcctcagcctcccaagtagctgagattataggcacccaccaccacgcccggctaattttttttatttttagtagagacgggctttcaccatgttggccaggctggtctcgagctcctgacctcaggtgatccacccgtcttggtctcccaaagtgctgggattgcaggcatggtgagccactgcgcccagctgacaaactactttttaaatttttttttatttttgagacagagtttcactctgttgcccaggctggagtacagtggtgtgattgcagtttactgctggcttgacctcctgggttcaagtgatcctcccagcttagcctcccaagtagctgggattacaggtgtgcgccaccatgcccagctaatttttgtagagaagaggtttcaccatgttgcccaggctggtcttgaactcctggatgcaagcgatctgcctgcctcagcctcccaaagtgttgggattagaggcatgaaccaccacgcccaacctcagactactttctttttttctttttttgagaccgacttttgctgttgttgcccaggctgtggagtgcaatggcctgacctcggctcaccgcaacatccacctcccgggttcaagtgattcttctgcctcagcctcccgagtagctgggattacagacatgtgccccacacctggctaatttttgtatttttagtagagacggggctttctccatgttggtcaggctggtcttgaactcctgacctcaggtgatccgcccgcctctgcctcccaaagtactgggattacaggcgtgagtcaccgtgcctggctgactacttttaaatgtagtattatcacatgctatgtttttgcccataccctctagtgaaactgggctgtatggctgatgtggaacagcagtgcgatggtgtgtaagctttggcatcagact

SEQ ID NO: 12234 - DNA, 1071 bp, Homo sapiens
gctttgtcaccaggctggagtgcagtggtgcgatctctgctcactacaatctccacctcctgggctcaagtgattctcctgcctcagcctcccgagtagctggaattacaggcatgcacccccactcccaggtaatttttgtatttttagtagagatggtgttttaccatgttgtctaggctggtcttgaactcctggcctcaaaggatcgcccaccttggcctcccagaatgctagaattacaggcatgagccaccgtgctcggcctgattttttaaattatctgtaagatgaggtcttgctatgtttcccaggcaggtctccaactcctgggttcaagtgatcctctcaccttggcctcctgaagtgttgggattataggcatgagcaactagtttttcttttccttttttttttttaaagagacaaggtcttgctctgttgcccaggttagtgtacagtggcacagtcatagcttgctgtagtcttaactgttggggtcaagcaattctcctgcctcctcctcctgagtagctggtactagtactacaggcatgcgccaccatggctggctaatttttgaatttttttatagagctatgttgcccaggctgttctcaaactcattttcacaagcagtgctcccaccatggccttccaaagtggtgggattacaggcatgagccactgcacccagcctagtttttcttttttctttttcttttttttttgagacggagtcttgctctgtctccagtcacccagactggagtgcagtgacgcgatctctgctctgccaactgggctcaagctattctgcctcagcctcccaaatagatgagattacaggcacgcaccactatgcccagctatttttttgtatttttagttagagatggggtttcaccgtgttggccaggctggtctcgaactcctgacctcaggtgatctgcctgccttggcctcccaaagtgctgggattatagacgtgagccaccatgcctggcccccagcctagtttttctaagcacatatgcatatataacattaaggtaaaatgacatattttga

SEQ ID NO: 12235 - DNA, 1080 bp, Homo sapiens
cagtcccgttttcattatttttctcgaagctttatttgctgaagacctcctcgtttctacatagtaccttttcctctcccgtatcttcatttgttgggtcactgaggtttagaggtgtgaagggaagaggaccctaatacaactttcagcttgagttttctccctgatggagccacccttcgctaccttctcccgtgatggtgatagaaattgaggggtctaaggtgggaaaaggcaaacaggaaagtatctagtggcttttctccgaagccctttgacaagtgaataaaacccactattccttctggctagagaagaatttgcagcctggctggccgagatgctgaagtgtctgctgtgtatgtaaggtgtatgtgttggaaacggagaatcacagcttttatcatggttttgtcccttcctaatggcctcatctttaggaaaatatgcatagtagtaatagctactcaatgatgatcaaataatatatgtaaaagcaatttataaaatactgtgcaagtgcaaagtgtttctgtttttgtagccctcatatgtgtagtctgtagtctgtagaagcaacagtgtgcctgtgccttggtacacacggtgttttaaaatgtgccattttgcttcttgctctgctgctttccatgttccttacacctcagcccacctattttatggtatctgatgacaacccaggttgctgctacttctccccaacctcacaatttaaagtggtactacctctttccttctgttctctacccagtagctccttcatgaattaccaacttttaatgtgtgttttgaaaatactacttatccagtatacttctctttactcttaatcattttctttaccctgactccgtgaaaatccaggtatcacatcttaccttaccttgtcactaaaagctgttttctgttttccgtgactatgtggaagagaaaaaggaataaactgcttttttgttttcctttactatgtccagatcattgatctaccactgtcactctaatcctcatggaaggtattgccatgcaattatagcagtttctgtaaaactttagtgtcat

SEQ ID NO: 12236 - DNA, 1124 bp, Homo sapiens
ccctaaaggaagggctggtgaaaggtgtttatacaaggttctattaaccacttctaagggtacacctccctccaaactactgcattttctatggattaaaaaaaaaaaaaaaaagtagattttaaaaagccacattggagctcccttctacccactaaaaaataaccaatttttacattttttgagggggagtgagttttaggaaaggggaattaagattccagggagagctctggggatagaacagggcgcagattccatctctccccaagcccctttttagtgactaagtcaaggccccaactcccctcccccaccctacgctgagcttattcgagttcattcgtactaataatccctcctgcggcttcctcattgttgctgttttaggccaccccagctcagccaatgattcctttccctctgaatgtcagttttgtttttaaaagtcacttgcttagttgatgtcagcgtatgtgtatttggtggggaaaacctaatttcggggatttctgtggtaggtaataggagaagaaagggcactgggggctgttctccttccttccctgggctgtatccatggactcctggaaggcacagagaagggagctataagaggatgtgaagttttaaaacctgaaattgttttttaaagcacttaagcacctccatattatgacttggtgggtcaccccttagcttcctccctctcccaccaagactatgagaacttcagctgatagctgggggctccccagatgaggatgcagggatttgggagcagtggaagagggtgcccaaccttgggttggaccaacccttggctcgcagctcaactctgcttcccgcattcctgctccacgtgtcccagcttctcccctgtgacgggaaggcaggtgtgactccaggctctgcactggttcttcttggttcctcccaccaggccctttgttcctcatgtccccatgtttctctccctctgcgtcttagcacctttcttctgttcaaagttttctgtaaattttctctttttttctttctttcttttttttttttttataaattaatttgctttcagttccatcttgtgggtgcattctgtgttcttacctgtggctgtcagg

SEQ ID NO: 12237 - DNA, 1050 bp, Homo sapiens
agactgtcccaaaaaaaaaaaaagaaaaaagaaaaaagacacggtggctcacgcctataatcccagcacaaaaaagtcaagccctttcaccatgggttgtgaccacagcaaatttgttcttatacctgccagcatccaccctacctttcttctgtattgtcttcagttgggtcctcccactgatgtgctgtctcgcccctccttccctagcacttggctgctgttgaggaaaggaagatcaaatctttggtggccctgctggtggagacccagatgaaaaagttggagatcaaacttcggcactttgaggagctggagactatcatggaccgggagcgagaagcagtgagtagcaggagccctggaaccctgctgcgctgtgcctcagtttaaaatcggaggggcgtgtgtgtgtgtgtgtgtgtgtgtgtgtgtgtgtgtgtgtgtgtgtgtttcagtgaaagagagataagcaacagtggggaaagcctgagtgtgtgtgtgtgtgtgtgtgtttcagtgaaagataagcaacagtggggaaagcctgagacagacagggcttcaaagcagagcagggcaggaacagggcaggagtagggcagccagttagagacagttaagtggtctcacaagtgaagtctggggactgaagtcccacagaaggtcagctccatgaggcagggactctagttggttgttttgattgctgcatctccaggtccttgaacagtgcttggcccatagtagactcaaatagtgattgagtgaatgggcgtaacggatgatgagagagagggtaagagcctcagatccaggaggtgaacttggaaagggaatgggaccgacacagtgttgaaccattttgtctttggaggacataaaaagaaatagacaatagggactgggcacagtggcccacatttgtaatcctagtactttggtacactgaggcagatggatcacttgagcccaggagttcaagaccagcctgggtaacatagtgagatctctgtctcaacaatttattttatttatttatttatttat

SEQ ID NO: 12238 - DNA, 1035 bp, Homo sapiens
gatgttctccccaagcttctaacttcagcaatttcgagctcttttccttctttgccttctaggcttttcctccctttggggcccccatcccttcaccaatgccttcttctgaaaccattctggcttttcttgcagtgttcatgccattgagcggagggctctccccgagttcttcaacggcaagaacaagtccaagactccagagatgtaaggaaatctcatctcatgattctccttctccctcctgtccccacattcacccttcctgatccagtaacattcagtttagcaaacatttcttgagcatcttccatgagccaggcactatgctaggcttacaaaggcacaatatctgcctttaggcagccctggcctagcatgtagacacatgttctttaggatttgcccaagggtgatattaagcatgttctatacataacaagtacctactccagtgcctcaacttctttttaacagggtatagagcctttaaatccatattactgatatcgtctatactgcagatattcctagcacaaaagttttgattaaagtgtaaattactattaccaggctggttcctgagagtaggttttaatagaaaaacaagagaaggaactaatagaagaccagtttatataaattaagggatggagagggctcactgggaaagaagtgtaggagccacggtggctcacgactgtaaatcatcccagctacttgggacactgagacagaaggattccttgaggccaggagttcaagaatagcatgagcaacatagcaagactcccatctctaaagaagtgaaaaaaaattagctgggcctggtggggcatacctgtggtcccagctacttcggaagctgaaatgggaagattgcttgagcccaggagtttgaggctgcagtgagccatgatcacaccactgctctccagcctggctgacacggcaagaccccgtatctaaaaaaattaatgaacaaggctgggtgtggtggctcacgcctgtaatcccagcactttgggaggccga

SEQ ID NO: 12239 - DNA, 1303 bp, Homo sapiens
cactttggagacattgctccaccaatactggtttacagtctgtattctgtagactcaccccaggtattccagaagtgtatttcaggggtaggattagggctgccaccaagaagagttctggcttctacctcctcatcaatcagctctctctcttctctatgtttgctcctgagcatatgtatatgaattcagttgaggaaagtatcctctgctttcaaaaatgtttaacacttaaccattcttccacagagtgatttggtcagattcagtatcagaccattaaaagcttacagatacatagatggagataaaggcctgtcaaagacaagaatcatttatgaatgtacatagagaaataagttaaattaatttttggttggagaagtggggaaagtagcaagaagtttgaagccctagaataattgtgactggagagaattactatattttgcaatcaggtggagacaatttttggagaaagtaggatgtctggaactattaaattgaaggcttgaattaggcaaaatctgtctgataaaatgactctctgttttcgcagtcaacacaaagaaagactcagagtcggccccagtcaaaggcggcaccatgaccgacctgggtaagacaggagcctcttgggcacggcagtcagagccaagggaaggggagggctcagctgcccccttttcgctagcctgatgggcttttggtagggctttcttgcccctcaggaggctccagccttacatcttggtttttctctttcagatgaacaggaagatgaaagcatggagacgacgggcaaggtggagccagtttagagaggccctacctctctatgtgattctgatttgtgattataaagttcattctgcccaaacttttcactgcccagactttacccactgtagactaattccagctttgttcaaaactctgaccctttcagagtcctggggcccatgactgctcagtcccatcacccatctttagtgtccacattcctggggtgtgggagaagcagagggttgctagggaggaagcaggaatgctgagtgtccagcagcctccatactcgtaggatgaggatgagaacagtacggggaacaagggagagcagaccaagaatccagacctgcatgaggacaatgtgactgaacagacccaccacatcatcattcccagctacgctgcctggtttgactacaataggtatggttgtccccaacttctcactgagtccttatttccctgcctccaggggtcaacaggctgttcttctccctgcctcctccaaataagt

SEQ ID NO: 12240 - DNA, 1576 bp, Homo sapiens
ttacgtaagggtgattctttttgttctctatttttgaaatgtttcgtaatgtgcttttactactttataatgaatagaatacaaaaaaaataagccaagaacccaatactttctgtaaatggaaagggtaaaagatctgcactttacttttccacaattctatcccattgattctactgtgtgctcaatttcccatggcagttacgacacgtggatcccagcgagtgaaattgaggcatctgtggaagatgctccaactcctgagaaacctaggaaggtgagcttttcttgtatcccctcttccccaaaaagaatgccaggaacagtctaccctttggaagtgaaacagaggcttgtatgcccttgagctttttctgttaagggtccccagacagagctgtggcttccaggcttctctgcagcatgatctgcctttgtactttaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgacaaatcctgttctttttttcctggcgcccttagcataagtctcagaacaaatcttcagtggggattgtaggctgacatttgtcctgattctccatcctataggtgaacagcccagattcagatcgacgggacaagaaggggggaaactataagaagaggaagcgctccccctctccttcaccaaccccagaagcaaagaagaaaaatgctaagaaagggtgtgccagcccctagcctgcccccgtgttcaccattctctccacatcatgttgaaggaaggaaagacaaatcccttcctataaccacctggccctgacctgggtgtgccataatactgcaggtgtcctgagagggaagatgaggagatctttagctgctcagttgttagttctggttctggccccactagtacatttaaagagagctttatcaagtgaaaagcctttgccacttcccattactgtgtgattactggtttctgtttgtactcagctctacccttggaattctctgtcacttcccttcccttgaacttcaacttccagggactccttgtccaaggatgactgggttctctttcactctctttccttcccagtccctcaacaccttacactaagtcaaagcgtggccacagagaagaggagcaagaagacctgacaaaggacatggacgagccctcaccagtccccaatgtagaagaggtgacacttcccaaaacaggtacaggccaggctgagctcctgggatccacccccactccccgtcttgactctcctttgccaaaccccaagtgagctgatttctcaggtccacctcccagtctacaggatcttttccttaaatttagctggttattggaattacggtcattaccctggaaaatcctctaactgtatattcatatctgagttgtggactgtgctttgtgcctgatagtagttgtctccaaactctttgattatgtgtttctgacagtaaaatatatttgagca

SEQ ID NO: 12241 - DNA, 1027 bp, Homo sapiens
gccggacaggcgcctgtcctcccagctactcaggaggctgaggcaggagaatggtgtgaacctgggaggcggagcttgcagtgagctgagatcacgccactgcactccagcctgggcaacagagcaagactccgtctcaaaaaaaaaaaaaaaaaaaccagtcttcataagtatttgctgctacctttccctgtcataagaaaaaggatagccagacatggtgggacgccactatgatcccagctccttggaaggctaaggcacaagaatcgcttgaacctgggaggtggaggttgcagtgagctgagatcatgccactgcactccagcctggtgacagagcaagagcctgtctcaaaaaaaaaaaagaaaagaaaagaaaaagggatatcttttcctcctcccagaagtttgttttaaatttgagcatttatcatgcacctgatgtaaacctaatagtactcttgatactctagtggcttgaaaaaaaaaaaaaaggcatttctgtgctgagtctgcgcttctatgcacacaaggtatgtttataaaatactgataagcatgtcacagtatagagcataagaggcaatgtatgtatcctagtgacattagcagtgcttttccccccttaaactcctttaaaattacttttagaacttgctgctcattcttgtgaatgttatgaatggtgtcatattgtccttttacagaagatacgatttttagaaacaaatattcattgaatgtctgccctgtgagatactcactagagtgaacatgaggaggcttatgtagcaaaatggcacctacctgcaaagaacttagtccctaatggagatgaatatataataagggatcataaatgtgctaagtggatttactagtaatatgtgagccaaggacgataaagctcctgattctgatgggtatcaggaaaggcttttcaggaagtgttacttgttataggtcagaggtcagcaaactacaggttacaaccccactgcctgcttttgtaaaaaactttattg

SEQ ID NO: 12242 - DNA, 1101 bp, Homo sapiens
aatgcaaaacacttgaagcagcaactactgtacctgggccccaatcctgcactctcccctggctcctcatatgcaaatcaagggctggttctgcccccacagcctgccccctccccattccctcccactcctagcctggcccctaaccacgcactttaaccttgcttctttcttttatcttcttttgggagggcagagcctgtggtcattcctgccctggctctccttcccttgaactttgaggcttgtcatgaatttttaagtaagcgttttatcctttaggggaagaaacaaattaatttcctgcccatttcaaaaccacagccctagtatgtccactgtgtttcaggcatgtgtttgcatgtatatggagggagggaccatgttcttcctcctgtgccgccaagcccatagtttatctgtgctccctatctgcctccaccttccgttatgtccaagagtacccactgccccagtcactcctgatctgaagccaaagatggtaggaggggcagggccgacaagggaccgtggctactcgggacccaggcttcccctccagtgtgaggaagaagctctgacctagagagagatgaataggtactggggcttggtccctgccttcccagcagggaggaaagatgggattgagctgggggctgcactgataagatttctaaagtcgcaccccaaaagccaaactgggctggagtgaagagggggcagttttctctctaaatgtagcattgaatttggccctggtccctttaagtgctctgtccacccatctcctagtgcagcctcctggacagttggacccactcctgcagcccagtgttcccttcctcacactcaatacctcagccaggggccaagacacagaacttgaatagaggtcatgccccctccgcccccacactgcatccttgcccagtttggctgccatcagtattgtcccctgagaactggacaggcttcgtttacacagtacagggtctcccctgaggggggatccttcagcctccctcccctactcaagtttgctttattcacagtcttacccatcttttagttgtataccctgaatgtcttgccaccctt

SEQ ID NO: 12243 - DNA, 1052 bp, Homo sapiens
aggacggtgagtgatggaagacttgggaagaatcccagttgcctctggcttcccctttctgcttgggcagtatactcttccctattttaatctaccctgatccctgccttacaggaccccccttcacgccgctgccttcgcggacaatgtctctgggctccggatgctgctgcagcatcaagctgaggtgaacgccactgaccacactggccgcactgcgctcatgacggcggctgagaacgggcagaccgctgctgtgggtgtgtaggggccacttgtggaagggaggagctcccctggggcatttgcaggatgggtcagccctgcctgtggaggctggctggggctggggttcagaaagcaagagggttgtctttggatgtctcgccatctgcagacgggatgcaaagtggagagccaggatggctactgctctggagggaggggtcagtccctctatcacatttctctcgtagaatttctgctgtatcgagggaaggcagaccttactgtgttggatgagaacaagaacacggccctccacttggcttgtagcaaggtacttacctgaagtgattgggggactgcataaggggcagagcttgatgaagagaggtaagtctcggttgcagaggggactggggcagaagtgaggattgtccagcctatccgactggttgggcagctgtttgtcctcctgttactctccccaactcctgccctgcaccctgccacatttctacttcacaagtctccactctctgttcccctccctcagggccatgagaaatgtgccctcatgatcctggcagaaacccaagaccttggccttatcaatgctaccaacagtgcgctgcagatgtgagtgcctggggaagggggctcctggctgggggaggccagtgggtgatgaaagagtggccgctgttcagaggctctctggagcccattgtatttgttcagcacccttgccaccctgtctggaggtggaagggcagcttagcatcaagctccttctttttccttttttccaaggccactccacattgctg

SEQ ID NO: 12244 - DNA, 2038 bp, Homo sapiens
gcacatttgcaaagacttacaagagtttaagaaccggccgggcacggcggctcacgcctgtaatcccagcactttgggaggcgaaggcgggtggatcatgagatcaggagatcgagatcatcctggctaacatggtgaaaccctgtctctactaaaaatacaaaaaattagccgggtgtggtggcggccgcctgtagtcccagctactcgggagactgaggcaggagaatggcgtgaacccgggaggcggagcttgcaatgagccgaaatcatgccactgaactccagcctgggtaacagagcgagactgtctcaaaaaaaaaaaaaaaaagagtttaagaaccaccagatcacctgaagagactctcttgtttcccttaaagttccaaatctctccagtatctcctccttagtgcctgcttctgctgttccctcgagtcctccaggttgttttgctcatggaaaaaggcattaggctgcctcagccttttcaggagatgaggcctctgctcttaggtaggttgagggcacgaatctagctctgaacaggtgtctttcatatcctgatgcagacggtgaacctgctcctcaacaagggagccagcctgaatgtctgtgacaaaaaggagcggcagcctctgcattgggcagcttttctaggtgagagagaatacacgggaaaatcagaaatttgacatttaggattcctagggcagggatgtggggttgcagcctttgaagagaggagtgtagggtcttagagtttaccttctacttcctttagagtgtcttctcttttctcagggcacttggaggtcctaaaactgctggtggcacggggagcagacctcggctgcaaggaccgcaagggctatgggctgctccatacagctgctgccagtggccagattgaagtggtgaagtacctgcttcggatgggagcggaggtcagggctttgagctctggggttgggaactatgggcagcaagtaggagattatagtctgttacggagatatgaggtattgggatgttggtatagttttgggaagttggaaggacgtggtagagagggtctgaataatgcttaccttagccatagtgcccttagtaccttagtaccttgggtcataaacccgagaggaaatgaggcagtcgttggatttctgggatctggaggctacatgtgctggcttctactttgtttaaactgataccaccttactctcacccctgaatatccagatcgatgaacccaatgcttttggaaacacagctttgcacatcgcctgctacctgggccaggatgctgtggctattgagctggtgaatgccggagccaatgtcaaccagccgaatgacaagggcttcacgccactgcatgtggctgcagtctccaccaatggcgctctctgcttggagctactggttaataatggggctgacgtcaactaccaggtgcctgaagggataaggcttagaccagtggggagcgaaacttggatctaggggtcctgactgtatctggatagctctcttggggaattatccacttgcttcctagggtaatcagaccttgccagggactcaggaaagagtgggctaagaaggtgccatatgacccttttgtccttagagatatgtccttggaagggaggtagggcattctctgtgctttgcactggaaaaaaaaacaaaaacaaaaacccaccatgtttccacagagcaaagaagggaaaagtcctctgcacatggctgcaatccatggccgtttcacacgctcccagatcctcatccagaatggtatggacctgggagactttgtgctctcatcccctcctcccccaaggaactcatttctagaatctagggaggttcctaacttccttctcctgccctcttccagtaggataggcccttggaactctgaccaagggacctgtggaaatggccctgctctgccctgcccagtctcctaaggcctagaaacaggataaaatatgtagaatcctgggcctggcacctgatgcatacatag

SEQ ID NO: 12245 - DNA, 1028 bp, Homo sapiens
tacagatgtgtgccaccatgcccagctaatttttgtatttttagcagagacggggtttcaccatgttggccaggatggtcttgatctcttgacctcatgatccacccgccttggcctcccaaagtgctaggattataggcgtgagccactgtgcctggccaagattaggatgtcttttacaagagtttaggtataactgactggctataggctggcatgagcccataactaggctagtaagtggcaaataagagaacagcaaagtttccataatctgccccttctttcttcccttggctctcccttcttacttccccacagtgaccatgagggtggcaatgtaagtgcccataccagccatttggtgggcagtgccctttccgacccttacctgtcctttgcagcagccatgaacgggctggcagggcctctccatggactggcaaatcaggtaagactattctttttattttcctgctacatgttttccttaccccatgctttgtttctgatcttggcattctcttctggcatatgtattaacattccctttttccccaaaccttacccataggaagtgcttgtctggctaacacagctgcagaaggaagttggcaaagatgtgtcagatgagaagttacgagactacatctggaacacactcaactcaggacgggtaagcagagatgcttaacgactaggaaagaaaccaagacacaagttctgcaatttggaagaattaagaaaagaatgaaagaggtccctaaattagagatttttttttcttcatttatctaccttgaagaatttagaaaagaatttctaggtgggcacaatggcatgcacctgtagtcccacctacttgggaggctgaggcaagaggattgcttgaggccaggagtttaaggctgcagtgtgctaagatcactcctgtgaatagccactacactccagccaggacaacacagcaagaccccattctctaaaaaacagttttaaataggttgagtgtggtggctcacgcttat

SEQ ID NO: 12246 - DNA, 1056 bp, Homo sapiens
acaggagaatgtaccattttcttttgttccttatttggagataggtagtataggaacagaaaattttctttttacaaagcaggtacattaaatgatttttggccaggaggtgccagccaccaggaaggccctaaagagttcactgtggtgcaagacacagaagagcatgacccactgctctgatgcaaccaccttgggtccttggcaaatctagattgatttagttggtcaatattaatttggcaccaactgtgtgtagagaattgtgtttgcagttgaggaagacagagagcatttaaaattgatattaacttggttggcattggggagttggtatcagaatgatgcaaaatatacacattcacaccacataaagcatttatttataaaggcttatttataaacactttaggtggtatgaatgtgtatatttgtacctgcacacattagcaggtacaaaaggtcatataatcttaatattttgtttttcattttatttatttatttatttttttgagatggagtctcgctgtgtcacccaggctggagtgaaatggcatgtgaaccaccgtgcccagccatttttatttttatttttttagaaataggtctctctctaatcacccaggccaggatgcagtggcatgatcatagctcactgtaaccttgaactcctggactcaagtgatcctcctgcctcagcctcccaagtaacaaggactacaggcacatgccaccatgtctagctggcattacaggcgcacaccaccactcctggctaatttttttgttttttttttttgttttttttgggagacggtgtcttgcactgtcacccaggttggagtgcaatggcacgatctcagctcactgcaacctccacctcctgggttcacacaattctcctgcctcagcctcccgagtagttaggattacaggcgcacaccaccacacccagctaactttttgtatttttagtagagacagggtttcactatgttggccaggctggtctcgaacctctgacctcgtgatctgcccacctcggcctcccaa

SEQ ID NO: 12247 - DNA, 1025 bp, Homo sapiens
cttttaatttttatattttttcatcttaccacatttgagggctacagcccacctctatcaataatagctgactcactagaggagttcttgtaaggggtggcaacaaatgagctcttagtgattgtgggggaaaaacctcttcgtgattgtgataacgccacctccaccctatagagaatactggctgtcagacattgtgagccaggcccttgtctttggaagtagccctctccatctctccccatgaaggagctgacctattgagtgagatgactgcctgattctcctgagagctgctgttccagtaaggtgactctacaggtggcatgcatccagaagccaaaagcccaactgtcacacctccaggattaggggagaatctgggaggtagaagttcagggatgattcagaggtttgtaatctacctgtctcatcaatgaacataacctgaatgtactgttcagagccattcagcagctttctttggcagccacggggtagaggaaatgaaatgtagcctttgatgttacagtcctcaagcacctcctgtctagagtcatttgctctgctggtggccatcagggttagttaaatttgtttcctctccctgagatgcctcccttcttggtcaagaagcccttaaaaagaaaactggtatcttttccttgatgcctgttaaaaaaaaaaaagaaagaaagaaagaaagaaaattgggactttattttgtattccacagctggaaggaattatccattcacctctgcctcaggcttgactgcctctttcctgggatccaactcccaggaagttctgacacttgatggtaggtgataggccaacacatttgtaagaaacaaatatttactgaattcagctatgcacaaagcactgttctagatgcttttatgaaaattattttatttagtttacttaactactctgaaattggcttttattattaccattttagaaatgtaaaaactgagacttagaaattaggttacatagccaagataacacagtgg

SEQ ID NO: 12248 - DNA, 1062 bp, Homo sapiens
gtgcagtggcgtaatctccgctcactgtaacctctgcctcccaggctcaagcgattctcgtgactcagcctcctgagtagctggggttagcaggtgtgcaccaccacgcccagctaattttttgtatttttggtagagacggggtttcaccatattggccagactggcgaatttttttaaccttactaggagacaacatgtgaattagtcattgttctattgttctactctcactgtcacataatttaaatgtcacataatttaaaacacctgagttagaagctaattcagagagctttgagattatttgacttcttgtttatccaaattcattaatgctaagcaatggccttagtattatctgtgggtgactcagttttgtgacatcaaaaatgtcttttcacagatgatctgggtttggatttgggctaggaattgaagtagggctgcagttcacttctggacttttgaagtcaacatgcttaaccaaccctagctaaagggaactgtctcttgagccactgaaaattgcttctccaagctagtatgtttgaaactgagtaaatcaattcaaagatgtttctagattacttctagactttttcaagacacttaaatgcaaaggaaccaatggtttctttacattggacttataccactgtacaacatcacctgtataagtcctactcagaaattgggttcaacaaaaccgagttggttttgtcctgcaaaatatttagttaggttttaaagcccaaattttttaaaggtaagggctcatatctctgtgccctcactttgactatcagcctacccaaagtaacggtgattccttgatactagaatggcaggggaagccttatggggtgttagtggtgagatgactgcatttggtcttcccagtggcctttaggttggtagcaggtgaatgaatgcatggggaggcagcaagaatagtatggtaggtagcagcgatagagttggcattcctgacttaaaatccaaggggcagcagaagggaaaccagacttggtggatttcaataaagccacacaatgattc

SEQ ID NO: 12249 - DNA, 1042 bp, Homo sapiens
gccctgtgtcacccatttctcccttgggttggcagtgtgagagcattgtggaggaatacgaggatgaactcattgaattcttttcccgagaggctgacaatgttaaagacaaactttgcagtaagcgaacaggtaagctgcccccactttatctcctgttctagtagctctgtggaacctgacattccctaactcacccatacacccccatcccagaaacctctggtattaggtcaagagctgtcttccatttcccttggcttagggacttggggtgttcctccacattttctgtcagctttcagaatttgtgtccccttgaccctgagatacaggtgagaggacagtggggatgttttatcatttataagcatatattctgcagaatggtggttggtgtgtgtttgtgtcagcttggtctgggaaattttcttgatactggcagatatcagtatgagaatggcatattcctttaaattgtttgccatttgcagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtacaaactgtgttgtcttttcatgcctggaattgcccttacattaagcttgaagataaggagttatatagacaggaaagataatggaggagaaagaagagttttgggattgatacaggataaaggtaggagaggcctgaacctttaattcttctaccttctgagattccactccactcataaactagataagctttcagtcagtgcccactcaataccacgtctttagagtctaattgtggagaatagaggaacctccatgaggaagcaggggaacatagtgtatggtagtgtagaattctagaaatcccttgtgttcatggctgttgaaacataaagtaagacagggcttggtcttgaaggaaataacggatatgcattattctt

SEQ ID NO: 12250 - DNA, 1980 bp, Homo sapiens
aacacacatgtacacaaaggtgtatctaataagcaatatataaggcagtgttaagattacagtgctagcctgggcatcatggcaaaacaccaactctacaaaaaaatgcaaaagttagcagtgcatggtggcatgtgcctgtagtgacagctgcttggaaggctgaggtgggaggatcacttgagcccaggaggtcgaggctgcagtaagccgtgattgtgccactgcactccagcctgggaaacacagcaagaccctgtctcaaaaaaaaaccaaaacccagcactttgggaggccaaggcaggcggatcacctgaggttagaagttcgagaccagcctggccaacatggtgaaactccgtctctactaaaaatacaaaaaagtagccaggcgtggtggctcatgcctatagtcccagctactcaggaggctgaggcaggagaatcacttgaacccaggaggcagaggttgcagtgagccaagatcgcaccactgcactccagtctggttgacaagaacaaaactctgtcttgaaaaaaaaaaaaggccgggcgcggtggctcacgcccgtaatgccagcactttgggaggctgaggtgggcagatcacaaggtcaggagatcgaaaccatcctggctaacatggtgaaaccccgtctctactaaaaatacaaaaaattagccgggcgtggtggtgggtgcctgtagtcccagctactcaggaggctgagacgaaaagaatggcgtgaactcgggaggcagagcttgcagtgagctgagatggtgccactgcactctagcctgggcgacacagcgagactcctctcaaaaaaaaaaaaagaaaagaaaaaagattatggtactttaatagctgttgttcacagagcctacactacatctttaatactgtgcttactgaggatattagtctcaatttaaacaaaattattattatttttttgagatggagtttagggcttgttgcccaggctggagtgcaatgacacgatctcggctcaccgcaacctctgcctcccgggttcaagcgattctcctgcctcagcctcccgagtagctgggattacaggcatgcaccaccacacctggataattttgtatttttagtagagacagggtttctccatgttggtcaggatggtctcgaactcctgacctcaagtgagccaccctcctcggcctctcaaagtgctgggattacaggcgtgagccaccacgcccggccaaaaataaaatattaatgaacacatggacacagggaggggaacgtcacacatcaggtcctgttggggtgttgggggctaggggagggatagcattaggagaaatacctaatgtagatgacaggttgatgggtgtagcaaaccaccatggcacatgtatacctatgcaacaaacctgcacgttctgcacatgtatctcagaacttaaactataatttaaaaaaaaattatcttcatctatagaaattagaagtataagttgatcaggttaatcaaaaaattctgtttataacttggagctaatgttaactgtcttgtttcttagaattgtacaatgaggtgccgggcacggtggttcatgcctgtagtcccagcactttgggaggctgaggcgggtggattacctgaagttgggagtttgagaccagcctgaccaacatggagaaaccccgtctctactaaaaatacaaaattagctgggcgtggtggcacatgcctgtaatcccaactactcgggaagctgaggcaggagaatcacttgaacccgggaggtggagcttgcggtgagccgagatcgcgccattgcactccagcctgggcaacaagagtgaaactccatctcaaaaaaaaaaagaaaaaaaaaaagaattgtacaatgaggtaaaataaaatcatatagttgaaactactgccaagtacagtggctcatacctgtaatcccagcactcttggaggccaa

SEQ ID NO: 12251 - DNA, 1123 bp, Homo sapiens
attcaaaaccacctttgccagaaggagttctgtctggcatgtgagctgggcttcctgtttcacatgttggacctctctcgtggtgacccttgccaggtcagtacttggagacacttaaaatggaaggggaaggaaggtggacacaaaagacaaaataacccctttccaccaacacatttccagggcaataattttcttcgggcattccgtactattcctgaggcctcagccctcggtctaatcctggctgactcagatgaggcctcaggcaagggcaatctggccaggctcattcagaggtggaatcgcttcattctcactcaactgcatcaagatatgcaggagctggaaataccacaggcttatcgaggtgctggaggcaggtatgaaatcaggatagaaatagttaaagccatcatgacaggcccctctgtgatttaaaaggtctcctaacttcctcaatgtgcatatatcatcctctccactcttagcagcttttgctcatcgggggactctgttattgggcagctcttcagctgtgagatggagaactgcagcctctgccgctgtggcagtgagaccgtgcgagcctcatccactctgcttttcacactctcctaccctgatggtagcaaaagtggtatacccttcagctcagttgggaaggctccccaaaatgtcctgtaatatcagggagagggtgttggggactaactgtgggtagaggggagaaccaggagtatagcatctaattttccctcagataaaactgggaagaactatgactttgctcaggtgctgaagcgaagcatctgcctggaccagaatacacaggcctggtgtgacacctgtgaaaagtaccagcccacggtgagtggactgttggactggactagagtcctggtcctgccatggagattcagccactatcccatgtggggctggctctgtcagcactgccatccagggatctctggtggagtgaggaatcccagtttgaagacgcagacccaggtccctgtccagactccttttcctgtacattccctgccattccttgtttgtttcttcctctcagattcagacccgcaacatccgccatctgccagatattcttgtcatc

SEQ ID NO: 12252 - DNA, 1021 bp, Homo sapiens
gggtcccaaggttttacttgggtttggccagagattagagcttttattttcttgaatatgaggaacatggaaaaaggtaaagataaagtaggcaaaataactgtagaattgctctttgctgagtagcgaaccatctgtggtttatggaaggcacgaagtggcattctgtctctaggcatggatttggggcccatcttgtcctgaaatcaggggaagaggataggaagggcataagaatatggctccctttcactttctagggctcagtgggtttcttcctcctttgtagggcagtgccaattctgtgaacccacaggcctggccaacccagccgatatctttcatgtgaatcctgtggggcctctgctaatgacatttgatgtgtcagccagcaagcaggctctggcctttggggattctgagggctgtgtgcacctctggactgattccccggagccttccttcaacccctactcccgtgagactgagtttgctttgccgtgtctcgtggactcactgcctcctctggactggagccaggacctgctgcctctttccctcatccctgtcccactcaccactgacacacttctctctgattggcctgctgccaactctgctccagctcccaggttgtaccctacctctgggccaaaaggcgggagggacagggaaagggccaagataccagaattctctgctagccctgttgttattctactactttcctgatttttgtctaccttcagtattttctttttctctggacccttggggattggggagtggaccagtgtacaccacaactctttaagtcctagaactatgctggattgtaggcgagcaccacccgtggatgcagagattctgcgcaccatgaagaaggtgggcttcattggctatgcgcccaatccccgcaccaggctgcgcaatcaggtgtgttcagagtggagggtcagccccgaccccggcccactgaagtttctcctatctttttcctttactagtctttcttttgttt

SEQ ID NO: 12253 - DNA, 1060 bp, Homo sapiens
tctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaactgggctcaagtgatcctcacgccttggcctcccaaagtgctgggattataggcatgagccactgtgcttggccaggatttttttttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaatgtctcatctctgatcctctttatttccctgctcacaaaggctaatgttcttagggacaccaacaagctgcacagg

SEQ ID NO: 12254 - DNA, 1049 bp, Homo sapiens
gtcctctttcccttagtatctcagcccctctcctttcacacttagtctctttttcccataatattctcagtccctagagtcagaatggtcagggttccattggcccaacctggaaaatctcttagtttgacttttaggttcttacgtggaaggaaagtgaggggaaggaggcacactgtaggcctctgctggctggcctctttcagttacctgccttgtccttcctgttcttttcagaactgatcagagaaggcctttggtctcctctttttgggccaagaacctatatgctccctttctcctttcaccattcaggtcttccagtcgcagagcacctacatggagccccgaagaagaggctcatcttcgggagctgtacctcgccaataaggacgtggaaggtgagaggccttgggatctggagagtttatgaggagggcagcttgagctgtgggaccttctttactgccttagtccttccccacgccagggcaggatgtggtggaagccatcttggcccacctgaatactgttcctcgaacacgcaagcagatcatccaccatctggtacagatgggactggctgacagtgtcaaggacttccaaaggtagagaggcacatgctctggaggctattgggatggggactcgtgatcacttcctgggcttcctcttccactgacaccttcctaatcaggaaaggaacccatattgtactgtggacgggggatcaggagttggagctgcagcggctttttgaggaattccgggactcagatggtgagtaagctggaaactcaggggacctttgagatgaaagccaagctatccatttattttggggctgccttttattcccaaggaaagattctcccatcccttctgttcacttactatatttgtaagtgtcatttttggatgaattgaggtaccctctttccagagacctctgatttattttactcatctctttccctgttacccttgggtattcacatgcttgctttttatagatgtcctgggtcatatcatgaagaatatcacagcca

SEQ ID NO: 12255 - DNA, 1086 bp, Homo sapiens
gttaagccacctgctcaagttcaccagtttagtaccagacagaattggaattcaagtgctagatgccattttgttcatactactgggtctcaaagaggatccttggagcagagttggtttggggcaggtagagtgttttgtttcgtcttcaaaaagtaagtttatttggtcgggcgcagtggctcatgcctggtatcccagcactttgggaggcccaggtgggcagatcatgaggtcaggagtttgagaccagcctggccaatatggtgaaaccccatctctactaaaaatacaaaaattagctgggcatggtggcgcgtgcctgtagtcccagctacttgggaagctgaggcagaagagttgcttgaatccaggaggtggcggttgcagtgagctgagatcgtgccactgcactccagcctgggcgacagagcaagactctgtctcaaaaaaaaaaaaaaaaaaaaaaaggttaatttgaattgcaaatacatttaatattttatctgttgttttcttttggttcttgcattttaatgcctccaagtattgatttcagatgcatattgcttcatctgaactgcttgatacttagttgagtaggaaaagtaactaacatcccttttaaatgtccagttccattggctctgtggtgtttgacaaagttctcacctggtctatgatgaaatgtgaaaataaagtcaatgtaatgaattttttcatgaagtcatatttattaaatttgaaggacagtattttatcctgagatttttgtctgtagtttttttggtgttaaaatggtagaaacagaatgcgtatagtaattgtgtggagtgttgtttataacggctgtttgagatataattcatatactgtaaaattcacccttttaaagtgtacaattcaggctaggtgtggtggttcacacctgtaatctcagcactttgggaggccaaggcaggaggattgcttgaggccagtcaggagtttgagaccagtgtgggcaacatagggaggtaccagctctacacaaatttaaaaattagccagatgtggtattgaatgcctgtggtcccagctgcttgg

SEQ ID NO: 12256 - DNA, 1013 bp, Homo sapiens
tagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaaccacatttgatagagattcaaaagactctgtgtattcatcttcccttctacacacctgagggggagacggcgttgggataggtatgactggcttaagagaccacaggcaagggaacaacaggggctcctgttccataccctctgtgtggatggaaagggtcattagtgctcctgcctaaatgtctggctgagttgctggagcaaagggggattcagtgcatccaggtcctgccttgtgagatgtggccccagcttcctaagctgccacctctgtgttcctgtcatagcaaatatgggaccatcaccagcttaccacttcccactcacggataagacaccaagacgtagacttttgtgttttatttaaaaaaaaaaaagtgtgaagtaagacaaaatggacctctaccaagttgtagggaaggacaaggaaaagaccaggggtagaaaaggagtgtaagttttagaatggtggca

SEQ ID NO: 12257 - DNA, 1032 bp, Homo sapiens
cctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgcgtgcttgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccc

SEQ ID NO: 12258 - DNA, 1028 bp, Homo sapiens
ctttcttgaatctgataacctcctttttcataatgcccatgtgtttctccctaggttgatgccacagcatctagcatcccagagctagagcgccagatagaaaaactcagcaaggtattgtgcttctaacctcccaagagttggagatatgggctgggcaagaattgatcagcttcttttttaaactgaattttaatttttattcttttgagatggggtttctgttacccaggctggagtgcagtggcacgatcatggctcactgcagcctcagcctcctgggcttaggtgattctcccaagtagctgggactacaggcaggagccaccatgcctggctaatttttgtgtttttgtagagacagtttccatatgttaccaaggctggttctgaactcctgggctctagcaatccacctgccttggcctcccaaagtgctgggattacaggcgtgagccaccgctcccaaacttaatcaccttctgaattaggcccagatggcatcacttttatagagggactgagagccattgcctttctctgatatactggatgaattcaccactgtcactctggaaatgtgtttattcatcttcattttcattgtctacccagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttaggtaggtgtgcctgtgggagtgtggattctgagtcctatcaaacaagaattaaataattccttttccttagtagtcttgggcttctttcattttctgataatatagcgtaatggttaagagcacagattttagagtaaagctgcctacccacctgctctgccatttccagctgtatgattctgtttcttcatttgtgaagttgagataataatagtgtatgtacttcataaggctactgagaggattaaaatgagttaagtctcttaga

SEQ ID NO: 12259 - DNA, 1041 bp, Homo sapiens
gctagactctgtctcaaaaaaaaaaaaaaaaaaaaaaaaagccaggcacggtggctcacgcctgtaatcccaccactttgggagactgaggagggcagatcacctgaggtcgggagttcaagaccagcctgaccaacatgaagaaaccctgtctctactataaatacaaaattagccaggcatggtggcgcatgcctgtaatcccagctactcgggaggctgaggcaggagaatggcttgaacccaggaggcagaggttgcagtgagctgagatcacaccattgcactccagcctgggcaacaagagtgaaactccatctcaaaataataataataatataataataataataggcactgttttagtggatggacaggtgagaaatacctacatttttcagtaaatagtgtgtttaccctggtgtagtgtgaagaatgtgaaaaaacttagtcttttgattttcactcagacatctagccgtgtcatgtttcaaccaaatgacctagaacaagtctcattttgtttttttttttttgagacagagtcttactctgtcacccaggatggagtgcagtggcacgatcttggctcactacaagctctgcctcctggattcaccccattctcctgcctcggcctcccgagtagctgggactacaggtgcacgccaccacacctggctaattttttgtatttttagtagagacggggtttcaccatgttagccaggatggtctcgatctcctgacctcgtgatccgcccacctcgacctctcaaagtgctgggattacaggtgtagcccccacgcctggccctttttttttttttttccagatggagttttgctcttgttgcccaggctggagtgcaatggcgcgatcttggctcaccgcaacctcccaggtttaagcgattctcctgcctcagcctccagagtagctgggattacaggcatatgccaccacgcccagctaattttgtatttttagtagagatggggtttctccatgttggtcaggctggtctcgaactcctgacc

SEQ ID NO: 12260 - DNA, 1695 bp, Homo sapiens
ctgtcagcttattcagcaggtattaggggtggtaagaagggtcttttgagtgctaagaatatggagtgagatgataaagataggtcagaaagggggatggcttaagtaaaattactttggttcgctgggcgtggtggctcacgcctataatcccaacactttgggaggccaaggcgggtggatcacgaggtcaggagttcaagaccagcctggccaagatagtgaaaccccgtctctactaaaaatacaaaaaaattagccgggtgtggtgatgggcacctgtagtcctagccactcgggaagctgagacagagaattgcttgaatccaggaggcagaggttgcagtgagccgagattgcaccactgcactccagcctgggcgacagagcgagaccctctcaaaaaaaaaaaaaaaaatttactttggttcctgttcttcatgggatctcactttaggctatctatgtgcctgctgatgacttgactgaccctgcccctgctactacgtttgcccatttggatgctaccactgtactgtcgcgtgccattgctgagctgggcatctatccagctgtggatcctctagactccacctctcgtatcatggatcccaacattgttggcagtgagcattacgatgttgcccgtggggtgcaaaagatcctgcaggtgagtatattactatgtgggatcagtgtccggaaagtcaaaaagagggcctgtggggactatatgaggactggatctttcttagtgatttgttttggagcaaggaaagttgaggctggcaattgctagtgagagctaatgaggtctcttgagtttccaggtacttaacgctttggaatgcaatatttttctttctttttttttttttttgagatgagtctcactgtgtctcccaagctggagtgcagtggtgccatctcggctcactgcaacctccgcctcccaggttcaagcgattctcctgcctcagcctcctgagtacctgggattacaggtgcgcgccaccatgcctggctactttttgtatttttagtagagaccaggtttcatcagttggtcaggctggtctcgatctcctgacctcatgatccacccaccgtggcctcccaaagtggtgggattacagacgtgagccactgcgcccggcggaatgcaatatttttctaacagcaccaaactaggactatggagaacaagacactgatctttcttggctgagggccctcataacaccaccaccttctctgccccctagcatgtaactttccctttgttagcttgtccaaattaaaggaatgagaatacttaactcagtcttcttttttctcataggactacaaatccctccaggatatcattgccatcctgggtatggatgaactttctgaggaagacaagttgaccgtgtcccgtgcacggaaaatacagcgtttcttgtctcagccattccaggttgctgaggtcttcacaggtcatatggggaagctggtacccctgaaggagaccatcaaaggattccagcagattttggcaggtgagattttgagtacaaatcttgaatgtttactgtgctgtggtcccattccaacaaccgtcaagcaatatatgtaatatactatgcttaattatattttttaatttaaaaaacaaacttacccattgattttgtttgaaaatactctaca

SEQ ID NO: 12261 - DNA, 2418 bp, Homo sapiens
cgttgaccttccggttgaataggggtactgaactctcgaaaaatggggtcttgtgcatgcggatgggaaggctgtgcaggcgctttatcgatcgctgcgcggccttccctcttggacacgcgttccgtacaagcggaaagaggcctgacttcggctgagttttcctctccttgtgtgttaagtcctggcttccgatgacctttaactggcctgaccccagctccttccaatatcttttgtctgttagtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtaagtagagtttgttaggaatagtaaagaccttgtgtagcccaaatatccccaaaaccaagctgtctgccttctatgatgattttatcaaaatgactttcgttcttctgagtttgctgaagccacatttaggtactgagaaggagtcttggtcgatttaggtcttgataccaatttatccttatgtataaccctgcgatgcctgtatctaacaggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacagtaagttgctcttattgcatctatgcacaaaggaacttctgttatttgcagttttacacattaaggtgacatgttctcctaaagcagaatttttcttctgatacgttcgattattaaaatcacacagtgcagtttcacctgaagaaattaggatgcagaatttctgattgacaaaagcctactacttgaggtttttttttttgagagggagtttcgctctcgactcactgcaacctccacctcctgggttcaagtgattctcctgtctcagcctcctgagtagctgggattacaggtgcatgccatcatgcccggctaatttttgtatttttagtacagatggggtttcaccatgttggccaggctggtctcgaactcctgattttgggtgattccccccccacctcggccccccaaagtgctgggataacaggcatgagccactgcgcctggctagttgagtatttttaagactcggtcttatggcttaggtttaggagtctccaaaacttgtaggtttttgtatttgctattgctatgtgagggaatgctgttaggttaaggctcagtaaaatgaaaaatttatgacagttaaagtcagggaatgggattattgtttcctaagataataattttctttattgcagaaagttgggttagatcctagatgatagtttatctgatttatgtaagaaaggggaggtaagactgtggttcctcaggtaaagggatggacttgagagttgatagggagggatatataagattatcatttgctttcaacaaggtgaatagatactatcctctcttctacctttacagatttgctcccattcatgctgaggctccagagttcatggaaatgagtgttgagcaggaaattctggtgactggtatcaaggttgtcgatctgctagctccctatgccaagggtggcaaaattggtatgttattaaggggtacatattttccaaacctaatatgggaggaaaaactcatacaatgttatgagtggatattgacatctattcctcactgatgagtacgttctgactttcgttcttctgagtttgctgaagccagatgcaatttctgagaaggaataggatggaaggaagcaattactttttttgaagtttgcttatttaggaaagcagaactcttaaatattctttcttttcaacctcttatagggctttttggtggtgctggagttggcaagactgtactgatcatggagttaatcaacaatgtcgccaaagcccatggtggttactctgtgtttgctggtgttggtgagaggacccgtgaaggcaatgatttataccatgaaatgattgaatctggtgttatcaacttaaaagatgccacctctaaggtaagcattgagctaattgatgtccacgtggtagttacgccaggaaactattgccaactgaagccatgttctatattttctatttaatttttttttctttttaagaaaatgttaatattttcattttcgtgtcccagggcctacaaaggaaacctgttagtgttttcccccccaacttccaatacacaaatggacattttctttcctctttgatactgac

SEQ ID NO: 12262 - DNA, 2370 bp, Homo sapiens
ggattagagttcactgtcttctatcagtccatttttcttcatattgatccatgttttctctttgaatgccgagataggttaatttaggaatggattcaacgggtgggctaaattgtcaccaaaaggcacacatcattttttataggtagataaatcctctgctgtacatccattcaccttaggtaaacctagtcaagtccaatgactaaatttctaggcttgatatgactacctacctgtgctactttagtcaaaaatatagcacttgaacttttttaggtaaactgttcagttagcaaacgaatatttgatcagctcggtaactttattttccctctttcaggattcacaagacagtgatgatgaaagtaagtgtatataaaaagtatgtttatacagtgatactttgcatcaaaaaacaaactcaaaatagagatgttaacttctttggaagtaaagtaattttttctttatgaccttgaataaataaccaaagcagaaatgtgaataacttgatagcaagacaacctattaattcattgggcaactatgtatttcgatttttggttgcttttcctttaagacagtaaaattggtagattattcacttgtactatatactaatatttttaaaaattctttcagaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaatctttgaacttctgcattttggcagttttcattccctcacagcttctgtatttgtcataatgtagaaacactatgtattttagtgtttctttgtcagatattcaggacctgtgttgcaggcagttaaagtgctggtgatacaaagattaatatttcagatgattgctgagctcagagagctcacaggctaggggagacaaacatgagacaaaaacttgatggaaagtgcgataatagatacgcataatgtattacgatgtgtagttcttagcttcaggggggaaaacattttaaaaaaacttgtttttcttcaaaaaatttatacttcagttttgggaattaatgattcactggcttactgcccagccttgaaacgcattatacaggccggcacggtggctcccacctgcctttaatcacagcactctgggagactgaggcgggcagattgcttgagaccagcctgggcaatgtggtgaaactcccttttttttttttttttttttttttttggagacggagtgttgccctgttgcccagtgcaacttccaccctccaggttcaatcgattatcc

SEQ ID NO: 12263 - DNA, 1035 bp, Homo sapiens
ttagattatataataaaacaaactggaagtacagagacatggttagttactttgcaataaaaggaccgctggagaaattattgtccctttttgtgaagtgaaaaaaaataagccttctgtcagaaatgctgggttccaatcctattttggctttttttttttttttggggggggagacacagcctctctctgttgcccaggctgtagtgcagtggcgtgatctcggcttaccgcaacctccacctccacctccccctccccctccccctcccagcctcccaaatagctggtattacaggcatacgccacctcgcctggctaattttgtatttttagtagagacggggtttctccacgttggtcagactggtctcaaactcccagccccaggtgatccatcagccttggcctcacaaagtgctgggatcatgggcttgagtcactgcgcctggtctgcagtttttgtgttgtgttttgagacggagtttcacgctgttgtccaggctggagtgcaatggcgtggtctgggctcactgcaacctccacctccttatttcaagcgattctcctgctgcagcatcctgagtagctgggattacaggtgcccatcaccacacccagctaattttttgtatttttagtagagatggggtttcataatgtttgccaggctggtctctgaactcctgaccttaggtgatgcacccatctcagcctcccaaagtgctggagattacaggcgtgagccaccgcactcggccctgtttgtagttttaatgtgttagccaacttgtataaagggtcagccagtaaatattcagctttgcaggccacaaatatctcttatctcattcacattttttttttttttttttttggtctcattctgttgcctaggctagagtgcagtagtgtgatcttggctcactgcaacttccgcctcctgtgtttttttaaaaatatacatttaaaaaatgtaggaatcatttttggttcatggcctaaccacaggttttgataatttaaatttgtttt

SEQ ID NO: 12264 - DNA, 1048 bp, Homo sapiens
tgggttgaagtagttctctgcctcagcttcctgagtagctgggattccaggtgcctgccgccatgcctggctaattttttttttttttttttttttttttttgagacagagtttctctcttgttgcccaggctgaagtgcaatgtcacggtctcggctcaccgcaacctccgcctcctgtgttcaagcaattctcctgcctcagcctcccgggtagctgcgatcacaggcatgcgccaccatgcccggctaattagtagagatggggtttctccatgttggtcaggctggtctcaaactcccgacttcaggtgatcacccgcctcggcctcagaaagtgctgggattacaggtgtgagccactgcatctggcctaattttatatatttttagtagcgatggggtttcaccatcttggccaggctggtcttgaactcctgacctcatgatccacgcgcctcagactcctagagtgctgggattacaggcgtgagctactgccgcagccggcaatgatagattctagaatgaggctgcttccctgcttcctcggtatacctttgtaaatttttttttttttcttgaggcggagtctcattctgttgcccagactgcagtgcagtggcgcgatcttggctcactgcaacctctgcctcctaggttcaagcgattctcctctctcagactcccaagtagctgggactacaggcatgtgccgctatgcccagctaattttttgtattttagtagaaatggggtttcgccgttttgctcaggcaatcatcccaccttggccttccaaagtgctaggattacaggtgtgagccaccacgcccggcctttttttttttttttcttttaaatggagacgggatcttaccgtgttgtccaggttggtcttgaactcctgggctcaagtgatcttcctcccaaagtcctgggtttacaggtgtgagctgctgcacccgatccttggtatacctttgaacttgcggttttccgggaatatttcttcttttctgagacactgtctcactactttgcccagg

SEQ ID NO: 12265 - DNA, 1032 bp, Homo sapiens
gttggtggctcacacctgttatcccagcacactggaaggccaaggcagatggatcacttgaggtcaggagttcaagaccagcctggccaacatggcgaaaccccatctctactaaaaataccaaaaatatatagcagggcatggtggtaacgctcctgtaatcccagctactaaggtggctgaggcacggcaattgcttgaacctgggagacggacattacattgagccgagattgcaccactgcactccagcctgggcgacagagcaagacctgcctccaaaaaataaaaaataaagtaacagaagttactacggcagaaaacccattctctattcttgtatgaacttttctcagcctggggaaaggctttgctttggatgttgtattatgttccttgcttctttaggctgcttctaaagaggttgaaaacctgatactattttctcttctttaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaaggtgagtaaacttttcttgggcattgttccagaccagggtttctcaacctcagcactgctgacattttgcgtcagatagttctctgttatggaagggctatccattacatccagttttgattacccaaaaactccattgccatatatctcctgggagacctaactaccccctagttgagaaccactgctctaaacctaaacaactactctttctactgtgagggcaagcagtttaaagctgtacaataagttacctgaatgggtttacagagagttgtgaaactatatgatttatttttcaaagactgctaatctactcacatggatctgtattttctaccctgtagatcgaagatttatcccagcaagcacaactagcagctgctgagaaattcaaagttcaaggtgaagctgtctcaaacattcaaga

SEQ ID NO: 12266 - DNA, 1089 bp, Homo sapiens
tgcctttatcacatgtctggatgagatgtgtgctggtggtaaatgtgtcctactgggccccagagtcgtcctaggtcggataacttgtttatgggttggtggtgctgagatacttctagtgtgctggaatagttcctgcatcattgtgtgaaacccaggattgaaataaatccttttatcctcagcgtcgaaattaacgactgtgaaggctaattttaaattctggttaaaacatatctctgtagaaaacttaggaggaggtaatgaaaagttcttaaaatgatagcctttctgagtcagttgtgcagcgttaaatgaaggaaatcttcaggctgtaattttcattctcacctttttggttttttttaaatttcatttgttatttaagggcaattcctgtccctttttggagttacagtagagttgcttatagttgaaagcataaagtttcttcccacctgtttgattttaacagctgaagggattaatacagctgctaggaaggacaatagggggctctaagctggagtataaacaatatgaaattcttgaagtacaaggggcttaaggaagggaaaaaataaagtactgttctctaaagattctgtaatttcagtacaaaacgagattttagagattgtgtcattgaacaacttaattttacaaatacgaagatttgaaattcagatgaatttagaataatctgattcaagcttcaaaactaatgcatttacttctgaaacagtccttaatgctattaaacgtattcctgaatagtctgagttgcatagtaggcttatattaaggaagtaccaatgataaatacacaaggttttatctgtaatgatagtctattagaatgaagaaggaagctcaaggaattgttgatggtgtcaaagcaagtatttgagtgcttattccatttgaggtccagtcagaagaaaacatattccatgtttttaattctgattcattatgtttggtagcgttttcctgtaatcgttagactttggcctacccactctccaggaaaaactagttgagccaccttgtcttttccatggtaggatgccataagaacttcagaat

SEQ ID NO: 12267 - DNA, 1028 bp, Homo sapiens
aacaggcgtgggtcacgctctcgctcggtctttctgccgccatcttggttccgcgttccctgcacagtaagtactttctgtgccgctactgtctatccgcagccatccgcctttctttcgggctaagccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaagggtaaggggtcacagccttagaacctgtaacaccgttctccctgtgacaagcaagtgttggacttaaaacaccgtctttcccctcctggtaccccaaagtcggcaaacgtagtccaggaggccccagcccagccagtgtgagtattaggagtggagggggttcacagtagcgtctgaagtctcccatgatcgagagccagcccgggatcctctccctcgggttgagaatgcagtgggaattgctggccttgatagaggcgtgagggtcacatcatatttacctcttattcccaggtgctttggggaaggttgtcaccaaacaccctcacgatttttttctaacagccctcctcggagtttttaagaatacttatctccgggttgggcaagtgaatgtatcccaatcaatttaggcctcctttttattcccttccttcagaaatgcccggcgaagccacagaaaccgtccctgctacagagcaggagttgccgcagccccaggctgagacaggtaggtttccctaccctccttgccattaattaaaattaaccctaaagccatttggtgggcaaaatgaccaaggggaaatacactttttaggaggatggggttgcagctttaccaaggaggatagaccgtaaaattactatcctggagatac

SEQ ID NO: 12268 - DNA, 1028 bp, Homo sapiens
gggcaataaaagtgagactgtcccaaaaacaaaacaaacaggctgggcatggtggctcacgcctgtaatcccagtagtttgggaggccgaggcaggcggattacctgaggtcaggagttcaagaccagcctggccaacatggtgaaacccgtctctactaaaaataaaaaattagccgggggtggtggcacacacctgtaatcccagctactcgggaggctgaggcgggacaactgcttgagccctggaggcggagattgcagtgagccgagatcgtgccactgcactctagcctggccgacagagcgactcaaaaaaaaaaaaaaaaaaatccaagaagtgcccaaaatagcaagcaaaggaattgtatatgtgcctatgttctttttttctgggaaggagaatctgcagctttataatttcaacatcggctaaattgtcgtgaacctaaaacaatcaaaagggccggaatctatttaaagagtttattcaagggcagtgtgaggatggaccaaccagaaaacctccaaagaatggagtcagccttcagaagtagagaagttacgatttcatttatttagggagacagaggagtttttagctggattacgttatccatacaaggttggaacataattacagaatttggttacaagaagtgttttttttggggggggggcgggggtacagctaacattgttttacgaagagtttaacacgcatgagttgctgtcatctggtgacatcgtttgagtctctctagtcattgaacagaacaagaaaaatcgaattaaatttataatctgaactgaagttatatgtgacccatcacatctctcaagttttaaaatgggtttttttgttgttgttgatggggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcg

SEQ ID NO: 12269 - DNA, 1015 bp, Homo sapiens
agatcatggtgtttagaatatcccaaatttagctggccgcataatttttttacagtaaattttatgggattcacatgctattatacactggataatgctgatcagaaaccaacattaaacttctcttgttcgtggtgaggcgcggtggctcatgcctgtaatcccaacactttgggagggcaaagcgcgtggatcacaaggtcaagagatcgagaccatcctggccaacatggtgaaaccctgtctctactaaaaatacaaaaattagctgcgcttggtggcatatgcctgtagtcccagctacttgggaggctgaggcagaagaatcacttgaacctgggaggcggaggttgcagtgagccaagatcgcaccaccacactccggcctggcaacagagcaagactccgtctcaaaaacaaaaacaaaaacaaaattctcttgttctgttacttgcagcttcatctgccgtgaattggatgccatttccactaatgaagaggaaaaagaggagaatgaagctgaatctgatgtcaaacatagaaccagaggtaaggtaatattttgaagcttcactttaaatacagggtttttatatagatatccatctgtcactccagtaattaattctctgattcaactagaatggatcagcatttgtcctggaactgcatacaatgtttgtgtcctttcttcaacagcagcccaagtggtgttattgaatccagtctgattcaacacatatttcctaagtaacttttaatgctaggatctatactgtaagattaaactatcaataagtatgaataatcagtctctgagattcaccacctatttatttaacaactattatatatgcagtactttttttctttgtttctgatgcatataggtgggttttatggtaaacatatgtctaaactgtttaccaagttgtatattcaagaatttgaagaagctggctgggcgcagtggctcacgcctgtaatcccggctctttgggaggccgaggcaggc

SEQ ID NO: 12270 - DNA, 1069 bp, Homo sapiens
attacaggcatgagccactgtgcccagcttctcatagcctctttataataaagtctcaattcaaactaattggggagatctttttgaattattgaaaaatttttaaatacttctatgtatggtaacaagtaaaggttcttaaaacaccttgcaataggccattatttgtatacgttcccttgtcagaaaactaaaaacagctttattattatccttattgaccaacaaacatttatgatggatatgtattcattaaaccctgctttaagttggtgaaagttaagactctcatcaatagtgtatgtgtaagatccaaaataatgaactttcactgtcataaagttggcattatatagtctctttatttctgtttggcaactttttccatatgtgtagaaaataagcagatttagcagtgtggcagctcttatagaaactgatcaatattttgtatctgtagcccaatcaacacaatacagtgaagctgggagctttccaggctcaggaaaaagaactggtatttgacattgacatgacagactatgacgatgtgaggagatgttgtaggtgagcactgtgtgtcttgctgttagggtgggtggtatcactgacaatgagtaatgatgactctgctttagttctgcagacatatgtcctaagtgctggaccctcatgacaatggccatacgcatcattgacagagcattgaagggcaagtatcagcagtttctgaatggggtcaagtgtaagaatcggttttcctctgactactattaactattagtctctgtattttgtgatcaaatctcattaatttgtgtgtgtgtgtgtgtgtgtgtgtgtgtgtgtgtgtgtgtgtgtgtgtgacgagtctcactctgtcagccaggctggagtgcagtggtacaatgtcggctcactgcaacctctgcctcctgggttcaagtgattctcctgcctcagcctcctgagtagctgggactacaggcgcacgccaccacgcccagttaatttttgtatttttagtagaggcagcgtttcaccatgttggtcaggctggtctcgaact

SEQ ID NO: 12271 - DNA, 1050 bp, Homo sapiens
aaaggcagtctatgtcataaggaccgcaactcctaggtgaggcctagtgcagaactaggcccagagacagtggattagggggacatgtgacatactgagacaccagctggggcagccaagggaatgtcggcatcacccctcccctaactccagtctgcacaacctgaggctccaaaggagaccccttttttctacttgagcagaggagagggaagagtgggaagggttttgtcttgcatcttggataccagctcagctacagcaagatagggcaatgatcagagtcatgaggcccctgtttcaagtcctagctcccatatgacattactagacagaccctgggccagaagggaaaggacccaatgctaacagcattcatcacctgctatctgaagagaacttgggccctgaataaccagtaattcctaggtgctaatcaaaggccttgggtgagcctctgaaccttgatggcttcaggtgagactcgggacattgccagctatgttggctatggagagagactcctgcttgagtaaagcagagagaaaagtaaagggactttgtcttacaccttaggtgccagcaagaccacagtggggtagagcaccaagtgggctattgtggttcctgattctgggacttgactcttggatgacattttctggacataccctgggccattgggaagcctgctgacctgcagggtgagttccaggccaggcagcattcaccacaagctgattgaagagatgttgggccttaagggaacatcgatagttgtctggcagtactccctgtggcctggggtggtggtggctgcaggttgaggctcctctgcctttggaaaaggaagggaagagtgggaaggactgtgtcttgtggtttgagtgcccactcagctacaatttagtagaatatcaggtacacttctaaggtttttgactctagtccttgactcctgcacagcacttctggacccatatggggtatggggtacctcaccatcctgaagggaagggcacaggcctaactgactttgctacttgctga

SEQ ID NO: 12272 - DNA, 1058 bp, Homo sapiens
accaccttatatgttcctcagtagctagtggagctttgatagttgtgttcaagcatgtgcatggtatttggcatcatgagggaaaagaatatgctcaatgaattaggaaagcttgtatttgggaggaaattaataggagaaaaatttgatccagtggctctggtaatgaagtataagattgtgtccaagggaatgcctctggttcgtctctaggcaccagcttaaaaccaagctatcagattgtcatcagtcgttttggtttttgtcataactctttgagtatatacagggggagatgtcattgccttgtcataatggaggaactctccatgccagtttactcctgatccctacctggggcttggaagcattcagagtgatggtattttctcctgcatagcccctcttttgcacggatgtgtttggccatccatctttttctcttgctatccacagattaactgtgctgataaggaggtaatttcataggagctgctaagatgggcatgaggatcaaactgcaaagcaccaaccaccccaacaacctgctgaaggaactcaacaagtgccggctctcagagaccatgtgcgacgtcaccattgtggtggggagccgctccttcccggcccacaaggctgtgctggcctgtgcagctggctacttccagaacctcttcctgaatactgggcttgatgctgccaggacctatgtggtggacttcatcacccctgccaactttgagaaggttctgagctttgtctacacttcagaactcttcacagacctgatcaatgttggggtcatctacgaggtagctgagcgtctgggtatggaggacctcctccaggcctgtcactctacctttcctgatctggagagcactgccagggccaagcccctgaccagcaccagtgagagccactctggtaccctgagttgtccttcggcagaacctgcccatccccttggagaactccgaggtggtggggactaccttggtgctgatagaaactatgtgttgcccagtgatgctggagggagctataaagaggaagag

SEQ ID NO: 12273 - DNA, 4162 bp, Homo sapiens
taagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatatactattttttaccttatttatagaaattgagacctagcatatttaagcataagtttattttaaaaaataattcaactcgtgcaagtggtctcaggattctctggagattttggtgcctcccctacttagggaggtgatagcttgcctataagggtgacttttcctgatcatgtctttatttcaatgagaaagcactgtgaaattgtgaaagattctcctctttctctgtttaataaacccccatgaaatatagtttccatctctagaccagttttttttccaccgtgtttagacttgaggtgaataaaatcaaactgttttttactccctatctggtagttggagacctgagctgtaggcagtggagatggcaattggttctgcagcctgagagttgctctcacacagtgaaggacggtgctgctctggtgtgctgtgtgtccttgccctgcctgcctgtggctctgcccagatgcttcagatcctctgtgttccggagattgcttgacttcaaccttctttaggagctgctcttgtctccctcttggccacttagtttgctggctcagtcactacttgaagaccccatttaatttttctctggcagttatagctcttgtgatttcagtacagtctcatctctcagaccaatctcatcaagaaggattgaagggataactatgaggtaagctggacattggagccgtgtttgctgccacgtcagcgtcttgctgggtgaatgtcaagccataaatgggctccagggctctggatctcatcagcattggaaatctattgcctctcatcagtctgaccaaattatgtagagcattaatgtagagactcccattaatgggaatacaagaggcagctggcataaaacatttctttcactttcctttcccactcagattgcttcaagagaccaacagaacacagggatcaaaaacaaggaaaatttagcaacttcattaccttctaataagtaattcctgttagccactgcatcccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttatagatatattgtggtctttcttaatgaacataatattttcttgtttggatttcttgttttcaggtaatcagcaatttactcctcagtttcatctttctaatgagatggttttgcatgccactgatttccctttttttcttagccaccccttcctgtcccgagtctgtactggtctactttcatccttggactggatgatttcccaggatgcaaaatctctaaggggtattcttgcaggagcagcaggttgtactaccatgctgtctcatagaaaagcaaaatacaggttattcttggcccaaggaactactctgattatattttagttctttttttttttttatggcataaagtatctcttttgtttgtccattgggatggggagaagacctatggctccagctatgggatccctaccaagagctctgtatagggtggaagagagagtagggctgtagtgagccttatgtgtattgaataaaaacttaaattatgtctaggcccagcttctaccataggagtctggtacctttcattttatgtattggctaccttctttgctctgggaatcctttgtaatattcatattaactctgtacctatgttttttcatctcattaattaattattattattattatttgagacagtctcttcctgttgcccaggctggagtgcagtggcatgatctcggctcactgcaatctctgcttcccgggttcaagtgattctcctgcctcagcctcccgagtagctggattacaggcacctgccaccacaccctgataatttttgtagttttagtagagatggggtttcaccacgttggccaggctggtcttgaactcctgatctcaaatgatctgcccgccttggcctcccaaagtgctgggattacaggcatgagccactgcaccctgcctatttattatcattattatttgttttgttttgttttttgagatggagtttcactctgtcacccaggctggagtgcagaggcgggatcttggctcactgtaacctccgcctcctggg

SEQ ID NO: 12274 - DNA, 1047 bp, Homo sapiens
agaaaataagtaagtattttatcatttattggaaaataaagtgagtttgttcacattagtgaataatattgactataattttttactttctataggcatttttatatttttattctagtcattttatataaaataaaaaggtctagtaaaatgtcatgtgttcctgttaccacaaggtggtgcaaattatatcactttttttttgagatggagtctcgctctgtcgcctatgaattgtcactcatagtctaatgtatcaggagttcattataactaaagatgtccatggaatttttaggagtgatgactcttaatgttcaggctgtctgctgtattcttggcccactgaagggagctagaagtaaggatggatatagattactgattaatgattcataatgttattttggtgagcacagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaaggtaaactcggccagatataccaagcatctatcagggtaattgtgaccttgagttctaccagagatcatacttctagagaatcgtgcacttgtgacctttgttttcctgttaatcttcaagtagtcaagagaagggtggatatataatcacacattaagcagtaacctgtttcctcagggaactatctactctagctttgattgtagcattaagatgggaagactccagtaccatattaagtttcccttctgaaagttttgcattgctgtctgagttggtagggttcccccctacccactttttagttgggggcaaatgtaccaatgagtatgtgaagcttcaatttggaatcatgatggcataaagtttacagggccataaacgtgaataactgtaatgccccttaatcttctcttatcaggattacagatgactaaaggaaccttggcacttt

SEQ ID NO: 12275 - DNA, 1033 bp, Homo sapiens
attttaaatatacttggggaccttaagtaaaagactccgcagttaatttttttctccttcatttctgaatgaactgctgtagattttatttacaaagtaaaaatccttggtcatatagatagtaacctttgagttatcctttgaagggtgattaatctggatttctgtatattggttttttaaaatagtctatttcagggttgttcaacatgtacctttaatgttctgtttgaaccaaataaatttgggacagcagaaaggatagaaacttagagaaatatattctaagaaaaaagtgtgaaaaattaagtaaaaatctgatttcctagttcaattggtgctatatagtaaattaactactgcttcccacacaaattatttttaccaagtatagatgaaaaagaatgtcttctgataactcttctcataggttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcaggtgactgaaaggcaatgtaacttaatattgacaggtacattgtgggatgcagttgcagcaagaggatacagaggtgttgacctgggagcttctttgttaatgaaaagtcattgtattgtacttccacttttgttccttcccgagtctatttttttttttttactttctataggaatttttatatttttattctagtcattttatataaaatgtctagtaaaatgtcatgtgttcctgttaccacaaggtggtgcaaattctatcactgtttttttgagatggagtctcgctctgtcgcccaggctggagtgcagtggcgtgatctcggctcactgcaacctccacctcccgggttcaaacgattcttctgcctcagc

SEQ ID NO: 12276 - DNA, 1031 bp, Homo sapiens
ggtgagactgacatgtacaaatatgaagaaaatatataggtaactaaataaacattgaatgaaggtaaaatcaacattaagtttgtatacaagtaaaaagtatttgtggagtagtgaatgcaagattaacaattggagtttgaagttgggctggagtggggttgctggaagttgttattttggtgatgctgagagaaacagggaggaataactggtagaaaaaatctggaatggggggctggttgtggtggctcacccctgtaatcctagcactttgggaggctgaagggggaggataacttgagcccaagagtttgagaccagcctaggtaacatagtgagaccctgcctctacaaaaaaatacaaaaattagccaggcatggttgtgcatgccagtagtcccagctacttgggagtctgaggtaggaggatcacttgagcccaggaggttgaggctgcagtgatccgtgattgcaccactgcactccagcctgggtgacaaaataataatattcaggtcgggagagatgatggggatgtgaataggacattacgtaaaggctgattattgggaaatacatgagggaagacctttaatcctaatcttcataatctggcagtaactacatagcatcagtctctacagttctctgacctcaagttttgggcaaatatagtcacacatcactttattgtacttcacttttttgtggttcacagatagtgcatttctttccaaattgaaggttcgtggcaaccctgggtcaagcaaatctatcacaccgttttcccaacagcatgtgctcacttggggtctgtgtgtcacattttagtaattataatatttcaaactttttcatatgattataactgttatggtgatccataatcagtgatctttgatgctgctgttgcaattattttggggcaccacatgtccatgtaagacagtatattagttcattttcttttttttttttttgagacagagtctcgctctgtcgcccaggctggagtgtagtgacgcgat

SEQ ID NO: 12277 - DNA, 1023 bp, Homo sapiens
aagagtattcatggaaccataaataaagatgaagaccactgcagtttaaaacttattcagtggaactgggagaagttttctcttttctgaagatgactgagaaagtttcaggggagatggatcctgttgaattctctctgactttgtttccccttggttactacacagggtcctgggatgttgtaagtagtagaaatgtttctaggtttagtatgaaataggttgtgcccttccatttgtcctagggttctttggttacgtagggttggcttgttttttgacgttccttctacagttactgattccttctgctcctgttctgtttgtgggcctcccgtagaactcttgaatgtgaaagctgtgggagtatctggtatgccactaaggggcctttgctagggccccctggtcctgagtgagaggtatttgcgtgtaggcttttccagcacagtgttctgtagcaaagggaagtaggtggtattgttgggcaagaaaagcagccagttagagaacaacacaaggccctgacccacagttctgggcaaatctgctgagttccatgactgtgagtgacttaaagcttgaaagccagagtgatagagaccccttgtgggtgattgcatgaattgctgatggtactgtgtctagctttgtccaaaacgaagcttgagtttcttttaaccttagcataggtagcctaagtaaaagtaagatcttcaggcaaatacaggttagacagagacctaattatacattggaagggtgcccaggctttaggtgaaatttaaatgctttttaggtgggctgtttgcatttatttttactgtagctgaccaatagtgccaacgttgtcttttattctataataccttaagcagttttgttcccttattaagcaaaaatctttatttatttcaggatttgatcccaaactctttcttgttttccttcttggacttatgctatttttttgtggagacttgctgagcaggtaggttccaaggctagtgtgcagaatgaaac

SEQ ID NO: 12278 - DNA, 1106 bp, Homo sapiens
cctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacaccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatgtatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaagacgctctaactgc

SEQ ID NO: 12279 - DNA, 1050 bp, Homo sapiens
ttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactggacatcagtcactgtttctctgttgccgccctggtatgggtaaagggttggaggccctgggtaggtatagccctacagctgttggaggtgtttgtcgtgggttgggatggctttctctagcatacgcacactattttaacaccattccctctgtctcatcctcttccctgtacacggttctgatagatggctagatctctaatgggaccatggctttgggctctcccggttctgccactgtggttcatcgagcatatcacttctcaactctggatctgtgtccagatcagtaaaataagagacttggacttagtaggtgacctctaggtttccttccagactattaattctgtggtactgtgtactcatttagggcccttgtagttgagttttgagatagggtcttgctctgtcacccaggctggagtgcagtggcagatctcagctgactgcagccgcctcccgtgttcaagcgattcttgtgcctcagtctcccgagtagctgggattacaggcgcgatctagcatgcctggctaatcttttttttttttttttttgctatttttggcagagacagggttttaccatgttgcccaggctggtcttgaactcctgggctcaagtgatctcccgccttggcctcctaaagtgctgggattacaggcatgagccaccactcccagcccagctcgtcttctgaaaaccctttagggatggagaacttgggcctttcttttttttttttttttgagatggagtctcgccctgttgcccaggctggagtgcagtggcgcgatatctcggctcactgcaacctccacctcccgagttcaagcagttctcctgcctcagcctcctgagtagctgtgccccatcgtgcccagctaat

SEQ ID NO: 12280 - DNA, 1055 bp, Homo sapiens
ccaattgcagagattgaaagagtaacaacaggcagaggaccagtgtagatgatccaattctgggagttaactcttcctttaacatccctgtataggccttggacacttgcccctctctagtgctgtccatgcttaactttctttagccttctttacatacttagtacttacaaccaagtaggtaaaaagagctggagaaaataagttcactgaactttctaatgaccaaagagtttaacctaatatcagtaccaagtctgagggctgggaatgtgggattttgtaagaaacggtatggtcttagaaaaggaaccactagatttggtttcagaagttccagtctcaccactaactagctttgtgatgttcaacaagttacttaaactcagaagtagacctcacttcctagtctgtaaaatggggttaatcacacataagatgggaattttatctgctttctgccttagctgtcacaagcagtataaaaatgagaatgtagtttaaaaactttaaagtgctctgaaatgtaatatttatcaataataggtaacacttaatggtacttaatatgtaccaggcattgctataaatgctttacatgtcttatatttgtttaacctttccagcaacattaatgagggaaaaaaatacccaacgttagatcatatttccagtaacagagccactattttaacccaggcagtctggctccacgactatgctcttgtctactgtgcttatactgcctctcacatgagtcagaaacttgaaccctgggtttaggggttgggagaatctatataagagataaaagacagccgggcgcagtggctaacgcttgtaatcccagcactttgggagcccggggcaggcggatcacctgaggtcaggagttcaagactgcctggccaacgtggtgaaaccccatctctactaaaaatacaaaaaaaaattagccaggcgtggtggcacatgcttgtaatcccagctactcgggaggctgaagcaggagaatcgcttcccaggaggcagaggttgcagtgagccgagatcat

SEQ ID NO: 12281 - DNA, 1027 bp, Homo sapiens
cttagcatgttccctgcttctcattgagctttgccagtgaggttaatataatcctgtaatgatgcttttctttgatgttaaccaacagactctccaaagaagccttttcttctagctctcacaagagaaggcagatttttaggtacctctgtgtgatctatatctctcctttttatttttaattttattttgttttgctgtaatcttttcagcagagtgggtttgctccatgcatggctgcttgtggaataattaaatttgtggtttttgcaacattggatatttttccccatttaaaaaaatggctcctggtcaatgactttatttttattgttgctgatttcatttcgagtcctaaacaggtggtgaaggggaccaaataggtgtgtctgggataggtacagcttcctcccagaaattagctggaattgggcatttttgaaagattcaaacatatttatgataaggtaaaagaatgggtgtcttctggctaaccttttctgaatctatggaaaagatgtgtagacattattcctgacccagcataggaatattttttcttaaagatatctttaagaaaaaataatacatatatatatatagagagagagagagagagacatatacggacacctttatgtatgtagttttctcttgaggcaatgtaatgtgtaagatgacctcagaaaggacctggccaggcgcggtgactcacgcctgtaatcccagcacattgggaggccgaggtgggtggatcacgaggtcaggagttcaagaccagcctggccaagatggtgaaaccttgtctctactaaaaatacaaaaattagccaggcgtggtggtgggtgcctctcgggaggctgaggcagagaattgcttgaacccaggaggcggaggttgcagtgagctgagatcacgccactgcactccatccggcctgagcaacagagcaagactctgtctcaaaaaaaaaaaaaaaaaagacctaagggacctctctgccttagaatggacttaaagtgtgtc

SEQ ID NO: 12282 - DNA, 1035 bp, Homo sapiens
gggctctttagattaagaagtaccagtgacatcgtaacctagctgactatctgtgatgtgttcctctgcttcacttacacctggaaaatgactgccccactatgatagccattagcaaagctacagatgttctgaaagcacagacaatttataatagggtattagagctaattatgtacaacagtggactgtatctacctacaaccataacaaaggcaaagttagctcttctctttttttttctcctgatttctagtcttcaagcctctactaatgtatgtattctttgttagatccttgtagatttatcactttgatttcagcacttctaactcttgttgtggtagaggcatcaggaatctcagaaagtctagacaaggaactatggccaaagcccatcatactccaaagattccatgtggagaggagcctggctaaagggagctgattaggggtggagttgtggggttgggtgtgggagcaggaggcaggccaaaaagaaaggaagtggcaagaagggtgtttggatggaaatgctgctgctgcagccttctctggagcctgagctgtatattggaaaagctgcccagcataggctctgctctgcatggagctcactctgctcagcagctggacactcttggtaccttttcctaaagcttgggaatccaccacaatgctcacttcactcagctcagtggctttgtcaggaaatgatccccaaagggaatgtttcaggcttttaattttctcattttttctaggccctgaaaagtaactgcttccccaatatcccaccctccttgggtctcaggtcagaatgtctttcattttggccaatgtaggagacagaaatggaaaagccattgaggatgatttccaaaaacaaagtttctttctcttgtctcccttttcccttcctttgaacacactctttaggaccaaggacatcagttattattcccaagttaccaataaattcagagctaaaaaggaaataataattaggttaatactttcctcttcctccttttc

SEQ ID NO: 12283 - DNA, 1049 bp, Homo sapiens
caccaattacaggccaggagaggaaagatcatgatgaggatttagatggtaggctactcagaggtggtgatctccccagccatcccgtctggttacctcactacattttctagagaatgtaaggttcttctctatcctctattttcttattttccttgtctatctctctgtctctccccttcctccactgtaccttacttctcttcctttctctgcccctctttctatctgttctccttttctttctctttgtattgctctgttctctttcttctttatttctgtaatttgtctctccccttccccacctccagttaatatagttaagttcaggaaaaaaatgcttaggctttgagtttagcttcgcccttgggatttcatttccaaggccctctttgctgagctgtgtgtgatttgggtcttcaggccatggcattagtgactaaataaggaataatgccaggtgctagttctataaacctcctcctctactgttcagctctgctaaacacctgtttcttctcccgttccagcttccctctgtcctttgctttccctctaaagcagtgttgttccttttcccagggctattttctcgatccttactgactggaggctacctgattactagagggaagcaacccagtccttataaatagttgttattcttgatactgcgggggtgggaggggtggggatttggagagtccccagccatccagaaaacctgatctcccaaactgcatggtcagatgtacccagtgaaacttctccaggactggaaattttattcttttttttttccatttttttgatggcaactataaactttcccggtttctcttccttgctggtgtgcagtgagcttgcagtacgaggagaacttaactagcttaattctgctcatcgatctagatcagagttccattgcaggatggaaggaggagcaagtcaatagaagagagagaggaggaatatcaaagggtccgagagagaatatttgcccgagaggtaagtgtagcatctgagagttgtcagcccatagcttt

SEQ ID NO: 12284 - DNA, 1030 bp, Homo sapiens
ccttctgcattggctgaaaggactggaaatgaccttaattaaaggttattttggaaagcaaaagagagcctcagcctaagaaatacagttttatgcttagtttatcttccagtggatcttaactctgtattagtaacagtctgacccctcattactcgcctctgcctactttcagggcagtttcttttatcctagaagaaaatggtaaggagacttaaagccatgtgatttgaaagcttgacttaaagaagctgggaatgtttagagaaggaaataaggtaaagttttcttttacaaagagctgatagggaagcaagattaagcttgttctttatgactcgcacagaaggctaaacaggggccggtgggaggaactaccaaagaggtaaattttgcctctttaaaaggaaagtgttccaaaaagaaatggtttctttctggaggtgaagactttcccttcactaagaggtatacaagcagggacatttttcacagttactaatgagttaagaacctaattatggaagactacggttgtagaaaaatggagctaaggctgggcgtagtggctcacgcctgtaatcctagcactttgggaggctgaggcgggcagattacttgaggtcaggagttcgagaccagcctggccaacatggtgaaaccccttctctactaaaagtacaaaaattagccggaaattgcttgaacccgagaggcggaggttgccgagatcatgccgcttgcactccagcctgggcaatagagcgaaactccatctcaaaaaaaagaaaaagaaaaatggagaatgagaaagcttctaaatacccttacagttatgagattccatgattcccttgtgtctttggtagactttcctttctggtttttgactatttctccccttagttagaggcagtattgtataaagtttaagaaagcaagtaacaaagccagattttctggatttgagtcctggctctgccatatgccagttgtgtgcccttttaagcaaagtgtttaacttctctgt

SEQ ID NO: 12285 - DNA, 1032 bp, Homo sapiens
atctcaacagtgggcttaaaatactgagtaaattatgctgtaaacagatgcgctgtcatccaggtttctttgttctatttttagagcacaggcagagttgatttggcataattcttaaggccataggattttcagaatggtaaattaatattggcttcaacttaaagtcaccagctgcattagaccctaacaagagaatcagcctgtcctttgaagcactggagccaggttttgacttctcctctctagctatgaaagatgacatctccttccaataaaaggctcttttgtctacactgaaattattgtttaatgtagccacctttatcaattttcttaactagatcttctatataatttgctacagcttctacaacagcacttgctgcttcaccttgcacctttaggttatgaagacaatttctttccttaaactcatgaaccaacctctgctagcagcaaacttttcttctgcagcttcctcacctttctcagccttcatagaattgaagagaattagggacttggctgtttcactttcttaccatttgtgtgttccctgtagtagcacgtttaatttcaagaacttttcctttgcattcaccagatgggtaactgcttggcacaagaggcctagcttttgacctgtcttggctttcaacatgccttcctcacgaagcataatttccagcttttgatttaaagtgagagatgtgtgactcttcctttcacttgaatgcttacttagaggccactgtagagttattaattggcctaatttcaatattgttacatctcagtgaatagggagaccaaggagagggagagagatcggggaacagttgggtggtagaagagtcagaacatttacatttattgattaagttcactgtcttacatgggcacagttcctggtgcccccaaacagttacaacagcgacatcaaagatcactgatgccagatcacaataacacatataataataaggaaaaagtttgaaatactacaagaattaccaaaatgtgacacag

SEQ ID NO: 12286 - DNA, 1041 bp, Homo sapiens
gaagctgagccaggtggatcacctgaggtcaggagttcaagaccagcctgaccaacatggagaaaccctgtctctactaaaaatacaaaactagccaggcatgtcagtgcatgcctgtaatcccagctactcgggaggctgaaacaggagaatcacttaaacccgggaggcggaggttgcggtgagccgagatcgcacctccagcctgggcaataagagcaaaactccatctcataaaaacaacaacaacaacaaaaatctgagaaggaaattatgaaaacaattccatttacaatagcatcaaaaacaataaaatacttaggaattaaccaaggacgtgagagacttatacaataaaaactataaaacattgctgagagaaaagaaattaaagaaaatataaatggaaacacatcccatgttcatggattggaagacttaatattgttgttctttttttttctttttctttttttttgagacggagtctttttctgtcggcccactacaacttctgcctcctggttcaagcgattctcctgcttcagcctccctagtagaggctatttatatgatgtcaatttgacgtgggaatatgttactcataagagaaaaacagtaccagtaagcagcaaggaaaagagacgtctcaattatttttctctcccttcttactataaaatgattagggggaactagtattcacttagcaactactgtgcaggcaccttgcaattgttatcttgtgatttttagtggctctgtgagatatgtatcatgcctatcctacagataaggaggctgaggctcagtgacataattagtaagttgtagaaacagtagtcacacagccaaattcttgtggatctacgaagtccacaatcttatctactgttcttatgtactataacatgattgttgtctcctacattgtagagattaatattctttattttgataggttttacccctcattcaccataatgacgctcgtctttctccttgcagcagagatagtgttaggtacaagggtggtatacc

SEQ ID NO: 12287 - DNA, 1091 bp, Homo sapiens
accctatatgtcctgctgttaattttacctaattacgttttctaaataaggaaagataaagaactcatgagcaggtttctggaaccaggatccatgaataattttggttgagttttggatttggaatttttctgccttatttgcacagacagtttgtacactgtttctcagacctaaaaaataggtagttatgtaaaattccttgacattgtagtttagaacaaaattctaattttgatgtatgtagctaaagcgaagctttaggaagaaattgttatatatactcttaggtgtgagcataacagcccaacccattttttttttttttggattgagtatctgggcttccagtcgcttttcatgcaattccattttaataccgctgatttctagagggctgcagaggtcagtttgaaaaactcagtaaactagagcctaggaaaattaagggtttacctatctgtcaatgtgtgtttaggtaacatatgtggaaaagtacctttaaaaatatgctggtttattttctgtctttattttctcttctgttctgtgctttcatttactctgaattctttgtgtgaagtgaaaagagtaataatgtctgcttctcagcttacattaggtattcttatttttctatgatagttcaattatattaatatttattacagccataaatgtttcagaccaacacaatctatttttggggggtggggtgtggtaggaggagaaaaaggaagataatcctagggcaaatggagagaattctagaagaataacctatttagatgtttgccagagacaggagctataagggttaagggaaattccaccacatccttgcatcttgatattgcagcaaatttgtggataatttcttgctagcttttcaggaaacccctgtggtggacaaccctcattaatcgttgctgggagactgctctgacgtcactgggagcagttccctgtctgcaactaggacaggaatagcctttgagggggaagaaaactgctgtgaaattaaaagatgacggttttgtttacttggttttcctttcatttgagggtagataagatagacctaaagtctt

SEQ ID NO: 12288 - DNA, 1237 bp, Homo sapiens
tcctgaatattagacattttggtattgttcctcaggtccttgatgatctggtttttttttcccccaataaggaaatttttttaggccagttgcagtggctcatgcctgtaatcccagcattttgggagcccgaggcaggcagatcacccgaggtcgggagtttgataccagcctgaccaacatggagaaacccagtatctactaaaaatacaaaattagccggacatggtggtgcatgcctgtaatcccagctactctggaggctgaggcaggagaatcgcttgaaccaggaaggtggaaaggtggaggttgcggtgagctgagattgcaccattgcactccaacctgggcaacaagagcaaaactccatctcaaaaaaaaaacaaaaaacaaaaaaacaggagaagtttttttcctttagtgttgaaattcagtgttcacatttgatacctctgttgatctgacttcaaattcattgactctttcccctgtcatttctgttctgctgttgaactcatcaagtgagtttttatgttctggttgttatattttccagttctaaaattttcatttgattcttctttatatcctctgtttctttgctgagacattctgtcttttcattagtttcaagaatgtttgtcctaccttgttggaatatttttgtcatgtgaggttgttaatttcaacatttgcatcatcttcttgttttgactgttcatctcttttcttatacaaattcaaattatcttgattcttcatatgctgggaaattttagattgtatcctggaaaatttgaatattatgtcatgaatgtcagggtcttctttaaatcctgtggtgaatattgactttaattttagcagacattcaacctggttgtgttcaacttcaagttccgtgcagcttttcgtgagtgatgattccaaagtctgttcagtttttgaaggctttgcattgctatttagatctgccttgcatgtatatcacctacccactcatctgagatttggctgatggctattcttatagttcagaatgaccttaacgttaggagatacgtactgaattgttttaggtgtgaagagtcatcatgaaagcatgtcaaatagacctgaaaaaaatttatatgcacatatatgcatgcacatatgtgtatacgtaagtttgtatatgtatctaggtgattgttgtgctggttttgcaaattctttttatgttagaaatttctcaagt

SEQ ID NO: 12289 - DNA, 1569 bp, Homo sapiens
ttctttactggtattcatagaatgtttactaaaatagaccatatcttgggccataaaataagtttcaataaatttagaatttttttttttttttttgagatggagtctcattctgtcacccaggctggagtgcaatggtgccatcttggctcactgcactctccaccttctgggttcaactgattctcctgcctaagcctctgaagtagttggtacaggtgcacagtaccatgcccagctaatttttttatttttttgtatttttggtggacacagggttttgccatattggccagcctggtgtcaaactcctggcctcaagtgatccacccaacttgacctcccgaagtactaggattacaggcgtacacttctccacttggcctctattactaatttctaactaaatccctttatgacaaaacatactttgtgtatttaaatcctaaatttggctgggcgcggtggctcacgcctgtaaccccagcactttgggaggcctaggcgggcggatcacttgagattgggagttaaagaccagcgtggccagcatggcaaaaccccatatctactaaaaatagaaaaaaaaaaaaattagctgggcgtagcgtcacgcgcctgtagtcccagctacttgggaagctgaggcaggagaattgcttgaatctgggaggcaggggttgaaatgatccgagatcgtgccactacactccagcctgggtgacagagagaaactctgtctaaaaaaaaaaaaagaaaaaaagaaatgagtaacataacaatatctggaaaatccccaaatatttggaaacctaaccactctgaaactctgtcaacaaagaattaataagggaaattagaaaatgttaacagaatgaaaatgggaacatgatatggaaaaatttgtgggatgcaattaatgaagtgcttaatggaagtttatagcattaaatagttaggaagcagaaaaatctaaaatcattgaccttaagaaattagaaaagaagagcaaactaaaagtaagcaaaggagaggaaattgtaaagaccagagcaaaaattaatgaactaaaaagccaaaaaaaaaaaaaaaaaatcagcaaaactacaagctagttctttaagattgacaaaattgaacttttagccagacttactaagaaaggaaaagagaagacacacacaccttaccagtattaggtatgtatgagagagacaacatcactgatgattttccaggcattgaatatcatgaaccattcctttttttttttttcttgagatggaatcttgctctgtcgcccaggctggagtgcaatggcgcgatcttggctcacttcaaccactgcctcctaggttcaagcgattctcctgcctcagccttccaagtagctgggactacaggcatgtgccaccacgcccagctaagttttgtatttttagtaaagatggggttttgctatgttggccaggctggtctcaaattcctgacctcaggtgattcacccacctgcctcggcctcccaaagtgctgggattacaggggagagccaccgtgcctggcctatca

SEQ ID NO: 12290 - DNA, 1028 bp, Homo sapiens
tatttatcattgttgggagctgaatggagcactatgttttttcaccactgctcattaggacccacgtgtctgtcttcaacttggatgacatacctggttcatgttaaatcccactggtccatcctgggaaggctttgagataatataagaacaggccacagttggctgggtgcagtggctcacacctgtaatcccagcactttgagagtccaaggtgggtggatcacctgaggtcaggagttcaagaccagcctgaccaatgtggagaaacctcatctctactaaaaataaaaaattagcccggtgtgttggtgcatgcctgcaatcccacctacttgggaggctgaggcaggagaatcgcttgaacccgggaggcggaggttatagtgagccgagaccgcaccattgcactccagcctgggcaacaagagcgaaactccgtctcaaaattaaacaacaacaacaaaaaaggacaatctatgatatgttgtaaaatcattcggacttttggattactgttattttgtttcagcagcagtgggacagagagaagctatgccatatccttcccttagactatgctcaaagatattatgttatactggcttttctgatgatatttactttttgtttttatagttgttgcattgatgttactcatttaggaaaggtgaaagagaaatccctatgagaagcacaatgttaaatcaagattcattttagttataaatatgacctggatatttggagatatcttgaaattctctgttttgggggtttgggttgtgggggattggcttgttttgtttgggagtatttcttctcattgcctgtcttcttatcttactacagactataggcttggaagaagaatgacaaaacctaagcacaaggcagttatcttgaatgatatttcttaccttttctgttttgcaggacatcagaactgatgtttcttttttgttttcgttctatttttttctgcatcctgtctttcatgaaaatatttttctctcccttgatatcac

SEQ ID NO: 12291 - DNA, 1023 bp, Homo sapiens
gggacccaagtgggttgccccttttttaaaatttttttttattttttattttttttactgagtctcattcttttgcccaggctagagtgcagtggtgtcatctcggctcattgcaaccgccgcctcctgagttcaagtgattcttctgtctcagcctcccaagtagctgggattacaggcacttgccaccacacctggctaatttttgtattttttagtagagatgggacttcgtcatgttggccaggctggtgtcaaactcctgacctcaggtgatccgcctgcctcagcctcccaaagtgttgggagtataggtgtgagccactgcccccgtccccatatttctaaatatttagtagttataaatcaagatttttaaaaaaggaacttaataattttatttcactacagccttgaacttctggcttcaagtgaacctcctgcctcatcttcctgagtagctgggaccacaggcatgtgccacctcacccagtaaatcaaaattaaaaaactgttagaactttgaggggaaattattttttgagacagaataggatggttcagggatatcctacaagcctagtctccatctgtacccttcccgttgtttgtcccttgcccaccattcaggcaatggaacgtgtataacagaaggttattgtccatggaaggacaaagtttgagatgagaagaaatccactgaaggccctgattggggtttggggctgcttaggcaggaaaacctgggatctggagcatagctgagagtagtcgagtaaggctcttcaggtaggtatgtcctctggtcccatggacatcttgccctgagggcatgggcaagtcagaggagggtcatagtggttctatcttcaatgaaggacccagaataggtccaagaccaagagtgccagaactcaaaactgggcccctttgaccatgctgtctgttgttaatagtaagaaagcctgggtttacagaatgagatgatggcttactctggttgatggagaggggttagaaagc

SEQ ID NO: 12292 - DNA, 1011 bp, Homo sapiens
cacaaaaaattagccagtcgtggtggcatatgcctgtagtctcagctactagggaggctgaggtgggaggatcacttgagcctggggttaaggctgcagtgaatcttgagtgcaccactgcacaccagcctggacaacagagcaagaccctgtttcaaaaaaaagaaaaataataccaccagacagaccaagatggaatccatgaaagcaaatccttaaaatgagacccacaaacagctctcttgattatagtttatctgaaattggctctacttttttgccctttcatgtcccctttttgcccatgataggaaacagagtgatgacatagcatgtaataatagtttcattttgttacagatttgctgtgggccagacaccctgcaaaattactttgaaaattatataatcacagtatcctatgaaaggtgttttttgtttgtttgttttttgttgagacagtgtcttgctctgttacccaggctggagtgcagtggcatgatctcagctcactttaacctccgcctcctgggttcaagagattctcttgcttcagcctcccttcagcctcccgcgtagctgggattacaggcatgcaccaccacacctggctaatttttgtatttttagtagagatggggttttaccacgttggtcaggctggtctcaaactcctgacctcaagcaatccgcccacctcggcctcccaaacttctgagattacaggtgtgagccactgcccctggccgaaaggtttcaacttgcttattttacattgagataaagagaggcttagagaggtgattacttatctaggatcacaaagcctggtatgtgatagggctaggtaggcatggtcctaatgttatcaagcaaaaggggcttgctgcccaatgcactacaagccaatactatgacactgagtttttgagaaaagaaaagcttatattgccagttgactcacaggagtcaagctcaaatctgtctcctggtgcagtaattttattagaa

SEQ ID NO: 12293 - DNA, 1072 bp, Homo sapiens
tgtcctgaagttagaggaagcactaagtgaagtagccatatatatataatttattttctggtcaggccaagctggcttacatattatattgtatatattacatatataggcttatattttgatgttggaatattagataaccacttcatatttgctttttgtggccaatagcttatttaacaaatacttaatcattgtgtcagagctatctgagagtaagggatatagcagtgaagaaacagaaaaaaatcccttcccttattgagcttatcgtttttttcattttctattttttttttgagacggattttcgctcttgttgcccaggctggagtgcaatggtgcaatctcagctcaccacaacctcctcctcccaggttcaagctgttctcctgcctcagcctcccgagtagctgggattacaggcatgcgtcaccacgccaggcttattttgtatttttagtagagacagggtttctccatgttggtcagactggtctcaaacttctgaactcaggtgatctgcctgcctcggcctcccaaagtgctgggattacaggcatgagctaccgcatctggcctcattttccaattttttattgtgttaaaatccacataacagaatttgccatcttaaccataacataaaatttaccattttaacagaattaaccctcttaacagttcagtggtattaaatacatttatgatgtcatgcagccatcaccaccaatccttctccataattattttcattttgtaaaactgagaaattttgtactcataaaacaataattccccattctcctctccccctttcccccagccctggcaagtaccattctactttccgtcttctatgattttgaatattctaactacctcatataagtggaattatacagaatttgtcgttttgtgactggctttagcgtgtcgtcaaggttatccatgttgcagcatatgtcagaatttcctttttaaggctgaatattattctgttgcatgtatataccacatttggaacaaatccattcatttgttgataaacacttgcttctaccatgtagct

SEQ ID NO: 12294 - DNA, 1020 bp, Homo sapiens
aaaaaaaaaaattagccaggcatggtggtgcatgtgtatagtttcagctactcaggaggctgataggaggattgcttgagtctgagaggttgaggctgcagtgagtcatgattataccactacactccagcctgggcctcagagcgagaccctgtgtgtttatgtctctgtctctctctctctctatctctatcccctctctctatatgtatgtatatataaaattgcaattctcagcctgcccacctaattctcactttcctgtgaataacatcaataaacatgtcacattttagttgtgatttatgaagtcgataccattttccttctctcagtaagttatattgtttaattctagaatcctattttcttttctttattagagatacatctgaattttatctttttgatgggattcatttgcccattctttttttttttttttttttgagatggagtcttgttctgtcgcccaggctggagtgcagtggtacgatctcggctcactgcaacttccgcctcctggattcaagagattctcctgcctcaacctcccgagtagctgggattacactacagatgcccagctaatttctgtattttttgtagaaacagggtttcgccatgttggccaggctggtcttaaactcctgaccttgtgatccacccactttggcctcccaaagtgctggcattacaggcgtgagccaccgtgcccggcctcatttgcccattcattcttatttttatgttaatttttttgagacggagtttcgcttttgttgcccaagttggagtgcaatggcgtgatatcagctcactgcaacctctgcctcccgggttcaagtgattctcctgtctccgcctcccaagtagcagggattacaggtgtgcaccaccacgctcgactattgttttgcatttttagtagaaacggggtttcaccatgttagccaggctggtctcgaatgcctgacctcaggtgatccttccgtctctgcctccgaaagtgctgggatt

SEQ ID NO: 12295 - DNA, 1027 bp, Homo sapiens
ttcttgttactctgttagccagaagtggaatcccctcccccaacctgtaaagttttcattagcattattacacctattgttactgactactatccaataattcctttgtttctcgaattcttgaaaagggaacggcagccaaatagagctcagacaaaaaagatacttctgatgttgttcagtgtctcttgaagcccacataattccagaaaattgcaaatcaatcagatacaggcttagagctagaagtaggtcagctaccatagcacaagatgatggtgtgaaaatattttagtgacagcttgtgcatgataatatatcctttcttgttcagggttctttttggatataatgctgaattctgggtgttatcatatgctttttttctattctaatctttttattctttgttaaaaaatatggtcatgtttataaaatcacaacttctacatttaaagggtaggttgaccaattaaagcagcctttccaacctaagtgcatctggctaggtaattctctctgagctttattatttgttttagagcttagatcagagtttgacaatgtagtgtatatactaagatttcttaaagatttatctgtgtattccaaggtgtgcttatctgtgtaaaaaactcagcaagacatggcattgccacaggctatcaaacatttgaaatattcctttggagttattttctggaattaggccacttttcaataattagatgactttgagctcttggagtcatctcctagaaccacctttggaatagagctgcctctgtgctcgtcttaccagtagagttttatttgtatttccagcctgttgcttctgctgatgaacctgggtatagctttgtatattagtcagctattttcaacattgcctatcatggtgctttgcaagtggttactcagtagttatttgctgcatgaacgaatgtctcttcattgagtcactgcatcagtcacttccctcctaacgtttcaggggatctttccttttcctcccatctctatcctt

SEQ ID NO: 12296 - DNA, 1070 bp, Homo sapiens
cctgaggaatcgccacactggagtagacagtgtttttatatgtgaaataaacaagattctttggcaagtcagtgacttgtcagtccatcaggatgaatcagcggaagtcctaggtgaggtgagaatgtcagcacagtgagccccttgccctgagtttatcgggcatcccattaaggtagctgtcatagctcctattttagagaagagtaggagtcattgttcaagatttagcttactttaaaaactttcaggggggaaggtcacttttagtataatgacaccattagaagtggcatgtggctgtttttcagattacagccattttggtgtgcccaagtgttaccagttgttaggatctttaaaacttgtcttcaggtgactagaggctatgctgcttctccaagtaagttttattaattgtcttgggtcctagacaagttaactgtagtttctgacttatctattgcctaaacctgtgataatttgatagaaataggaactaagaggtggcattttattgcaaaagatggatgttggctgctaaatacagctgattagaaggctaggacaaagtgtctgtttttctggtgacggggtcattattaaagctttattttattttattttattttttgagacagagtctcactctgttgcccaggctgaagtgcagtggcatgatctcagctcactgcaacctccacctctcgggttcaagcaattctgctgcctcagtctcccgagaagctgagattacaggtgcacgccaccatgccccgctaatttttgtatttttagtagagacggtgtttcaccacgccagccaggctggtctcaaactcctgacctcctgatccacccacctcggcctcccaaagtgctgggattacaagtgtgagccaccgtgcctggcctaaaggtttatagaacgcttcagtagtcagatggctgagttcagctcctttccactcctgtgaagttatctttaagacatttggaatccttcatagaagtcttatcagcagtgattctcttataggtgtttgctacttgggtcaatttagcctaaa

SEQ ID NO: 12297 - DNA, 1071 bp, Homo sapiens
tgattgtatcatgatttttttagtagcttatatgtttaaaataggatccaaataaagtctgttatagttggtcagtgcatgtttaacatcttttaatttttttttttttctcttgagaaggagtcttgctctgttgcccaggctggagtgcagtggtgagatcttggctcactgcaacctccacctccccggttcaagagattttcctgcctcagcttcccaggtagctgggattacacgtgcccatcaccatgcccagctaattttttgtgtttttagtagagatggggtttcaccatgttggccaggctggtctcgaaattctgaccgcaagcaatccgcccgccttggcctctcaaagtgctgggattacaggccaccatgcccaccctaaaatctctttttctaaaagactttccctcacttattttccttcgtagtttatatattaaagaaattgggtcatctgtccagtagaatttcccacagttaactggattaattgattgacattattgtggtgtcatttaacatgttctctgtctcccatattttcttcaaattggtagttatatctagatgatcaggttcagattcaatatttttggttagcatgctttatgcagtgttgtatacttccatcaagggcatgtgatgtctattaatctcccttttatgatgtcagcagctgttgataatcattgcctagatcccttacttcattgaacttcattagagattataaatggtgatactcaaattctatcatttcttaatttttttttagctgcagtactttttataaaagatactcccctcatcgcttatttggttactctgaggtacaatttgtataggacagaaaagacaaatgcttaagtcttttaattaacagttatgaccattttcaaaataattagtttgtttattaacattttctaaagttgactgatgagtttttaaaaaatagtcattatggactcttcaatttaaatatatttaatgtgtttaagccaatttcagtttttttttttttttttttgagacggagtttcgctcttgttgcccagg

SEQ ID NO: 12298 - DNA, 2016 bp, Homo sapiens
tcagcctcccaagtagctgggattacaggcgtgtgccaccatgcttggctaatttttttgtatttttagtagggacaaggtttcacaatgttggtcaggctagtcttgaactcctgatctcaagtgattcgccccccttggcctcccaaagtgctgggattacaggcatgagccaccgcgcccggccaatactttgtgttttgaacctgcttcttgcattcatctgcatatatattttacatattgatctgtgaatacaatctagaactcatatgaagttaggatgtgtatttgtctgttctcacactgttataaagaaatgctggagactgggtaatttataaagaaaagaggtttaattgactcacagtttcgaatggccaggtaggcctcaggaaacttaaaattatggtggaagaaaaagcaggcatgtcttacatggcagcaggtgagagagcatgtgaaggaagcaaagggggaagagccccttacaaaaccatcagctcttgtgagaactcgctgactatcacaataacagcatgggggaaaccacccctatgatccagtcacctcccaccaggtctctccgtcaacacccaggtattacaattcagggtgatatttgggtggggatacaaagcctaaccatatcggggtgttcaatgtattgaatgtttctgttggagcatagttttatggttcttgatgaggtctcatgttttagaaagtccaaaatagtattagtcttggaattgggatctggtatatcaaaatcacttcttattcaacagcttgagaatgtactgctctgggactctacatgaaaccagacatgtcagtcttgtccacaaaaatattttgcactgaaggtgaaacccattaaatgtatctgcatattcctttgatgtggaaacatataaataagctgcacagaaggtgatgatgtgttagtaacatgttcctttgaaatagttacaattctgcatattaggccatggctcatgcctgtaatcccaacactttaggaggctgaggcaggtggatcacttgaggtcaggagtttgagaccagcctggtgaacatggtctctactgagaatacagaaattagctgagtgtgatggtggacacttgtaatcccagctactcaggaggctgaggttgcagacagccaagatcacaccactgcactccatctagcctgggcaacagagtgagatgctgtctcaaaaaaacaaacaaaaatcctgcatattattgctattgaggaagtataaaatattgttttgatgggggaagttggtcattttcagacattttagctggtattttaattaacttactaacttattagttgtgtgccttatatattcttttgttttatgtggatgactgctctaagattacttaataaatgagctgcctggtaacataaattgcagatattaagatgaattgtatgctttcccattatttctgttacttggccaaattagaaccatgtagagctctcctgtagaattgaaatccactattttttccctactgtctctccaaattatactttataaatagaatttctttttatttatttagagacagagtcttgctctgtcactcaggctgtaatacagtggtgccatcatggctcaccatagcttcaacctctgtggctcaagcgatccttctgcctcatcctcccacatagctgagactacaggcacacacaccatgactggctaattttttaatttttctgcagagacagggtcttgccatgtagcccaggctggtctcaaactcctggcctcaggcgatcttcctgcctcagcctctcaaagtgtcggaattataggcgtgaaccattgtgcctggccactaaacatacttcttaataaatatacttcttaacacttcacctggatggatgaggcaatacatttgagcttgagatcaggtgagccttacacttgggtgcttgtgggagaattttatgatgctggaattgttttgcatg

SEQ ID NO: 12299 - DNA, 1021 bp, Homo sapiens
tgtactccagcctggacgacagagactccatttacaaaaaaaaaaaaaaagaagatatcaaagtcagggtagcctagagtatgctgggtaaaaaacagtctccatatctcagtagcttgaaacaattagtttcctttccactgtcactacatgtccatcaaagataggctaaagacttttagttgtacaaggacaaagaccaacggcagcctgcgcaaccaccgttgggaatattgccagttgctctgctgaaggcaaaagaaagctctggaggccttgccccgttaactaaatgttctgcgcagaagtaatgagaatagaggagaggaatcagagctgaaaagagcagatgaatgtgagatggttccagaatttggagattgtttaaatgtgggaagaggggaggaattgtggatggatgacgctcaggtttgtgtcttgggcaaactgggtggtgttgcttactgagataagaaaagggtaggtttgggattagaggaaatgttggtagagagttcacttttggaaatgtctagcagctagttgtctaaatggatctggagtgctagagagaggcaggggtatttagatttggaagtagtctccacaagaaggtttaatctgtgatagggaacagggttactcagggcaaacttaagaaagtgataggagagttgacatcgagccccaggaaataccagaattttaggaacactcctggcctgatagcattggattttaatgttaagattgacatttttgggaccaaggtagcctatgcccattcctgacagataacccagtaatattttgaggaaggagcaaacataagctggtaagctacatttcccatcacgtgctatattctttagagaatgttagttctcacttacttgtgccagtggaggactgttattggtccttggatggaatgcattataattctttgattttggatatatttggcaaaaattttgacagtgacctgtaagttgccaagacatacaaaaaaagaacaaat

SEQ ID NO: 12300 - DNA, 1055 bp, Homo sapiens
gttccaccaatattccccccccacccccgcccccctttttgttgctggggtatcaagacaaaaggttgtattttgttttttgagacagggtctcagtctgtcacccagaatggagtgtagtggttccttttcggctcaatgcaacctctgcctcctggcctcaagccgtcctcctacctcagtcccccaagtagctgggagtacaggcatgagccaccactcctggctgatttttgtagagacgggtttcaccttgctgcccaggctggtctggaactcctgggctcaagtgatccacctgccttggcctcccaaagtggtaggcttgagccaccgcgccgggaaagacaaaaagtttaaatagtggtgaaaagtggccggttagattaattcagttcagtttttagttgtatttttcttaccctgttgctgttctccagagagttgagagaaaagataacttttttcttgaaggcctgatgaactcctaacaagttaaatttcagagttgaagttccatttgtctttgtgtccattatatgattagtagagcttcacaatttttttttcgtagggatgggatcttgctatgttgcccaggctggttttgaactcctggcctcaagtgatcctctggcctcagactcccaaaagcactgggattacaggcgtgagccattgctcttggcagagcttcacaatgtaaagttttaaaaaaatttgacaaataaaaatagcatgcctgactggccgggcacggtggctcatgctgtaatcgcagcactttgggaggcgaaggcaggtggatcacctgaggtcaggagtttgagaccagcctggccaacatggtggaaccccgtctctactaaaaatacaaaaagtagccaggcgtggtggcaggcacctgtaatctcagcttcttggcaggctgaggtgggagaatcatttgaacccaggaggcggattttgcagtaagccaagatcgtgccactgtactccagcctaggcaacagagcgagagactgtctcaaaaaaaaaaaaaaaataatagcatg

SEQ ID NO: 12301 - DNA, 1044 bp, Homo sapiens
aggagaatcgcttgaacctgggaggtggaggttgcagtgagccgagattgtgccactgcactccagcctgggcgacagagcgagactccgtctcaaaaaaaaaaaaatcattgagcttttgttcatatgatttacatctatcaattcaccacattagaaattaaaactgaaaaagactgtaacacaagaccatacaagcacacattccattaacaatgatgtcagaaagatgatgtaatcacatgtcacacggcctctggaaaactccacaatacaattttaagataatgagaattcaaaaggcaaataacatgttagtattattatgaaaatagctttgactttgtggacacccctgaaaagggacctcccagaagcctacagagtacacttgaagaactgttgctctggaccatcaccctaacccttctttatgactcacatttgttgattttctttctcctttttattaagaaagtataagccaggcgcggtggctcacgcctataatctcatcacttcgggaggccaagtcgggtggatcaagaggtcaagagattgagaccatcctggccaacatgttgaaacctcgtttctactaagaatacaaaaattagtgggcgcctgtaatcccagctgctcgggaggctgaggcagaagaatcacttgaacccaggagacggaggttgcagtgagccaagatcgtgtcactgcactccagcctggtgacagagcgagactcgatctcaaaaaaataaaaaagaagaaagaaagtataaatgcttgtctcccagtgggtcctgtcccctgggaaaaaccagggaacttcttaggcttagtgcctcattttcctgactcctgtttctgggggtcccctaagcatcctccctcagcgccttgcccatctccctcttgaccttcccttaaggtacctcaacagcccttaccctgggccagcctgcttaccctgcttcaagcctgctggaccatctatctgcttcctcctcccctcacttgaggactttctcatcttgggagaggcta

SEQ ID NO: 12302 - DNA, 1033 bp, Homo sapiens
aagaatcacttgaaccgaggaggcagaggttgcagtgagccgagatcgcaccactgcacttcagcctggcaacagagcaagacttggtctcaaaaaaaaaaaaagaaagaaaaaaagaaaaagaaaagtaagttgcctctcccccttccaaaaatggctgacatttctctttgttgcccacagtgttcaagaaggaagtgtatcttcatacatcaccacacctgaaagcaggtaaacttaacctacccttttccaaaaattttaaacggcaggacagtaaatattttagatgttaaaagtcctatagtctctagcgtgactcttcatctctgccactgtagcaccaaagcagccataaacaatatgtaaataaacagatgtggctgtattccagtacaactttacctacaaaaacaggcatcagaccagcttgccaacttgtggcatagactgtttgctacatggagcttgttccagccactccccattatcctgcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggtaagaatgttagccctaaagctaaagggggatgttacctttcccttctcaactaatatctatgttccctttcctcatttccttgaaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatg

SEQ ID NO: 12303 - DNA, 1050 bp, Homo sapiens
gaatgaaaatgctctctgtccctgtgactgtccagaacctctgagactcaccgtctatgtgttgaccctcttctactccccgctttccctacttaggaacgtaaataagaaagtaggttccatctgcatagtgcccgcccataataagggcttaacaaatggtagctatgattaatttttttcctgggtctgtaggttatgcctcccattcctcttttttaagaggattaaacaaaagaggatgggtgggattggcctggattggggctttcacagggagaagtggcatattcctgagtatgaacttcagagaagatggttgtctatccttagcctgagcccttcccagttgataagaggccagagatcacacagctattagatgggtgggtgttctggccgtaacatttcagaacaggttaaagagataatcatttgggactcaaatgtctctccccccgggcacttgcatatgggacattgagtccttttgttttcccttgatctatagctcttacccctctgcccagtaattccctgaggaagaggtaaagatcaaagttgatactttgtcctttccttccttcttcccttatttttaaagctgtcacccacactgattcctgctctaatagcagagcagagatgaaggaaggagcttccttctatctgcttttctttctcaatgatgtcccaccatgtccccctcacaccctctccccacatacctacacacaggcagagattctcagtcctggctgtaggttagaatcacctggatatctggccctaccccagaataattcattagaatctctagaagtgggcccaggcctttttttttttttttttttcttttctctctctctctttttctttttttgagacagggtctcactctgttgcccaggctggagtgcagtggcatgatctctgctcactgcatcctccacctgccaggctcaagtgacccttccacctcagcctcctgagtagctgggaccacaggcacgtgccacaatacccagctattttatattttttgtagag

SEQ ID NO: 12304 - DNA, 1055 bp, Homo sapiens
gaaagaggaatcttggctgggaccctagcatcgtctagggaacagagaggttgtgattaagaggtatctggatgaaatcttggtgaaaggaagcacttgtttttaatcccaccatggtttttcatatgcatacaaccatcctcaaccatctgcccatcagcagagctcctagaaaggcaggacataccactggatatccccttctggcagttctaaaccagccttgcccggaagtgggagccttatctatgtggcccagactcaaataaggcctcttggaaatactctcacccttcccctttgtttaccctccaacccctgtgaatcttgtgaacagagggttgaagaaacatgttctgcacatgtgctagtacctgtgaatcttgatgtcccctggaccctctgtgtaagtacatcatggcagaattgctctagatccttcggagctgcagggtgagttaccagccactcaaggtggaggcaaacatgccaggctgcacaagggaccaggagcagctctgcctcttcccttgcaggaggaaatgagaacggggctatacttaggtacttcatcattcctttaactcaccatctgtacctgacatattttgttttgtctcacctaaagtcatatcagacttcctacctgatcactctcattgtgactgattctgccatccaaatgtctaatttttcacagctagagaaactaagagataggaagacaagggccatgaactaagaaggggaactcctctcctgagaattattgaccctctatcagctacaagtctaagaatttctaacttctgcttcatcttctaccatttctaatagcttccccaccacctcagccttctctccccagtttcttattccatgccactggctggtaacatctaactcctagttttcagatgatcctaaactgctgctgttaatggcaaagcttcatgacatcctcaccaccagagggaaaagggtctcatgctcttctttctcttggggtatatggtgaccccagctgaaatttcttggcccctaaatttcgctag

SEQ ID NO: 12305 - DNA, 1030 bp, Homo sapiens
ctactatccctttaaaacaattttagcaggaagtaaaatcttctaaaacaggaatggaccaggaaagtgcacgggctgtagccctttcctcctcaatctgggaagatctctttgcacttcagacactcccaggttaattggggcaataggcttgcttggagatttttcttaaaatgtttggaaaactaattcccaaatagaattccacccacacacacaccccgaccctaacccctgggcccacagcctgccttgggtcagtgaggctttctgctcatggcttttgaactgctggaataagggaagtaaattaagaaaaacctcattagaaacaatttagcttctctctttatggcataactacccgcagtaaaaggggaaaaaatgacctagccatagtttgatggggccctggcagaggcttcatttctccaaaaggtagatattactggacactcctgagatgagaaacagtacttccttacagtttagaagatcctggagtatgcttgattgtgttcattgactgttggcgcacttgaacttacctgagtttttcctaatgcttcccccatcctccctcctcaccaccttgcctggacactagtttgcacaagtaagaccattcaatgcttcttctctgcatgtttttttcatctgccatctcgcatgcaatgctctgccactgtgctattgttgtagctaatcgttttaaattccagtgagtccctggctgggtcactgaggggcctgctggccttatgtttaaagatcattaatcaagggttagaaacagctatgatccatgaatcattgtctcttccccttgtgaggtctgcagagtaaaactgtccagtggaggatgggatagaagcatggaggctttaaatgtttttgaacatgaggcatttaggggctggagttagaaggcagtttcctttctcctcctcagactaagatcaaatgaagatttttttatggaatgacttttagctattctagacaaggatagaaaacaaaagggatgaca

SEQ ID NO: 12306 - DNA, 1917 bp, Homo sapiens
actctggtaccgagctcccgaagttcttctgcagtccacatatgcaacacctgtggacatgtggagtgttggctgtatctttgcagagatgtttcgtcgaaagtatgggacccacataccctggactaccttgaattccccaaatcgcttgttcataaaccacatccataccttgcccattctttttttttgagaccagggcttgctgtgttgcccaggctggattgcaatggcatgatcacagctcactgcagcttcaacctcctgggctcaagtgatcctcccatctcagcttcccaactagctgacactacaggcacgcacctccatgcttggctagtttgttaatatttttatagagatggggtctcagtatattgcccaggctggtcttgaactcttgcactcaagcaatcctcccacccctacctcccaaagtagcataagctactgcatctggccccattcttttacttgcgtactactaacttgcccatagcagaaagctctgaaatgttctggaattaggaacttcatatccctttattctctttattttttatttatttatttatttatttatttatttatttatttatttattgagataaggtttcactctgtcacccaggctggagtgcagtggcccaattacagctcactgtagcctctacctcctgggctaaagcaatcctcccatctcagcctcttgagtagctgagactacaggtgcacgccaccatgactggctttttttttttttagatggagtcttgctctgtcgccaggctggagtgcagtagtgcgatctctgctcactgcaacctccacctcccagattcaagcaattctcttgactcagcctcccaagtagctgggaccacaggtgcacgccaccatgctcagctaatttttgtacttttagtaatgacagggtttcaccatgttggccaggatggtctcgatctcttgacctcatgatccacccacatcagactcccaaagtgctaggattacaggcgtgagccgctgcacctggcatttctttttttttaaaaaaagagacaaggtcttgcttgcccaggctgatctagaactcctgggctcaagcagtcctctcacctcagcatcccaaagtgctggaattgttggcctttattccctatacttcctattttgagccactaagcagtaaccattcaactaagatatctttgaaaatgactgctaccttatatcccttctcaccttaggcctctcttctgtggaaactctgaagccgaccagttgggcaaaatctttgagtaagtgaccaacatgggagaaaaagattttctattctgagtcctctttctgctgaacccaggatggcaactggctctgcccatggggatgggaactggaggaccctcctgaccagagttctcctgtcccccacagcctgattgggctgcctccagaggatgactggcctcgagatgtatccctgccccgtggagcctttccccccagagggccccgcccagtgcagtcggtggtacctgagatggaggagtcgggagcacagctgctgctggtactggagatggctgtgggcacagggaaagaaatagagactggggaaagaaatagagcagtatgcagggccctggccactgtggttaatgaaacttggttggtagatgggctgtagtttttattacagctgcaaatagccacccacagagaaggatatagaagagaacccatcctggctgggcacggtggctcacgcctgtaatcccagcactttgggaggccaaggtgggcgtatcacctgaggtcaggagttcgagaccagcctggccaacatggtgaaacctcgtctctactaaaagtacaaaaataagccgggggtggtggcacacgcctgtaatc

SEQ ID NO: 12307 - DNA, 1126 bp, Homo sapiens
aagcgttttctattgcagggcctcacgtggctggaggggttggtattgagtcattgtgttatctctggggccggccccaaggaagactgggagcgggggatgggatgctggtggtgttctttgcgctttttttttgggagtccctttgttgctgcaggctcataccatcctaactctgtaagcgacttttggtgataggagtctgtgattgtagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggtgagaaggtggtggagggttgggcgtggggagtaaagggaaaagacagcctataggtggggtgtgatgatctgtagagaagtggggaccctgaggaaataatgagaggccatgttgggttaaaggggattgaaaagtgagcatttactctggtcaggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggtgagtggggttggtaggcattgagaggtggattgggacctttgtagtagaaccttctgggatttcaggtatggtgcctagtttccagtgcatctgtacctcccctttgaaactaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggtcagtagaaagatggtaccaaaatgggttctggttgggagtaggagagtgattgcccgtagcaattgagaagtcatgtgcttcatgtgttcagtcaa

SEQ ID NO: 12308 - DNA, 1076 bp, Homo sapiens
cggtagggattgggagaggaagcagactggaactgtgggctccaccagagaagtacacccctccaggaagacccagccaccctctagggctctggggcgagggagggggaagcagcagtcgggagattgacaccacatcttccccccaccaggtgcctgtgcagtcctggtttgatgacatggcagacactgagttgctgaacctgatcccaatctttgaggagctgagcggagcagaggacgtctacaccagccttgggcagctgcgggccccttagcctgccctgcttccaagcgacggccatcccagtaggggactttcccacactgtgcctttacgatcagcgtgacagagtagaagctggagtgcctcaccacacggcccggaaacagcgggaagtaactggaaagagctttaggacagcttagatgccgagtgggcgaatgccagaccaatgatacccagagctacctgccgccaacttgttgagatgtgtgtttgactgtgagagagtgtgtgtttgtgtgtgtgttttgccatgaactgtggccccagtgtatagtgtttcagtgggggagaagctgaaagaccaagactcttcccaagttagcttgtctcctctcctgtcaccctaagagccactgagttgtgtagggatgaagactattgaagactccattgccaaaccatggcctttcctcagtgttgtaaggcctatgccaaggataaaggaagggtatgcctttgggtactccaggcacacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgccttcctcaccacctagccatagtctcaaacctgtggggaaggaggttttctccctgcccgggaagaggacagataactgatttccgttcttttgactgtgttttaaaattctctttctaaa

SEQ ID NO: 12309 - DNA, 1029 bp, Homo sapiens
tggcattaaggactcaggtctgaaagaagagacagccatatagggagctctcctgcccagggaaagggaactaatggagacactggcttaggtagagctgccccagttgctggtgcagagagggcaccagcatacaacatgctggtatgggccaaacagcatggctaaaactgctttttaattttttaaattttatttatttatttatttattttgagacagagttttgctctgtcccccaggctggagtgcaatggtgtgatctcggctcactgcaacctccacctcttggattcaagtgattctcgtgcctcagcctccggagtagctgggattacaggagctcactaccataccctgctaatttttgcatttttagtaaagatggggtttcaccatattggtcatgctggtctcgaacttctgaccttaagtgatccccactgcctttgccccccaaagtgttaaaactgcttttttcaaaaaatgcccatgcagttagatacacagctactttttggaacttcgggagccggtgctaagctgggtccggccctgccttgcttgttagctgtagagaacagtgtcagtggccaggcatgaaagcagtacaccctccccattgtttgcagtcttttgtgtgtgggggctgtctaggcatctcaccctcttttgttccctgccgactcacctgctggtcccaggagctcttccgtccacctggcactttagggcatgtccatagccaaggaacagatgccccttgcagaggacctgggaggacttctctccatgggggagtcccagtcaaatgtgtcttggctgcagggttcaggcagccgtccaagaagggccggaaatgctccaaatactctccttcctccaatagctgagaggaaggaggcccctcagaggggccattttatagtgatagccaggctaaggctaagtcctttgctgtgggggatgggaggtggtggggaaggaagtacttctggggatgaaccaaaaaagaaagcaactttctac

SEQ ID NO: 12310 - DNA, 1068 bp, Homo sapiens
gaccaacatactttaccattccttcaatcactttaatttcattatgtttggttaatttttcttcttgataaaccagttgtccctcagtatactccagggattcattccaggagcacctgtgtataccataatccacacatactcgagtcccgtggttggccctgtgaaacccacatatttgaggtcaactttccttatatgaaggtttggcatcccttgaatattgtacttttggtccatgtgtgtgtggttttttctttttaatctccatataaatggacccatgtagttcaaattcagactgttgaagagccagctgtgtattccttaggaattattttaacctgttaaaaaatatgttctcatggcttttgtgggtctaaagatatcctcatcttgccctaacttgaataatggtttagtgaataaaaagtattaaattggtggtcgttttacttgactgtctttcagaatcgtttgttgaaatctgttctcactctattgttagtgctctgctactgatccatctttccgtctggtagcttttaagtctttttgctttatctctcatccttttcagtttcattgtaatggttctaaatgtgcgtttatttaacatacctgacctgatgcacatttaatctgaaaatttgttataattctggaaaaaccttgcccttttagaaaactgcttacctgtctttccatttactcttaaattctcaaatccctttaagatgtgttttggagcctcaaataatcttttatatttctcatttactctcacatgttctttctaggtgaataattatcttaattattaagattaattatcttactgctctaatttttagctgcaatctaaaaagtccttttttatgtcaaggactgtatctttacatatgtcagaatgctagatgtttctgtttttagccatttcttattaaattgtatccacctgcttgtgtttcacaaaattatatggtgctttcttgtgtctctgataatcttaaaattatttcaaaatcaccaagattgttgtatttttattttttcaaaactgacaga

SEQ ID NO: 12311 - DNA, 1085 bp, Homo sapiens
tgtgtgtgagagagcaatgacagccttgaatgtcaaactggtaaaaaatggtttcttgaatgaggctgccatgacatccgactagttagtgtaaatgcctccaaaagcaaagtcagaggtgggattttacttgatgatgtgtttaatctataactaagcctcaggagctttctgggtagcactgtgtgtggcatctactccaagacaagggtttggggaggacttaggagctcagcttgtcagccatgtggaaaaagtggttttgggctcccacggcctttggggtggagttgtgtgctctgcatgattgtggtttggtatgtctggtggcttccaactgaacccgcagtcgaagggtggaaaacaacatcctacctagcaacaactgctagtctgacaagctggactacctttggccaagaaaaccagccttaaggtccaagtcggtggtgttagatgctggctggcactgagattaggtagtgaattttttcgtctgatgcatggggataataggatggaagagctgaggtcatcttttcactgaacagagagatggaaaaatcagccacaacttgccatgttgacaataaaatttaaaaaaggagaattttcaaatattttacccaacttctacgaaatgttatgttttatcacagtgtaattatttatattccttttttggaaaaaattaaaataatatgctttgtataactgaggcaagaatttgattcaattgagtaatatttggctacaattaatgaagaaagggcaggacacaggtttattttgaaagaaaatttctttatttagcctcagttaacttggatgttaccatccaacacacccgtcaccaaaattgggctctcagctaggatgtggggaaacttatattggggaactttattgcatgaccattaacattactacaggtcatgagaaatgataaagaatagatgcatttgttcagtggatgtaaatatgagggaaggcaaatgtcttttgctccattctagaagtgatctggctgtaagacagatgtacatgtatgtgagtgccataatgtggacttgtagaaaacactt

SEQ ID NO: 12312 - DNA, 1083 bp, Homo sapiens
ccccagccctcagtttatttcctgttagccttcccagatggtagcatccaagctctactcaccagactggagattggagaatttgggagaagattcacagaaactgacatgtggccattttgtcctaaaataggtccctccttcacctgtgctggcactcaccattcaacaagcccataccacacacagccctcagaaggcttttagtgctgctttttattaagtatgaatgagtagccagtgatcatcagacttttgaagacgtttctaacaatgaagtcagagtttgaaacaaatgagaaatgagaatcagagataaatggaaggagaaaggaacatcaaaacaaatttaatatctttggagagaaaagaaagggtactatgtccacaaaatcagaaaaacatgatgaaaaaaacagtaaaaggaatattcagaaaagttaaaaatacagtaccagacactttaaaaacataataaaaatgttgggagaaagttgaaaaactcagaaaaaagaaccaaaaaacaaaggtatggaagtcatgggaggaaaaaataagaaaatcggaagatgaactaaaaaggctaacacttatctaattggaatttcacaaagagacgtcagtggaaatggaaaggagaaaactatgaaagatacaaaattttgaatttcctggaagtgaggaatatacatttctagattgaaaggacctactgagttacgtctcaatgaaaacaaggcaaagatggtcctatgaggactgtgctcctagcacatcaccatcacctgggaacttggtagaaatgcaacttccttggtccccacccacacccagagaaaaagaagccctgaaggtgtgggcttaacaatctggtcttccagaagcccctgcccaccaatcctgatgtgtgctaaagtttacaaaacactggtgcagagagtcagaatggcctctggctccccaagctggcattatccatgagcagtgtcttcaaaatcctaagagaggctgggcgtggtggctcccacctgtaatcccagcactttgggaggctgaggcaggcggatcatgaggtcaggagat

SEQ ID NO: 12313 - DNA, 1048 bp, Homo sapiens
atttttagtagagatggggtttcaccgtgttagccaggacggtctcgatctcctgacctcatgatccgcccgcctcagcctcccagaatgctgggattaaaggcgtgagccaccgcgccctgccagggtgctggttagattatcagacactatccctagagattctaaattagtagatttgggtggggcccaggagtatccattttaacatatgcaatattcttatcagatattgcataaatatttctagaattactgataaaggtcatatcataatcaactaagccttttctctttatttcttatctcaaaagtaaagcatttcttagtccatcattgtctttatagcctgtcatcttcccagaggtgacattgtcatcattccagagaggttattatatatattgattacctttgctggtaggacaccgaaacatgtactctaccaatggaaagccattgaagagacgtaaagcagaatgacatgatcagagctgctatttgaaaatgtcatactgtctttagtgtggcaaatgacttggaggtggcaggaggatggtttagaggggcagataattaaaccacatgatggctgagaagccatggtggcctgttcttcagtgaagtcacgtcagtagaacagtgattaaaagtaaagctcaagtcaggtggcctggaattaacttttggctccaccctttgccaggtttgtaaccttgggcaagttactgactgactgtgtcagtcatctctaaaatgagaataatgctgatgtctatctcatagagttattgtgaagatacagggaatacaggtaaagctgtcttgcatgtactgagtgctcagtgaatgtgagctgtgataaggatgacgattcattcaactacaatgttttgagtatctactatgtaccaagccctcttttaagtgctaggacacccagtgaaaaagcatacaaactccctcttatcctgacgcctgaggcttccattctagtgaggagagaaaaataaatgaagaaaagaaaagataacatcagttcatgatc

SEQ ID NO: 12314 - DNA, 1707 bp, Homo sapiens
aagcactccgtctcatttctctcacaggattgccctgtgaaataatccttaaaatgaagttaatcctcagttttagtgtttttttatttttaattaaaaagagaatcacctgtgttaaatattaatgccagattgcttcccctttctttttaagacctgaaacaataggggatgcagttttacgctggctcaatgctctttagttaagtgggtccaaatgagactttctgttgactcaggctacctcccaggtgaaagactcttttccttggttgttttttaaaccatgtgggaaatctgtgactgtctggggtgctaaaagcacacaggttttgtttgaatcctaacgtgagttgttgggctcacggtttccttgatgaactccagatggacttgagctgggctgcaagggaaagtgtctggctccagccagcgtggtgagcatgcacagcagtggttgtaattgcaggatttttatagtttaaagactgtgccagatttttttcatgttataactctaccagaacaaatctactcatgtctgtcactgtctggtaggtctttgggcaaacatacttcaaataaaaccttgcagatttttttttttaggtgaaaaagagaatccaggtttattctcaaaacagaaactcaaagactgaaaggaactctgatttctaattgttaactaaacactgagtaacactgtgcttctctggaggtgatttctctttatttattttttaggaggggtgtacttatgcatataacaaataattcatgcttttctccaatcaactttggttatttaaaaaactccgttttaaacaccaaaaaaattagtatgggttggataaccctttcagtgggaagcttcaagccatactatttgttatcccggtttttcatcactctggaaccatttcatttttattacactattttgaaggcacatagtcaatgtgttaacacatatggggaatataaccaagaatatttgctggaatttgttccatattttgaatcttaaatgagatgactttctagcctagagtattgtatatgtatgagtttgttattgtttttaatagtaatgatgttctatggaaattgttactaagttaaattgagttattgagtaagaagcacatttattttaatgattgaaatctgttcacaagtttttgtgcaatctgctgaactttgttagatggcgatgtggtttaaattttatattatcagatattgatatttggggaatttaagaaagcagagggttcagattgttttctaccctctcaacactcacacacaaaataatgctttaaatgatttggtgctttaacgcagagaaacaaatatgtatgcaaagcaatttctgttttccttgactgcaataaggacattgatgcttaaatgtatgacaataaaaagatttctatagaggctttagtttcagcaacctgcctaattagctccttttcttaaaccatgatgtcatcatatcaggttaggagtggggagatgggagggtgaagcagacctgccagttcacaaaagatctgttcaccacgtgccaaaaaaacatctcttaaaacatttgtgggcttaaagtatttgaatctgccagtctccctaaactaattttgtccttggagcttgtatttttgagtttggcattttggttgccatctagtttgtggacagaat

SEQ ID NO: 12315 - DNA, 1067 bp, Homo sapiens
ttcccactcctcaaccagattgtaaagactggtcggtagctatggaaagggcggaactcgattatccagaatcaagggcgtgatttctgtagctcctcagaacgcccagacggtttaggggagagcgcagggagctcttatgcaagtttttggatttttagctgcgaagtctgaaaacctgaaatcactgccaactgcgtgaagaacaaggaagaaaatgtaatttagttggaaatgctgatcttttccaaatgtcatctcttttcttcctcagtcccagttttaaaattggagtgctgtaaaaagtaaacaatcaaaatttgtattttttaaagtagttgttctgtttaaaataaaagtgcacttcatacgtaatcttatattttgacttagcagaattgcaatgaaaattttaagtttttaaaacaattctagtgaactattccaatgccctaatgtggtaggaggtttggtcaggtgtttaagaatttatattttaaaattattgtgctaatctaaataacttttgtgaatgtagaattgttggccatcagaaagtatattccttgtgtttttaataagccttagtttaataaagtagaattagtattggattgatatttaatttcttgggacgttttatttagtagtttttattgcaattggaagaggagataaggtctttaaccgaaagcagggagactttcaattagttgtggctaattctgttaaattgcctcttgtggaggtcatgctgccttattcatgagtgaatggctctattgacaacatatggaactgaacatgtaaatgactggaggtgaacacttaggaataatagagggatgagaaagagaaaatgaatacagtgcttcctggagtgtatttagatatgcttagattattcacggcatctaacttgtattcgatagtttttcaatgtcaagttgtctattgtgatcatgctagtgtgcagtactttttttcttttttcctggatttagatgtttagaaaaaaaatctgtgttgcccttgatcagaagttgagttgaaccaaaaggggttcg

SEQ ID NO: 12316 - DNA, 1048 bp, Homo sapiens
tatgttgtgacttatatttatccctgtccaattaataattattgtatgaccattactaattattgctctggtctataaagtagttattcttaagttttggtgtgcattggaatttggtatgtaagttttcttggagatttcattaaaagtacagatggtctgcccctatctccgatgagttttattccataagtctgtagtgggtcgtgggcatatgtatttgtaaagggtaatgcagataattttgatgcctaccaaagttcagggacctctgctgcatgtgattagaagcaggcattctatttacttgtggcatgagtggattaagaattgtatgattttttaaaaatcaggaatttgcctggaattttgagccagaactcaagagagagcaatttaatcacagtgttagctgttgaagacttaatcctgttcatggatcagaaggattcttttggtattattctttccttctagtgtgcttaaggacattggatcttgcttcttggttattggtttgaatgaaactcaccctgcacagatgggcaatagttttcgagcacagatggagaaggaacagtaagttcatgggcagagcccacacttaggaacaagtaagagaaaaagatgaaggctggaggtagaggcactaagcaaaataaacatttacctggtcattatggaaaatgttctattttttcttactttaaataagcaggtacatagcaaatgttttaggagctcatccaggtttactttatttattgctattaaattacataataaataccttccaagcactcattaaaataaaaataacaatgcagcagaattggaatagcaagagacctcagtgagaaattacatgtttttcctaaaaagcagaaggaactgagttaacaaggatggaagcagttgactgattttttgttttagccagtaaagatctcaagttagtacagccaggagacttctactaaaaacagaattactgcttctggtggtgcaacttctctttcagtatttggtatctgctttagttgtgcta

SEQ ID NO: 12317 - DNA, 1072 bp, Homo sapiens
aggtgagagatgaagatccagtttcattctcctacatgtggctagccagttatcccagcaccatttgttgaaaagggtgtcctttccccactttaggtttttgtttgctttgttgaagatcagttggctgtaagtatttgggtttattttgggttctctattctgttccattggtctatgtgcctatttttataccagtaccatgctgttttggtgatatggccttatagtatagtttgaagtcaggtagtgtgatgcctccaggtttgttcattttgcttagtcttgatttggctatgtgggctctcttttggttctatatgaattttagaatttttttttccaattctgtgaagaatgatggtgttttgatggggattgcattgaatttgtagattgcttttgttagtatggccattttcacagtgttgatactacccatccatgagcatgggatgtgtctctatttgtttgtgtcatctatgatttctttcagtattattttgtagttttacttgtagaggtctttcgactccttggttaggtatattcctaagcattatgtatatatttttgcagctattgtaaaagaggttgagttcttgatttgattctccacttggttgctgttggtgtatagaagagctactgatttgtgtacattaatcttgtatctggaaactttgctgaattcttttatcagttctaggagctttctggaggagtctttaggggtttcaaggtaaatgaccacattgtctgcaaacagggacagtttgatgtcctctttaccgattggatgccctttatttctttctcttgtctgattgctctggctaggacttccagtactatgttgaagaggagtgctgagagtgggcaccttgtcctatttcacctgtcatggggaatgctgtgaatcacatatgtttttaatttatattgtctaaaatatacaggaaaaagaaagtcactcctcctgtttgagtcagcaatgtgtgtgtttgtgtgtgtgtatgtgtgtgagctaacatatattaggtaatgtttatacattagaaaaattatcgta

SEQ ID NO: 12318 - DNA, 1103 bp, Homo sapiens
atccttgaatatttatgttgatttcatggtaaaatgtgtgggccaccattttcacttacacttcagcagtattttttgaagaaagttttaaaaaagtctatcattaagctctccctattaattttctctggtggtttctttgattagatcctgcactggttctttcttgattactcattttgagggaggtaagtttttcctggacaaggtacatgtaggtggcttatactgagaatgagccagggctgtgttgaagtgaggtgaaatttccctatgactccagatgtgtgtgtgtgtgtgtttattatacctttgcttctctgtaggcatataggcacaggtaggcatctgtgagggttcttacaatgcaatgtctctcttcacccctctatcacagaaacagaccgacttcctaaaataaacattgcttgttttaatcttactttttttcaggtccactcccatcttcttagactctttgctttacatggtttagaaatctctactgtggcaatttcttttctccaacttactgatttctaagagtttgaatactagcactttgtagttgcgtgttaaaaatatattctcccctctttaagctttctcttatcacccttttatgttgttatttggtgaacataaattctttaccttaatgtactagattttttcaatcttaacttgatggtcagagctttttgcatcttatttaaaaatgatttccttctctagggtcataaaaatatcctccaattctattttctaaaatctttatcatttttgtctttatatttacttctctgatcctcctggaattgattctcatgaatcaatgagaggttagggtccaattttatttttcccaattatcccacacccatttgctaaaaaccaccaatcttttgtgccactgctgtcatatattaagtattcatatatgaatagatctttctgagttatctatcctgagtcattgatctatttgtttttccctgaactaatagcacttagactattagtttccctgaactaatagtcttagttatcatagcccagtaataagtcttagtatctgttaccaacctagatgcctactaaat

SEQ ID NO: 12319 - DNA, 1025 bp, Homo sapiens
tggcaagtttgctacagttatttttctcctcactgtatccctgatatctagtacagtgtccagtacatgtaaatacacacaatttactgaaaaagagctcctcattcttttatatccgtactgtatcttatttaaatctccaaagaaatataaaaacccacatccagtcagtgagaaaagagtaaattttgaatttcaaataaagataataagaagtatttagttttggagaaaaatcctggtggtaaaaaatagtaatgaaaatgataagtataattgctaatactctgagtgcttagtatgtcacatactttctaactgttttacacccattaattcattatacccttactacaatgccctatttagtacaccacattataggttgggagaagacacttaagcttgatctaagctgattcttcaatttaagcatctcaatattttgtagtaaagaattttattactataaatatttaagaaaaattaactttccataatattctcaagcatcttggtcgtctacaacttccgaactagtcatcaaaacaaaagtgtgatactgcagaattacagaaaaatctatccaatgtctgtctgcttaatctctccactgcaatctcctaccccaaaagttaaacaagtccatatgtcccctccaaatttgctcttccttgtcttttccctatttagttaatgatactaccatcccccactaaactgcctaagtcagaaatctagaagtcactcctgattgctattttcccctatgcctcgctacagtcaatccgttaagtagctcaaatccatctcttatttctagtgagcacttgtagccattctcatttcctaccttcccttccatgctgctgtcacagtgatatctataaaattcatatgtgattaagtcattcctctgcttaaaatcccaaaatgtctcccacatgaattttggataaattcaaatcatttatataaccatataagatctccttcataattttgcctctgtcctcctcctgctg

SEQ ID NO: 12320 - DNA, 1032 bp, Homo sapiens
gttgcagcctgcacaccatagcccacctctctgagcagactttggttttgtgtggtgacgtggcacatgtttgtacactgggatttttcaaaggacgctacgcgagcagactgacttgcctcttctgtgagcactgtggcttttgtcagatggagtgccggtctgcagaggactgctctttcgaatccacagtgttatctgtgtaaatagctttaatttttcttctgtgtcttaggtgaagttttgttcatgtagcaaccaggtagacagtgaccaaataaggctgtaaatgtgctgtagttttctactgtgatgtacttgaaggagaacctgtgtcctctacttttctgatctcccacaagtattttgtgtttgtttcctgagtcctgaggttattattttactcctgttttgcccccagttttctttgttttttttctggagacccagggaggcccatggtggagatcatttgtaaggaatggatcatggtctgggtttccaaaactaccctagtacagtgaatgagagaaatctgcctggaaattgtttcagaaccatgtacctttatgctttgtgattgtgaaacattgacttttttgtaaccccaaaatgaaaactgtttagtaaaggggatctattttgtgtgttttgaaacttaggtgcaatgtcccctggaaaaagctaaagaaatgtatatgttcaatgacattttaaaataaaatattatatatatgtatatacgacatattcagcaaaacttttttctgtcttttctatgaattcactgtgaagtttctttgtatcaggtaatggtctgtctggtttctttatatcaggtaatgataatgatacaaagagtatcatggctcaatgtgagattatcaactgtgaacacagactcgaaatccagagggaatggatgccaacactataagccttcacaggaataacagtaaaggctaatacatttcaactatgcctttggataccattattaccatggataccattagtaaacacatgaataat

SEQ ID NO: 12321 - DNA, 1050 bp, Homo sapiens
ggtggatgggaacccgggaaggagccattagaaggtctgaccatgtcccccagtcccacttcaaagccgtttctgtagcacacctgtcccctccagggctgcaaagactcttccagatgtctgagtcctggggagcttcagagcccattagtttgatgtgaggcttccaggaacattaagaagctatttaaggaattgaacaggggaactttgaggatgtgggtatggttcgattgagtaaggccaacaacagcttcagggagggaaggtcaggactccggagcccagtggaatcctttgaagcctttgctgctggggaggataagcacacagtgggatgacttgcgcggcagtccaattcttctgaaaacatttttgcaaaatgttctgcatcacaggttaatgtataggacacgagttgtaagtggaaagttagcaaagatttttggaaattggctaaagggcaggaaacagagggtggttgtaaaaacctcaaaagatgttaattggggagtgcttcacagaccagggttgtgaccagctttttattattttcatacaaattacatgaagaacggtcttgagaaggattttcatgttggctaattaaactacattagggagccgagcatagaaatgggaacggtagaattagggaaagattacatttattgatggaattgaagagtagcattttataacgtgtgtatgtatcaacccacacccattctgttggccagatttccatttgagtgtggacaagacaacttcagcttgaataacacaacctgtcacatttcttgggtcagcaggaagcactttaaagagggtttggcaccctactcatagggcagactctgaaattaaatggatgttatctgcagacctgaaccctctcttttagaagaagctgcaaggcaaatggaatctcctgtttaactgcaagcataagattgagacatccacatctcaccacctcttatgactcaatattgtctatcataaagagttcaaattatcccaaaaatttattgtaggtataacccaata

SEQ ID NO: 12322 - DNA, 1050 bp, Homo sapiens
aagcaaggtaaagctgcccaaacacaccagccctttctcacatccccaggctttagcccctgcagcttcctcttcgtgtaaggcatacgatgtccagctcgtccatccaaggaatcagtatcccatttacctttggtgttcccagcagatggtctgtaagctttgaaactgaatgaataaagtgattttgcctaatgcagaggtgggtttcaaacccaagtcttctgcctccaaattcagtgtttgtttcatgacatcaagtaaagtagatagactactacagagaatttgggtatagtcttggtggcctgctggaatgccaatcttgaaatgatctacttggtttatagggctgcaggaagtgtgttggtgttttattttcttcttgtcataagtgtcatattcaaagatccataggttgagctgttgggttggacacatgaaatagaggggacaagatttcatctctttatttcccaccaactactggcagcctttaccttgggaaccaccttggctatttctgccaggaaacactattgagagctccagtcactgctgttttaaatgagactttgggaattgaatcccagtttccctgagcccactcttaatcctttccttctaccaactagacgatattcagatgtggttgccctgagatcagtgccataaaagaattaaaattggcagttcccttccacattatttgatcttaattacagctttgtgagagaagtagagcagttgttatatttcctttttcttgtgtttttcagtttttgaaaaatgatttcagagataggaaaattgagcgctaggccaggtgcagtggtgtgtacgtgtaattccagcactttggacggccaaggtgggcagatctcttgagctcaggagtttgagatcagcctgagaaacatgatgaaactcgtctctacaaaaagtaaaaaagtataggtggtgtgcacctgtagtcccagctacttgaaaggctgagatgggagggttgcttgagtgtggcaggttgaggctgcagtgagccagaattgt

SEQ ID NO: 12323 - DNA, 1030 bp, Homo sapiens
gattggtgggtgtgtggatgggtgggtggatggatggatggatggatggatggatcgatcaatcctattgggtttgatatgaactgatttctgcagctgtagacgtcacgcatgcattggagttagtttattggacatccttccttccagtctccaaaaaaagaaagctgaaaagaaacagcagcaacctgtcaagcttaagataatggatagaaaaagcactcctcaaatacagaagtgattttggtgagccctttcttggtaagagctatccacgtatgttagcagcaaggggcctggaaacatatctgggcaggaggaactggaaaattgtttggttgttcctagcccaggcagctgcactggaatgggatgctttcactgtgtgcgtgtttctgatgaccctctgcttatactcctaggcccgggtaatggcaactattggagtgaccaggggacttggggaccatgacctgaaggtgcatgactccaacatctacattaaaccattcctgtcttcagctccagaggtaccgcatgaggtttttgtttatattttgtgcaataaaacattttcggcgttattcctcctgtgactcacaccccatatccagacagtagccaacttgtattatatgtacttccactgtatctctcacgtctgtgtctttttcccactccattctcactttgactcttctggttcacaccttcatcacctcttacccagatggctgcacagcctcctcctgacattttctaagtctgccaatccatgctacttattgcagtcaggtaaattttccttaaaaactgactcctaattgctcagaaaccttcaatggcagcccaggcatggagagtaaagctcagactcccattcacttggtgttcaaggcttattataatttggtctggacttctctgatctttgttctcctgcaccagccagaatgaacttgctgtttcccttacatgaccttaggtttcccatatttgcttaaactattccttttgccaagaatgccct

SEQ ID NO: 12324 - DNA, 1046 bp, Homo sapiens
agcaaggtgcctttaaaagggtgctgaataagaaatcactgagattttcagatctgaatctagtttgaactctagagtcctttaagagaaagttctaaaacctaccaattgggaatataaaattgtacagtcactttggaaagctaactggtagttcttcagaaagttaaggttaccatatggctcaataatttcactcctgggtatatgcccaagagaactgaaaacatatatttacacaaaaacttgtacacaaatgttcatagcagcattattcactgtttcaaaaaaaatggaaacacaaatgtctgccaactaatgaatggataaacaaaatgtgttcatgtgatggaatattatttagccacaagaaggaatgaagtattgatgcatgctgtaacatggatgaaccttgaaaacatctgtttagcaaatgaaaccagtcataaagaccatgtattgtatgatgccattcatattaaatgtccagaatagattaatccatagagacaaagtagattagtatttgcaagggcttagaacgaaggagagatggggagtggctactaaaaagtacagggtatagggagtcctttttcagattttgaaaatgtcctggaattggataatggtgatggttgcacaaccctgagaatgtaccaaaaaacactgaattgtatcactttaagagggtatattttatggtatgcagactataattcaaaaacagaaaacaaacacatagacctcttttttttttttttttgagaaatgatatgcaccttgaaaacctttcattaatgactgaggcatttagctgatctggaaaattttgcgctggcgcactgggtttcatgagtgttgctggtatagcaaaatggtagactaagatgtttctacagaaagtggctgaatatgacactgagaaattattctgggtggtatgagtacagactgggctggttgtgaagaaagcaaggaacatgggactcagctatggctctatgagtggtcacttatttttgctgctacttaaagatctgaaa

SEQ ID NO: 12325 - DNA, 1050 bp, Homo sapiens
ggtttagctgttagtacaggaagggagggagaaacatgtcagcccttggaagtgagccagggttgtgggaggtagagtgttgaaatgggatgatcacaggtgctagggtctggaaatgctggccctcacccctccagaaaataccttgctttcccatttgtggaaggggctggttcctgctcttctagattgccatgcagattacagatgatgtgcttaaagcacaagtatggttcagcccttcattctttcaccaaatatgcctcatgccagacactgtcaaagtcactaggaacgtagctatgatcaaaaaaaccctgccttcatggagcttgcaaaccagtatggaaagacagataatgagcaaggcacataagtaaaatgttgagtatgctattggtaataatttctaaagagaaacatagggcaagggaagggacttagtagtcaggggtgggttgcagtttcaaatgcgacagcaagggaaagagtcatgggggatagagtcttagagtaaggtctgaaggaggtgaggcaaaatgttctggcagatgaaacagccaaggcctttgatatgatttggctgtgtccccacccaaatctcatcttgaattgtagttcctataacatactcccacgtatcatgggaggggaccaggtgggaggtaactgagtcgtgggggagtatttttcccatgctgttctcatgatagagagtaagtctcgtgtggtctgatagtttcataaagggcagtttccttcacatgctctcttgcctgccatcaagtaagacgtgcctttgtacctccttcaccctctgccatgattgtgaggcctccccagccatgtggaactgtgagtcgattaaacctctttttctttataaattacccagtcttgggtatgtctttttagcagcatgagaacagactaatacagccttgaaccaggaatgtaccttttatagttgaggaccagatagaaatggaccaaagaaagagggggtagtaggtgaggcagaggaggtgcaaacagggcccaggcatgctc

SEQ ID NO: 12326 - DNA, 1070 bp, Homo sapiens
gcgggcggatcatgaggtcaggagatcgagaccatcctggacaatatggtgaaaccccatctccactaaaaatacaaaaaaaatgagcgggtgtggcggcacacgccggtagtcccggctacctgggaggctgaggcaggagaatcacttgaacatgggaggcagaggttgcagtgagccaagattgtgccactgcactccagcctgggcaacacagcaaggctccgtctccaaaaaaaaaaagtgttttgttttacatgttatatctaatcatttgaaaagcctaacagatacttttatccttaataaagctgtaaaacatttaaaaaaaaatcaaaaaagcagtatctctaaaacctaataagcttaatgataaaatactacctctaaaacctcataagcttaattatgcttacagtattctagtcccagtatccagatataaatttggggttttgtagttgattatttgggttttctgttcacatatgggtcatacttcaggaaacctgagaacaatgtgagttggtatttttatgtgctatccaaaggatcgtttatgcgacacttactagagtgctatttgcagctcttttacaaacaatagatactgatatcatcttctaggattgttgtctagtttgccatactaataatataggtatttgagcttacagaaatattcagttattcccaagaaaccacagctaagtgagctttgatcatatctgtggaaatgtaggtccattatcactgattgacgagcagtcaggaatcccagggctcagtttaaaacaaatgcttagagccgcagaaggttctggcaacagagccctgattaatgaagggctaagttttctttattgctagatattagctgtcatgtgctttttttttacatcttgacagtttcgagagtaaaaaatatttgttatatgttcactgcccccataattattcacgctcaggaaaagagaagctttgccctggtttgatttggaagctgccaatggtcaggaactaagctgtgtatcatctgatttaccatcagacatctgcacacttagggg

SEQ ID NO: 12327 - DNA, 1033 bp, Homo sapiens
gcattctgtgctcatacaggacattttgtaaaatcaacgatgagatgtcactcaaagtgggatttctacatttgtgataggcctttcctgctgttgatatggcccctccaccggttgtataaatacctgaatagttagggtggcaaagggaagaataatattaaataagctaaggacttgtgaatgctaccaggaggataccactttttcccttcagacaactatttctaaattaacagtctccaaatcgtaagttaaaaacaatttttttggcagggtgtggtggctcatgcctgtaatttcacagcattgggagaccaaggcaggagggtcacttgaggccaggagtttgagacccagcctgggcaacatagcaagaccctctctacaaaaaatttaaaaattagccaggtgtggtggcacatgcctgtagtcctagcttcttggggcggccaacgtgggaggatagcttgaggccaggagttccagactagcttgggcaaaataaggagaactcatctctacaaaaataaaaataaaaaataaagcctggtgtggtggtgcactcatggtcccatctactcaggaggctgaggtgggaggatggcttgaacccaggagactgaggctgcagtgaactatgatcatgccactgcactccagcttgggtgacagagcaagaccttgtctcttagaaaaaaaatgcacccccaatgtgtttgttcatttattgatcatttattgatatataacctactactgtgtatccataaagtatataattattttaaaactataaagatacatttaaaatttttaaatgttttaataatttaagggcaataaagatgaaaaggcaacgttttaaaataacaacagctaacagtgatacagtgttaattgtatgccaggcattgatttaagtgtttttcacacagtaactcatttactgtcttgctaagagcaaagacttcctgctatcattagctaatatctcaaggcaaaattcatcattaacaatagcgagtataat

SEQ ID NO: 12328 - DNA, 1037 bp, Homo sapiens
agcacggtttgttgaaaagattatctgtgctccattgtattgctcttgctcctttgtcaaagatcagttgactgtatttatgtgggtctatttctgggctctgtcttctgttccgttggtctactggtatttgttcatttgccaacactagacgttcttgataaatgtaactttacattatatttttatatatatattttttaaatttttttagagacaggatcttgctatgttaccccagatggacttgaactcctgggctcaagtaatctctcgcctcagccttgtgagtagttaggactatagcaagtacacaccacagtgcccagctataagtcttgaagtcaggtagtgtcagccctctttgttcttcttcttccttcagtattgtattgattattctgggtcttttgccttcccatttaaactttaggatcagtttgtcagtatccacaaaataatgtgctgaaattttgattggaattgcattgagtatgtagatcaagttgggaatatctgatatcatgacaatattgggtcttccaagaacctcttgattttgattttgaaattctgactgtggaatggaagtgggttaagactgcaggtggacaggcagctaactcttgggcctggtttctaatcagtttgggccacagtttctaaagagtcattgctagggattctaggtagtttagtttgacaaccatgggcatagtttaccacaaaccctcctttatgtcatacgcaactttttgaagttccacattagtgttaaagaatgcgagctctggaatctctctggaggttcctaattctggcttcgtcaccttgcatcactcacaagactttagccaagtatcctctcaattgtaaaatggacttaattgtggggatcaaatgggaaaatctgggtaaatgcctgtaaagttgcttgtatatccttgttttaccttatattccattctctcctctccccgacccttatccagacttcctccctaacttgcccttgaaactgttttttataatgtcac

SEQ ID NO: 12329 - DNA, 1019 bp, Homo sapiens
attaagaagtgtgttgtgatttgtgtatgtttgcactgttttgaaaaccaccctaaaggtaagtatttttaaagctgtttataacatttggtaaatttaacctaaaaagtatcaaaaccaggagtggtgtctgttctcttttcagtgcgttttttcctttgtcgccccacactgaatatttttggccacttggaggacatacgtgggcattcataattaagaattaattaaaagtgtctgcttggaggactttctgctccgtacttaattaacttaaaaacttattgccttgataaacagatggatcattttaaaagaaaaaacagagttcaccctcactttagacatctacaataattcatttagttaaccttggaagtattttgcatctattatgcatccattgacaatgaaatgcagaagtgtttattgccaccatttaaggatgattatgtgctatagtttaactcatttatgaggtgtgggtggcagcagaaggagaggacctatagtgactgttccccaagctgggctgggctggactatacagttggtaccctggcttctttaggctaagggtcagtttctttgtccagtccttcctgctggtgataggctgtttctttctgcatctctgcactattccccacttgtgatggactggcttttccccactccattacaccttctgttccccacatcacttcagtttggcagtagcccatcatggcttctcatggtgctccccgagaattcactgctctcttggtttagttcccatagttagttggcaagaccctcctgtatttcttggtttagagtcttgaaagagatcttctgcttgacccagctgaaatctttcagccaagccacaaagtcataggtagattgccatgccaaggctgggtgtccttcattgggatcccacaccattccagctattggggctgtcacacacaaggtgtacccatacatgcttcatcagaggctgaagtgtggacaaggttcttacagggtat

SEQ ID NO: 12330 - DNA, 1049 bp, Homo sapiens
tcaccattgtatttcattgttctagacacatttatattcttcatcatttcagattcattttatttcaaagctataacagaaggaacgtgttgttacgctatacatgtctgattggatttatacaacaaactgaagccaggttctattgtagttcatttcccattatccccctgtcctacttttaatacggaagaactcttatcaactgtgtagcatttttatctcatatcttcttctattgttgcctctaccttttgtttcccttggggtcatggtgatggaagaagtggataactgtgcttctgaatagtcttttatgtggagaaatacagtttactcctctggacatcatgttggtgacccactttatgtattctttaatattctaggggtttttgttcatagagagaagcacctgctactatttgtaatttagcgctcaaactattaaatttgtatctaaaatcaaactttgaaaattaatttctgaaatctgtttgaacatggattaccgacttaactcttttaacaacttaaactgcaatgttgattcttttgagccccctgacactggaaacagcacacaaagatccagtgattatgaaacataaaacatacttaaagctgttgtaaaataccaatgccatggtggttcatttgttgttcttaaacttgtctgtttactttcctaagtttgtagcaacatatattttgatagtgtccagtgttagagcaatgtgcattttgagacttttctacagtaatatagtactagtacatttccacaattacagaaactttattggagccagaaagatagtctgaccagctgataactgatctagttatttttggccatctctagcttcatcaaatccaagccactggtcatctggctaggctccattttatatttgtccacaatttgttacagcagtaagattttggagttatactttccacacaagttctagtttttttgaagcatggtgcttctcccagaatgttttcttttccaagttttgcttggctggcatctcatagtccat

SEQ ID NO: 12331 - DNA, 1045 bp, Homo sapiens
agaatgagacagacaaaaaagagggccatgctccttcacagagagtgtcagagaagagccctctagggaggttagttgttgacctgagtgaaatcagagagtgacatacatcaacagatgggggcttaagagtgtgctggccagcagaaatcagatgtgcaaggacaccaagattgggatatgcttgttgtgtttgaggaccagcagggaggtgagggtggctggggagaagggaacaaaggagagggagataggaaatgagggtccagaggagattagatggctgaggccagtggctgctgagatggaaggtcagtgggagattttgcgcagaggaacatgggaaattgttttagaacgatggctttggccaccatgtgggaggtaaattgtagctagcaggggcaaaagcaggaaaagcagttgaaagcttttgcattactccgggtataagatgatgtcagtttgggccaggatgatagtagtggaaggaataaaatgcagtaggattctggatatagtttgaaaggaaagatgacaggattgattggtgaactgagtgagaaaaagaggagtcaaagataattccggattttcagcctgagaaactgggtgaatagtggttccattttctaatacttaagaagcccaggggatagggtggggtgggggactggtgggaactggtgtagtgttgtccttaaaggaatggtctccagagtccattggcccaagttccaatcccaaatccacccctttaagcagatagttaatgccagttttctcatctgtaagccagggattagtcataactgataagatgcatgtgaggattaaatagataagggaaaatgtttttcttagagttgagaaaacgtggtccatagtaatttgtaattatttgtttaatatctacccactctactggaggctccttcggggtgtggtctgcatctcttttgttacccatttattccttgccatagcataaacttggcacttaagaggagtccattccttcgggtggttgcagcccctactatga

SEQ ID NO: 12332 - DNA, 1047 bp, Homo sapiens
catgttggtcaggctggtcttgaactcctgacctcaaatgatccccccacctcagccttccaaagtgctaggattggtgtgagccactgcgcccggcctaaagttagcaagttcttgctgtcattcctgagaaataggctatgcatataaatatatgcttacttttttaaacatttaaaaattttatatttttggaagtattcttttatttcttcctccaatctgattaatatgttttcttttaataacatagttttttgaaaccccaaaactgaagtacagttaaggatatgattcctaaggggaagagatctcatgtagtaattcccaaacactaatgtaaaagtggtttgctgaactcttcgggaagcttaagaaaaatacccatccctgagcccttcctcctcttccctaagagggtaaaatttagtgtgcccagaaacctctgttttcaaaattccctgtgataatgatacgtggtctgcactcaaaaaaattgggtaactaagagaaagatgtcagctccaggatagaataggtactgaaccttactgatgtgtgtgtgcatacacgtgtgtgtgtgtgtgtctcctgggactgattagtattaattgttttcattttattagatttgtgccctatcatctttatttatttcgagatgaggtcttgttctgtcacccaggctagagttcagtggcgctctctcggctcactgcagcttcaactgcctgggctgaagtgatccttccacctcagtctgccaagtggctaggactacgggagcatgccaccatccctggataattattttatttttttgcagagacagggtctcactatattgcccaggcttgtcttgaactcctgcgtccaagccatcctcctgccttggccttccaaagtgctgggattacaggtgcccaaagtgctgggattacaggtgtaagccacacacccaggccctatcatctttaaaccttctttgaaacaccccacttcccagagccttaggagtttctccctttccctgcggatttaattttc

SEQ ID NO: 12333 - DNA, 1032 bp, Homo sapiens
ttttggagtcttgtatgattatcagtattcccctgtcaaaatcaaatctattcaggtttcttcactgttgagaacacctaaatgtttttatttttgagaagtggggacagagtctcactatgtcacccaggctggagtgcaatggcatgatctcagctcactgcaaccttcgcctcctgggttcaagcgattctcctgcctccgcctcctgagtagctgggattataggcacgcaccaccacgcccagctaattttttgtatttttagtagagacagagtttcaccatgttggccaggctggtcttgaactcctgaccttgtgatccacccacctcggcctcccagagtgctgggattacaggcatgagccaccacgcttggctaagaacacctaaatttttatgtttcttggctcaaaaaccagttccatttctaatgttgtcctcacaagaaggctaattggtggtgagacagcaggggaggaggaagagctgtggtttgtaacttgttcaactcaggcaataagcgattttagctttatttaaagtcttctgtccagctttaagcactttgtaagacatggctgaaagtagcttttctatcagaattgcagatagtcatgttgggctaacagtcaattggatatattcctttacctcacatgaccccagcaactgtggtggtatctagaggtgaaacaggcaagtgaaatggacacctctgctgtgaatgttttagagaaggaaattcaaaaaatgttgtaactgaaagcactgttgaatatgggtatcggctttctttttcactttgactcttaacattatcagtcaacttccacattaatgaaagttgaccatagttatttccaaataaaaagaaaccaactcttaccaggtcttggactgtgatgtcatattattcagttttatgcttgttcctgagcagaactcataagagtgacatagtcagctgctgacggcacctcagccacgccactcttactcagttcagtgggtgtgcttgcgtggtag

SEQ ID NO: 12334 - DNA, 1035 bp, Homo sapiens
cttgctgccttctgacacctttcaagactaacctacttgtttttctcctcttgacttgcactgtgtgactttgtgtgtgctgactggtgatagaaatgttcggaactgtcgagggctcatgttttgtaccatagactttctcactagagtcccttctggtgatttgtttcttttacaccccttcctgctatcctttccactgaataatattctgagtgagaagctagtgagagctaatgttacatttggtttttcctccccagatacaggtttgacccccgtctcatgttcagcaatcgcggcagtgtcaggactcgaagattttccaaacatcttctgtagcgacctcacacagcctctgcagatggatccctgcacgcctctttctgatgaagtgattgtagtaggtgtctgtagctagtcttcaagaccacacctggaagagtttctgggctggctttaagtcctgtttgaaaaagcaacccagtcagctgacttcctcgtgcaatgtgttaaactgtgaactctgcccatgtgtcaggagtggctgtctctggtctcttcctttagctgacaaggacactcctgaggtctttgttctcactgtattctttttatcctggggccacagttcttgattattcctcttgtggttaaagactgaatttgtaaacccattcagataaatggcagtactttaggacacacacaaacacacagacacaccttttgatatgtaagcttgacctaaagtcaaaggacctgtgtagcatttcagattgagcacttcactatcaaaaatactaacatcacatggcttgaagagtaaccatcagagctgaatcatccaagtaagaacaagtaccattgttgattgataagtagagatacattttttatgatgttcatcacagtgtggtaaggttgcaaattcaaaacatgtcacccaagctctgttcatgtttttgtgaattctaggctggtgctgcactgaaatagagcagtaagcttgtgataaaggccaattccaggtag

SEQ ID NO: 12335 - DNA, 1047 bp, Homo sapiens
tttgtaatcctgtcctttcttttgtatttattagctgaaattcctcagagaagaacttccccttatcagttatttggttattttgagatgcagtttattcaggaaacacaggataggtgtttttgttcatttgacagtttttggagtaaacttcattcagttgtgatgaggctgagtagcatgcataattttttatgtatttgtgtttcaatactttcctgtcattatttttgcttattttgttctatcataagccagggagtcccttctagtcatttgtttagagaagatgaatttgttgttttcctgccttgtagtaacaagagacccaggcaaatttcagctttctattaaaacaccagaatcagtagaacaaagttgttttagttttggctgtggattaaatgagtgaaacataacatgagcaaggctcctgtcttggctccatctttacattgtgtgttttgttttcaggacagttttccttgccaatagacaagagacagctgtatgagtttgatatcaaagttccactgttggttcgaggacctgggatcaaaccaaatcagacaagcaaggtaggtgcctgacaagctggtgctgtggacaggtaggcacttgcctgagaaaataaggtgtttcctcctgagataagattggttaggttcctcttcccactagggctgagcagcagaagagtttttaagtggaaacaatgattgcttttttttttccttaacttcccactgctctctgtatctgtattttcaccccacatatacatgtctcattagaatgcatagcttttctttgtcttttgagactagatctttactttgttctggagcagtgactctcaacagaggatgtgcatcaaaattgccctccgaaactgaagaagaaaaatggtacgtgcttgggcaatatccagaaagagtatgattgactcacttggtctggaatagggacccaacatctgccttttttccttttgaagtttgcaggtgattctgagaggcagcctggtttggggcccactgccttgta

SEQ ID NO: 12336 - DNA, 1073 bp, Homo sapiens
gggaaaaaaagtctgtgtccagtgtataaaatgatataggaaatgtgtaaagctgcagatcagcctgcaaatgaaccactgtgtctcaattagatccaagtagtattctttgtctttggttaagacccgtctctcaccatgctgtgccccctgtgtataaatattatttctggctgggtgcagtggctcacacctgtaatcccagcactttgggaggccaaggtggaaggatcacttgaatccaggaatttgaggcaagtctggacaacacaggaagaacgttatctctacaaataaaaaaatgaaaaaaaaaaaagccaggatggtggcacacacctgtactccaagctgttagggaggctgaggtgggaggatcacttgcgccaggaggtcgaggctgcagtgagctgtgcttgtgccagtgcactccagtctgggtgacagagtgagagctcgcctcaaaagaaaaaaaaaaacaactatctctgcggcagatgagactagaattactgttatcctgcagaaagaagccacttgagaaagaaatccgttctcagtttgttctgtctgctttaatgtctccactatgatttaaagcagccctgaagcatgtcatgtgtagaaaaaaatatatatattccatgagaaactacatatttgaagttagagtattaaggagcttttctttactctctttaacaatgatgagaagtccatctttcttgtgtgactttgtcgtttttgcttcctttcctttgtagtatgtgccaagtgctctctgctgccccagcagagccagtatcctgacaggaaagtacccacataatcatcacgttgtgaacaacactctggaggggaactgcagtagtaagtcctggcagaagatccaagaaccaaatactttcccagcaattctcagatcaatgtgtggttatcagaccttttttgcagggaaatatttaaatgaggtatgttgaatgatctgtttctttttttataatggcttttaaaatgtgaatataattcatgttaattttattatttcaattaatgttaaaggatttcttggtata

SEQ ID NO: 12337 - DNA, 1050 bp, Homo sapiens
ccgagctgctcgagtctcgccccgcgccgcgccgcacttttagacgagtgcggaggggaagtcagcgcggagctgcagcccccgccggccgccgccgcgcggcgagagggagttcccaaagctgcctcggcccggggcccggccggccccctccttgcgtcctccccctcgcggcgaggctgccccgcgcccaggctgccccgcgcccgcgcccgccgccgcggcccgcagcgatgatcttccccagcagcagcggcaaccccgggggcagcagcaactgccggacgccctatcgcaagcagcagtctctggtcccagcccaccccatggcccctcccagtcccagcaccaccagcagtaataacaacagtagcagcagcagcaactcaggatgggatcagctcagcaaaacgaacctctatatccgaggactgcctccccacaccaccgaccaggacctggtgaagctctgtcaaccatatgggaaaatagtctccacaaacgcaattttgcataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggataagcaagaactagaaaatatgctcaaaccatttggacaagttatttctacaaggatactacgtgatgccagtggtacaagtcgtggtgttggctttgctaggacggaatcaacagaaaaatgtgaagctgttactggtcattttaatggaaaatttattaagacaccaccaggagtttctgcccccacagaacctttattgtgtaagttttctgatggaggacagaaaaagagacagaacccaaacaaatacatccctaatggaagaccatggcatagagaaggagaggtgagacttactggaatgacacttacttacgacccaactacagctgctatacaaaacggattttatccttcaccat

SEQ ID NO: 12338 - DNA, 1033 bp, Homo sapiens
aggccaaggtgtgcagatcacttgagatcaggagttcaagaccagcctggccaatgtggcaaaaccctatctctactaaaaatataaacattagccgggcgtaggggcaggtgcctgtaatctcagcaactcaggaggccgaggcacgagaattgcttgaacccaggaggtggaggtttcaatgagccgagattgtgccactgcactccagcctggcccacagagtgagactcaatctcaaaacacaaacaaaaaatgcattgaatatatcaaaatttataggttcatattgatcccatcccccaccttccccacacacaaattctcattgggccaccattcgaagtatttagtgaacaaattccctgttttgaaattgaaaggaaagaattagcattcattcattctgcccttcttgtaaaagctgtatttcagagtaacaaagcagcactaattgataaaagagaattctcctttacaaaatcatttaggctaataaatacagaagatgttaataggattagaaaaagattatcgctttgcaacccctaatgaaattttgattcagacagtgatcaataaataaaacctttagattaaagattgatgagaacccttacaatagaggaatgaggctgtcatcacctgaacccacccaaagtaggacagctagacatgatgtgataggaagcactgtgccacctatgaactgttcctgcccccagtccccacctcaaagctaacctcgactgaaatcaagcatctagatttaacttccatttagagaaatgtgggagacagaggaatatactacagagcaaatgacacagtttcagcaatagatcagcagcacagggggaaggacgagaacccaccacaggtaagaggagatttaacagacttaacacagaggtagtgtgtggactttgttgggattctgacttaagcaagccaacttaaaaaaatgtttttgaggccgggcacagtggctcacacctgtaatcccagcactttgggaggccaaggctggcgg

SEQ ID NO: 12339 - DNA, 1049 bp, Homo sapiens
aaagacattgccatagtatgaattgatctgaaaagtaggggcggaagtcagattgcagtgagctgaggaatgagtggagagtgacaaatacagagatgctctgcttgctgtctgctttaggaactggattttggaagagagtttggccggaaaaatgcactgaatggatgaaagagactggacaccattgtgggctcctcttttgagaacttctgcatttacttatgtgcttgttgctctattttatattgtattatatcctttattcagtagttctcaactggggtcaattttgccccaggggacatttggtgaggtcaagaaatttagctgtagagaaagaagaagagacaacagatagtgagagactcaaagttcagaggggtgttattttgttttgcggctttgttttgttaagattggagagattgagcatgtttggggcctgacatgaatgagggagagaagagataataatggaatcagatccacaaaggaatgagaaagagaagtccaggacagaaggtagaagacctcttatgaatttgtagaaaaggttgtgagacacagaaagacaaacatcacatgttctcacttaactgtgggagctaaaaattaaaacaattgaactcctggagacagagagtagaaagatggttaccagaggcttggaagagtagtgatgatagtggggagtggggatggttaatgggtccaaaaaaaatttggaaagaatgaataagacctggtgtttgctagcacaacagggtgactgaagtaaaaaataatttaatcatacatttaaaaatagccagaagagtataattggattgtttgaaacccaaagtgtgggtactggagaggatggacaccccatttgccctgatgtggttattgtgcattgcatacttgtatcaaagtatcccatgtaacccataaatatacatgcctactgtgtacccacaaaaattaaaataattttaaaaaagaaaagaaaaggatgtgagaatataaatacatttttagctggcttttagatggttcatgta

SEQ ID NO: 12340 - DNA, 1064 bp, Homo sapiens
caacttttaagttcaggggtacatgtgcaggatgtgcaggtttgttacataggtaaacttgtgccatcatggtttgctgcacggatcaacccatcacctaagtattaagcccagcatccagtagctattcttcctgatgctctcccttcccctgcccccgtgacaggccccagtgtgtgttgttcccctccatgtgtccatgtgttctcatcattcatctctcacttataagtgagaacatgcagtgtttgattttctgttcctgcattagtttgctgaggataatggcttccagctccatccatgttcctgcaaaggacatgaactcattcctttttatggctgcataatattctatagtgtatatgtatcacattttctttatccagtctgtgattaatgggcatttgggtccatgtctttggaaagcatgaacatctaaggaaaaaagttctgaaagcaatgactgtagtaaaatacagtgccttttaaagtcagacaaatttggttttggattttggctctctgttgaccttggacaatatttaacctctccaagcttcaacttttccatctctaaaatagggatgatggtagtacttcttcataggactgatgaaaagatgaagtgagtgaatacatgtaaagtgctcgccttaaccaaactgttagtgaataccaagaaatttaattggctcttaatgctccacttctctaaaatgaacctcaagtctcctattatgctgaattaagatgtagctgatggttcactctgtgacaacattgaattgttgctaggaagcatatttggaaatgacatgttctggatcattttattttctataagttcatcggaatacttattttgcttagacctttgctaaaatatttataaaatatgtccctgagaatatatattaagttaggtacttgagtctttggtggaggagcacacaattatctcaagaacatcattctgaacaccaatccttgggcaggtgttacagagacaagagatgtagaagattgtgccaaatctgtactgacttgtaacttgctctgga

SEQ ID NO: 12341 - DNA, 1027 bp, Homo sapiens
ctcatgaagctctgactcactgcagcaggcccatggcttctccatggaaagtccatagggctccccagatgctttgcttcttggtgatctgcagtgactacactattagttttccatctgttcctctatttgaaatgaatcaagtctcatcaaacaagggacaatcaaataaatgcccctgatgcacaggcatctgtgacaaaatgaggactgatttactagtgcccttgtggcttggagtctgcttgaggctagctttacttttcttcccttttctcaaaagtatttcatctatacattcttttggtccattgtttgacaattactgtatgatgagtctgaaactttgtagcatttagttacatgaggcggaaatttcatgtacgtaaaatagacatgaagttcggcctaatgaaaggaccctaattttcaagtctcagtgtccctaatctataaaatggtagtatgcccttctttacagagtttttctgaaggctaagttagtgaatggatgtaagaatacttggaaaagtataaactgctttaaaagaatggatagtctttaaaagtatcacaaatttcttcattttaatctctctattcagtcaggttcctagctcatgttagattcgtgggtacttagatattcatggaagaaaaaggccaagtgagtgtagctctaagttctactttgccctgattatttaagaagtctgatttcttgttgaagtttatcctttctccatttccctttcaggcacaatggaacctcaagccttgtcctcttagttgtctttgaagatgcaacatttggccccttatgttaaacactaagcgacctaactcagcaatgactagctctcactagctgtagtgcagccttacctgatatctttctcaggatcttctttcacttccagagtgttctttctttttatccacccagctgctcccatcccttgttgttcagctggactcccagatcagaacatctgatcattctaatccccgcacagtagttctggat

SEQ ID NO: 12342 - DNA, 1062 bp, Homo sapiens
tgtcaggcaacaaagaactcagtgaaatatgtatagatacatatgtacaggtagactcggctttgctttctgtccttacatctcggttgtgttcgtgctgaaattatgaaagcagcttgtgtgattttttttttaatgacttcattctttgctgaaaagagaatgtgtttgggtccggtgctgaagttattgtgggaaaccgtcattttgcatgctgattaactggccaaaaggagtcaagtgtgtgttactgtcctttctatgatacatatactaaatgcagctggcagattcaggactcgcacagctggtggatccacagaataattgtttgttctatgactttccaacatcttaagagctttttccctggacagctttaatttctttatgtgttagaattgcatgttcagaaaagtatgtaattccaaatgctttggtcctatgtaatactagaagtttatttgaaagtaaaaatcattgctcggaatcttatcatcaagaattaccagcttcagattgtcactcttagaactctaaaatagtaattaaatttctctgtaatatttaaggtattattttatttgaaaccattctggatgtgccatctcgtttactttgtgagcattctattgcaaagttagtaaatggatgccttaaaaatcctgccttgtgtccatatagatatgtgagctctcttgccttatttcctttagatagaaccttccttagagaaaatttattatttaaaaaaaaacttcattctgagtaaaagtatttagttgcaaatgcctttctttttcagcctgtaatatagagtactgttgagtaattaatggatataattatgttctagaagctctgaacctataaatatgttaatggatgctatttctgtcagtttagcttgacatatcagaattctttgatcaccagcagtgcagctaaaaatgcaattaatattttatctggcagaagaatgagcacaaagcaaatcatgagaaatagatcttgagtcaataacaggaaagagaataaatactgtagaccaacttaccgaat

SEQ ID NO: 12343 - DNA, 1049 bp, Homo sapiens
tcaggtggggacacagccaagccatatcactctctgttgtttctgacctttgataagaaagaagaaatgttagttattgaaccacagaagccccaccaggtactaacttactgcatttttgcttttaattatctatatatgtctgtctgggacactagacttaccctccttaagagtaaaggctgttccttgtgtttgtgtatccagtatccagtactccaagggaaagatggtgtttagtcatgagtatctgcttgtgggacacatgtggtaacctagtgtgaagtgggtgtggatgagggctggatgatgtgagaagagaatagacaggagatgatagtaatggtagcaacagctggcatttactgagcctgctgcatgactgagaacttcacttaagcctcccaacaacgctgcaagggtagaggctgctgttttccccacttatgaaaatatgagtttgcccacaatcatacagtaggaacagtttttcttactccagaaactgtgctttaaaaagtcaaagaaagaaataaccaagtttgttatggtaacattggtagaggacttgagtggtgcttccacctactgggcttccagagcagctagatacgataggtagattcatattaacctctggaggggatggggtgggaggaccaccctagagccaacaaaggaggtggggggccagactattattatcttcaccgaacaaacaagaaacagggaaggaggaaggcaagaaaagagaaaataactctgccgagatttctagcctaggagacttgcgggttggtggccaaactgacaaataggaaatagttgaaaaagagctgtcctgggaagcatttgtgaagttctgccttgcgtgtgtagaatgtgggttcatggtggaactttcaagtgtttacatcctgtgtgcaaatgaaaataaggcacaggtacagcttttactcttcaacaaatattttttaaaaacacaaggcgtcctgatactaaaaagtgatgtttccccatagttgacaggtaaaaaacactttctttct

SEQ ID NO: 12344 - DNA, 1074 bp, Homo sapiens
ccctgcaaaaggcatgatctccttcctttttatggctgcatagtattgcgtggtgtatatatactacattttctttatccagtctatcattgatcagcatgtgggttggttccatgtctttggtattgtaaatagtgctgcaataagcatacgtgtgcatgtgtctttatggtagaatgatttatattcctttgggtatatacccagtaatggtattgctgggtcaaatggtatttctgattctagatccttgaggaatcgccatactgtcttccacaatggttgaactaatttacattcccaccaacagtgtaaaagcctttctatttctccacagcctcaccagcatctattgtttcctgacttggtatcttattgcagttttgatttgcctttctctgatgatcagtgatgttgagcatttttatgtttcttggccatgtaaatgtcttcttttgacaagtgtctgttcatatcctttgcccactttttgatggggttgtctttttcttgtaaatacgtttaagttccttgtaaattctagatattagacctttgtcagatgggtagattgcaagaattttctcccattctgtaggttgcttgttcactctgatgctagtttcttttgctgtgcagaagctctttggtttaattagatcccacttgccaattttggcttttgttgcagttgcttttggtgtttttgtcatgaagtctttgcctatgcctgtgtcgtgattggtattgcctaggttttcttctagggttttcatggttttggttttacatttaagtcttttatccaccttgagttaatttttatataaggtgtgaggaaggggtccagtttcagttttccgcatatggctagccagttttcctaacaccatttactgaataggagatcctttcccttttgcttgtttttatcagatttgtagaagatcagatgattgtagatgtgtggtgttatttctgaagtatctgttctgttccattggtctatatgtctgttttggtaccagtaccatgctgttttggttactgtagccttgtagtatagtttgaaat

SEQ ID NO: 12345 - DNA, 1049 bp, Homo sapiens
aaatggattggattggattggattggattggattggatggatggatggatggatggatggatggatggatgggtggattgaatggatagatgggtgagttggtaggggggtggattggatggatggattggatagataggatgaatcaaggctgactccccattttctggcttgactacctggaatatttgaacagaattcaccaaatgtacagaatgaataatgcttttgaagaggtcatcataataagtactcatcaaataagacaatgacacataattttcttgtagcatactgaagaaggtaatgttcattgtaaattgtgcatgaaaatgccatgattatttaatagttatgttttgatatccaaaaactataaagggagtaaacattttgtgctggtctccttaaagaggctatttagtataattacaaacaaattgagattatgcaatgtatttattttaaatagattctggcacaaacttttatagtagcagaatagaaagtgaaagacttaaaagacatatctggcaacgacattgatcattatgccagtttatatttttcactgatcttttctgcatttccattaactcttatagtcttttgtgcttagagtgtttcaaaagttaaatcatcattttcaatgaaataaaaaatgtaaatagaaaatttttacttcaaatatatcctaaatataccaactccttaagtcgtgaattgtagtttcattttctaaaaaaagtcctcagtaggtttaaatcagaccaaactgaaatcatgggtggatttaaaaagtaaaacagagataacgtttcacatcggtttagaataccaagttgtggacttagaaattacaaagtaagacatctggtaagaaattttaaaataataatgaattgatatgtcttgttaaaacaatccttcagtgtggggaatttgactgtgttaggtcacagagtgagcaatagggtgaatttaaatgaatttttttacccttgcctatctctaaagaaattcccaactttgtctatcaaggagctttt

SEQ ID NO: 12346 - DNA, 1084 bp, Homo sapiens
ctctctctttttctgcctgtaaaatgagggagttagaggaggtttttaggctcaacaagtggagcaaaccttggcaatcactgcagcagaagctccctcaacttatgtatccagtggtgacttagagtcagcaggacattagtggtggcaggaattcctgagcattaatgaatgacatcattgcagccggggaggagtgaccagccattgtgtggatgtagtgggaagagtctacagttggagactagttaggggatttgaaggaaattgaagggcaatctccaaagtataatgccggagatagatctccatggaaactgtgttgtgatgaccctgcacagcactgatttgatcattgttcctatgtccaggaacacatctttcctggcacacccaggaaacaagatgtgccatctccccattgtttcctacagaggagaactactgattttgttatcttgtagtccaagaatagctgcattaaccaaaacacagaaatgagagacttcctctagaacaccagtaagatttaaatcaatttttttaaacatcactaatttaattttgtttatcaattgggtacattgaattgaagtgcaatctcatttatagttaaagaaaagaccaacacaatgactgttcaatatgcatcaccattttaaggcctaagcagacagagagagtcaatcttacaatgatatgctgaagattacatttttaattctcttttcaacggcactaatagaaatcactttggcaatacatttcttggatttacataatgacagagcatgacaagattagttatcatttttaaccactgagttttctggcacgatgcttgtcattgcatctgtgtatacaccctttgcaaagctatggtgacatcagatgcgtacattttctaagccaaagaaataaacaccttcctgggccatgtggtgactttttttttttttacagtgagcaaaaattcaagcccattataaatgactaaacaatattttgagatttaaaagggccattacacaaagatgtcataaagcaagcattttctttaaaattggcatataggcttttactt

SEQ ID NO: 12347 - DNA, 1040 bp, Homo sapiens
tacatgtaaaaatattatcaaaagacctgtccacacttcatgctcaataaatttgagttattatattacgtagacttaatattattaccataattgaggcttgacataatatgcagcctttaatataaaatcacttttataagagattccactcttctttaagcctcaattagtctagcgatgtttctttttaagaatgaatttcctaatgctgccttttttgctgcatttttataacactcttcctaccattcacaaaacaaatgtttattcctgtccatctatggagggaagttatctgtttctgaagttatcttcccacactgatctaattctttccctttttaaaatatcttgtttattttaaaatatcttaaaatatcttgttcctcacaaatcattccatcatagatctgtatactaagaaaatgaatacctctgtattttgactcttgtttccttctttaaagtacagttcagaggggtgattttaatttttaagccctaatcaatctgagctgttgttactgtagaaaccacatttctcatcctgaaacatgacagcagtgatcgcccctgacagttcatagacctgaatttcagacaatcaaaggcaaagcaatttggaggtctgatcatttagaattttcacagtttcaaggaagcacagtacaggttctcttccaatttgtcagaagcaaggaaaagcgcatagttggagagctgagtgccagctttcagccctaggtatcagtgccaaacacatttttattattctctggaaaataaggttgtaaaaaagtaattgctgacacaaccttaatgatagcactttaaggatgctgctgtaattaaaataggaattttattaaactagacctctgagagcctaacatacgtagcattccgatctcaggatttacaaagcaagcaactttgattcctgctgcttttgctgtgtgggccccacatttcctttttgcctctcctagttgcagcgtacgtagaaaaccacctctctcctgaaaaaagcaataagc

SEQ ID NO: 12348 - DNA, 1062 bp, Homo sapiens
acggctgcttgtttgtcttaagaagtagacatctcttccaatcaggaaaggctgctgtttctgtggtacattgaaaagtttcattttctaaatgctacctgttcttatgacagagaggtatgtactgttctttttttcaataagaatttaattcttacattgactatttttcctcctacttttgctagtcattaactgcctacaattaactactggttttaattgtcaaaaatagataataaatttgactgacattctctattttttattacctcatcatgtctcatttgcccttttcttctctcagcttgccattttatatgatcatctagggaaggagcagccacttcctcaaatgttgttttctatttcctgttctatctctcacttgaaacaactttgcaatgcacttttttttttaacatttttctgagtaaatgagtgtattatgatacaccagaaatagccatagatccttcttatccaaatagtgtaaatctgtttatcacttcctttccaattaacctttcttcaagatgatcctggaagtgctgttgttgtttttacttgactttataatcaccttcctgtagtaatccattctacttcttgaggtgctggtagtcttgtcaggatgcccttgtgggtggcatagctgcgtgtagcaatttatactggttccttgaagattacaagcaaatatttctgtttggtatcagtttctctccgttttcctaaggaaactattttattactagttcatttgtaacaaaatatcccaacttctttgaaagaaagatgagttgaggtggcttccagtaaaaatgcaaatataacagcacagttaatgtcagaaagaaacaccagacctctcagagaggaaactttatggagttttcagtactaaacctcagagaaactggcagccctcataaatcaaaggcaagaggtatgaaaataaagtaatactagagcagggaaataacctagttactgtataaagcagagaagaaaaaggtacagtggtgtataattctacactttagtattgtgagctgttga

SEQ ID NO: 12349 - DNA, 1042 bp, Homo sapiens
tgtatataattattatccggttttaggtggtacttaagttctttgtccaggatgagaagattcatttgtgtacatcatcattatccctcctgacatgtgctttggtgacattaatctatgttttatttcctgcagctgtaatgatggggttgtcttccgtggctttattatgttgtcatgtttttttcagtgatcgtcctcacagtacaaaagaaatatctcatgtggggataaactccaaaatagctgacatttaacagtcatactggcaagcatctagttttctttcccttcattctttgtccctgtcaagctgagtcctggggaattatcattgactgtggtcagaacagtagttgtttgtaattttacatggaaaacatgtctgaggtggagcttgtttcttaagactagataacttgtacaggagtaggctagatggaacatcaattcaaaccggcaaatgactagctgattttgagggaagcttggaagaaagaatggattgcaagggtgtctgatttctagctgtagttgcagccagtggcctttgtagtttagagggtcagaatctaaatctgatagtggaagttcaaaggaaaacaaatgcaccaggtccttgctttaaggacagcaaggattagcttagcagtagagatctaataatccaattttaaattataaattttttataaaaattataattctttataaaagtgttgcaatttataattgtatcacttttatttgcattttcagtaacagaacaaactatgtgggcatggcttctgtaaacagaatatcaagactatgatgatcagtgactgctctgtacttcagctcaatagcccctgcaaacagcctcatatacaaaacacattaagcacagggaatgatgaaatgaaatcaaccagtattgtttattaatttgttagatgttttaataaagccaatccccagggcagaatcaatctgcgtaaccactgcacattgtatatgctccgattaaggcatttaatacattaccttgcagttgtgtgtg

SEQ ID NO: 12350 - DNA, 1117 bp, Homo sapiens
catatgttcagctttgatagatattgccaaatagttttcaaaaatggctataccaatttatacacccttcccctacctaagaaggtttctgattatctgttttaaaaccttcatgcagcctcctattttgaattaagttatacagctttctctccaatacctgtatcttctacctcagtgatgcttcacttcagtttgccttggacagactctggatataccaaattcatacctattgttcttgcataattattattagtgctcctttcattttcaatttgtcctaggttagagggagatgaaaaaaattctaaaattagattgtggagatgtttgcagaactctatgagtgtaataagaaaacattgtgtatactttgcttgggtaatttttttggtatatgaactgtatctcaataaagctgttttgatgattttttctagtttggatgataaattatgtggtcattctacttaatcaatttctaccatttgcaaataagttactttaaaaaggacagaaagaaagatacctaaataagcctcactgcttcatttggaaaaacaaaaacagacttcccctggcacagtttttgaagcattttctagcaagagatgccattgaaagcaagggaaaattgattgtgctaccccaatcaattaagctactcttttgaaaggggaacccttccactgggattgagtttgttttataatttaccaaaaattaagacaacttttaaagtaagtgtaccttataaatgttaccacgagacagaatatttaattaaaactgtggtatcgccgttacctgctgggtaacaaactcccctagaactcagtggtgaacaataatcattttatcatgctcttggcctttatgggtcagggattcagatggagcacagcagacagtttgcctgctccacgctgtcttgggcctcagcttagtgttagctgaaacctcagctcaactgtaggtattctagcacatgcaggtattctagttgagccagaatacctacatgtggcttctctgcatgggctagtttgagctttctcacagtatgacagctgggttccaagatagagtattccaagagggcaaagcggcagtg

SEQ ID NO: 12351 - DNA, 1075 bp, Homo sapiens
ggaaaccacgattatgcatgtcagggtgttttggacttgagtactcatggtaacataaagatataacagttatgaagatctttagtcatccatagctttccacatttttgctgtgatacaaaatatttagctccattttcatagcactcattaatggtaaatctaaaaaacaatgttaaataaaattttctaaatttgctaacttgtctctaccaagtttataattttactatatatactagaaaagggctaggttgattttttttctttaaatagaatttatattttggagtagctttggttcataacaaaattgatcagaaagcacagagttcccatgtatccctaacctccctatagatatacaacattctccattatcaacatcctccaccaaagtggtacagttgttacaattgaggaacctatactgacatatcattatctcccaaagtccatagtttatgttaaggttcactcttggtgttgtatgttctatagattttgagaaatgtataatgacgtatgcaccattatggtatcacacagaataatcccagtgtcctaaaaatcctttgtgcttcacctatttatccacccctccttctgattactagcaacccctgttttttttttttaattgtctccctagtttttccttttcccaaatgtcatacagttagaatcatactatgtagtctttttggattggcttctttcacttagtaatagcattgaattttccttcatttcttttcatggcttggtagctcattttttttggtgctaaataatattccagtatctgaatgtaccatagtttagttatctagtcacctactgaaagacatattggttgcttccaaattttggcaattatgaacaaagctgacataaacatccatgtgcaggtttgtacatggacataatttttaatacctttaggtaaataccaatgagcatgattgctggactgaatactaagagagaatatttagttgtctaagaaactgccaaattgtcttcccaagtagctgtaccattttgcattcccatcagcaatgaatgagagttc

SEQ ID NO: 12352 - DNA, 1049 bp, Homo sapiens
tttaggataagactgttaaagttcatgagataatgaatgaacaagacaaggtgacctaacaatgatatattatcactctttatttaataattgtgtcattttacaaatgcttattaaatgcctacattgtatgaggcactgtgctaggtgaagaaaatataaaacatggttcctatctttatgtgtcttactaccaattctgatgggtttgacttttatagcatacatacagggtatgtatacatgaaatgtaatatatcttagaatgtacaaaggctgctaatgtgtaagctgagataattttagaaagagtttaacacctgaaggaatggtggaacgtttggtaaatcatgcagaacatggaacagtttttcccactggggaacagtaatccccagtgttggaggtgggtcctggtgggaggtgattggatcatgggggaaaaattctcatgaatggtttagcaccatctcagtgctaatctcatgatagtgagtgagtgaattatcacaacatctggttgtttaaaaatgtgtagcacctgccgcgtctctctctctcttccttctgctccggccatgtgaagtgctagctctcccttcgccttcttccatgattgtaagtttcctgaggcctccccagaagcagaagctgctatgctttctgtacatcctgcataaccataagccagttaaacctcttttctttataaattactcagtctcaggtatttctttatagcaatgcaagaatggactaatacaccatatcatgaaacataagtcttcagaagttaaaaaaaaaatctaaaacctgccagatataaaaagaatcagcactgtggtatatgaactatatattaatggaagcaatgcataatcataagattgtcgtcaacagacacttgttgtgcaacaattatgtaaatgtactggggcagaatcgatggataagtccaaagccctggcctgaaaaacaaatacacattccattttaaaagatgctgggtatattttcttctgaaaaggattggtactttgactaatagc

SEQ ID NO: 12353 - DNA, 1067 bp, Homo sapiens
tgacctttattttctcccctacctgtcccctgcctctgcagtctcccttctccaccctaacatcatcactccaatctgccctccattttctcctctcccaggctttggttccagttatttcttcttcctggagtacctcccctctcacactcatttctgcttatgaaagctcttctttttcttcaagcttagctcaaatcctacctcttccaaaaagccttctcggttcccctagttgaaataagtcttcttccctcttccaggttcctttagcacttactatctctcttataacttgtttcatagtcatccttatttcagatttatttgtgtgtgtatgtcctgcaggaacatggagtgtaggaatctcacttccatcccactccatagcagccagcccagtcctcagcccatctattcagtgggtgctcagtctgtctttgtttaatcacttgaatttgaatgtgagaagggacttcagaacagccattcatatccctttgtaaagagttctgaactcttgcttaatcattgttgactgactcctctacatggcaaagcagaggaaaccttatgtctttcttgagttaaaattaccataccttgttataattctctatttctgtaatgttggcccacagtatagaatgatcaaattattttaattccgcatcacttctttcattttccatccattgtttctgttgtgactcctttcactcattttttaattttatttttaacttaaaatgaatttataagcatagtcccattccattttctaatctgactttctgccagatatgttttatgtgtgggataagaggaaagaatgaatatgtggggtgtatgtggaatgctattttctgcctcacagacttggaaagacatttcccattataaaaaatgtgcaaattagagaatttccagaaatataagtgtgtgttctgtgagcaataatgctaagtaagaggtaatgtgtaattaacttttgatttttggctgcaatcacttttgtggagaaagatcactgattatggctgtgtttaataaggtgaaatagaatc

SEQ ID NO: 12354 - DNA, 1049 bp, Homo sapiens
tctttttctgtagcgtttctgtccactgggcctttttctttaaaggaactctgtttaccattcattagatagtccatttggagaaatatgtgcagaaattaataaatgaaaggaaaaaagtgaaaactccctttagtcctccttttattacttacctgagacacctggtatttgaaagagaggaaaaaaaaaaaacagaagagtaacagaaattctacctgaaaacctgacttcaagtattgagctgctgactggtgagaactagagatattttcctcattcacctcaccacttacttggaaattgtgtttctagggaacacagattaaatgaaccttaggaaacattaacaaaagtatgtttgatttttaagggtctgcctatataaatgtacaggtcggttaatcagttcagcagtctttggggattcatttgactaatctttggttaatatgaatgcttatacatatcatgtcatgttcccactattttccatggctggtgttttcctcctgtgcctttgctctattccaattttattataaaatccaattataagttggaaacaatgtagtctgtgtttcttagtactagccattgaatccttataaataattttaaaataaataaagagtccatcactctgtcttcatcctctggttatgcctgcaatctctctgctcccatacccacatgttgaggagtgacagggatctcccaatcatgatattgaccaatgtgagtgttgaccaatgaactcaacgtcaagacattttacctctactacatcctccatttagcatggtgtatttcttttgaatccattgttaatttcctgtcactttaattaacatggctgtatttgacattatcctaaagttttcacccatccccccaactccctttttttagcagatcttaccacccacaatcctagtgaggttcttgggctccatctgctccttcctttgtgcactcagttctcttaaacacatcggtcctttgctccttcccttctttgcatggctggtcattctacatctggctgt

SEQ ID NO: 12355 - DNA, 1071 bp, Homo sapiens
cacgcatttaggtgataaaggtgataaataaacattattttcccctttaactactgtactgttgcttgagattttacagtacacaggttaggcaatgtattcttgtcagtactgattatttttctttgttttgcgaggatttggcttttattttttattgaaaaatggatcctagcaatttgtggcggattattattacttggttttacaaagccataactggtgtgtatgcatgtgtttggattcacacttacatcttgaacaaggaaacattagaaaggtatttcaaaatcacagtaaaaaatacatattagaattcacaaaaagaaatcactggtctaaacacggtatgcctgaggcatagcgttaatttcccctgttttgccataattggatctgttacctggtgtactgccatttcatcaactgtttgtgaaaatctctatttagagaaaacccttgtctgtttagctcatccgccaccatcatgactgcctcccatgcatttgtaggttggtctttgaagcatatgttctgaagcggctgattgccttcctcagctgtaacctctgggtcttaattaagggaacattgtatttttctgacctaaatggtattatagcatgtgcagttgttaaactagtggagttttctgtattttcagaggctaataaggaggcagaaactctgaaagttgctctgtcttgattctcacctccatggaagactccaaaactgtgaccttaagctttctccctaagtaggggagtgtgattcttagctcttggggcagggctttagggcactttcagtgagcgcttatagctctttcatgaaaagagcattgacacataccgagtgcctcctgggtggtgggtgcccatctaagtgcttcccatgcattgattcatgccatcttcccgacaacactgtgaatttctaactgtttattattgttcacattttatagataagaaaatggaatcacagcaaatataagcaacatacccaggagcacgcagctggcaaacagctgagctagcacttggactcaggcaaactggctcccga

SEQ ID NO: 12356 - DNA, 1875 bp, Homo sapiens
aacatgcagtgaagaacttaaaatactctttaaatacatgggatgcaattttaagattatggtagacggagaaaaccctctttacattaaatttagtaaatctgagaaatgtgttggagatcaccagaaaatagataataaaatttggaacatttgtaaggaaacaaatattttctagcttaaccagacaaacaaaaatgtctaatcttatttattttataaagatgtattcctactgctatatgatgtttatcttatattgaacacagttaattttaacaaagcaatggaaatacaagtgattttgttttagaatatcaggcctctaggtagggtaaatgcctttcaatcctaggcaaaagagtataatacaagaaatttgttttgtattaagatttttttttcctattagaggcttcagttcctggactttcttggctgtttttttcttattgtgcctcctttaatatttttgcaaaaagtggagaagaaaaaatatttgaataatcgtttttttaacccccctaagaaacctgttggaatatgagattttgaagtaatggtagatacattttgcatttaaaaaaataatacttctaatattttttatttggaggttttatttgggttttctttttttaaacatgaaaggcactttacagcacactggtggcttctgaaaggggttgctggaaggcgaagtgctgagactgttgtctgtacaaactcaggacttcccaggagagctgaattctacatgcctaaacctgattaggcataaactgtgtgtgggcggaagggagcatgaacaccaggttcttctctcaaattctccagataggagcatcccagccccttagggcttggctttcctgctgtactccagcctcagggagttgatgtacagatacctccgtgttatttgcaggggccccaacctaaaatagcatgtgggactttttgtccactaattttgaactttttttaaaaacatacttgccattttcctttttattaggctttctgatacaatcattttatatttagggtagaggtgggcatacttaggacccataggctccacaatatgcaccattctgtgtgtgcccacacatgcgtgcatgcacatgcccagagtgccactagcccacctgcccttgcccccaacaaaagcatgcttcagcccttctcaaggaccagccaggtgccttctggcatgatgagtttctcacagagacctcctgtgagaagaatattctgaatgcacttcctctccctttgcttccaattttggctgagtgttaataggtgctcagcaacctgaagggagaactatattttcttcctcgtctcatccccaatgtctaactcagtgtctggctgtcactcattatatttgtttaggcagcagcaggaagtaatcctgaaagcaattctgaaaagtcaggcttgaggcctcacaagttcattgcccagcatacaagacataggccccaccctgtttaatatctttcttctcaacagatagcctcacatgcaaaagctacacagttaggagatctgtgccaaatctggaatttgcagtggctgatgacagacagcagtgtcgattccgtcactctgcttgattcccacccacgtctgatgcctgctgagaacacactctgtgtgattccaccctgtttccgtctcactcgcctttgtcaccatacactcttcttttctaaagctagctggctctttgtctagacagctccctccctcatctccagatggctttgtctgggaagcctacagtcttttccactaccaccccaagatgcagaggcaattaaatcaggctaactctcatggtgttactccagttaataggca

SEQ ID NO: 12357 - DNA, 1061 bp, Homo sapiens
tctctgtgaatctgccgtgattctgagggctgcccaatttgtgaatcattcattgctcaattaaactcctttaaatttaatttggctgaagttcttttatcaatggccatgattgattgaatcattagccacacgactgaactcaatcattagaccttttcctctccccacaagtagggctaatatcacctgactcaaagccccaaccctttaatcacataattggtctttctagcttggcagcccccatcctgaaattatctaggggcctaccatgagtagcttcattagctactcatttagctactcatattgtggaacctacgtgtggtctgagaatctaccagaaataatggagacttctatcaatttagaaattccaagggcttagaagctttcatcccaggaacctgggatgaggaccagacacattatttatacaacaaacagaaacttaaaaactgtttggtttataaattttattataggaatgctggcccagagataggaatatagcaactaattgaggccaaaaagtcctatgaagaaaatcttcacagtcaaagcacaagttcatctctttgttagagaggtagctgctgaggatacaagagaacaataaatgaaatgtgtttaactcatgtttctgattcaagccttttctggaagacatggcattgtagacacatttaaatcactgaggataaagttgatgtcacccattccttggctcgagggctttggcaattcccctttcattacctcatagaagaaggaagatctttgctaatgaagttctttctggtgtctcctgggcacagggtaaatctcacaacagatatttgttcagttgcttactgtgtctcctccatcatcgtccacgatccctgtaggatttttcaagtttaaacaagcacttacttgtgtttgatatctagttaaaaagctaaataaatagcttggttggaaaagaagaaaaacattgcacagagagttaaatattccatggtagacagaacttgatcatttcacaagtatttttcacttgctatttttactgt

SEQ ID NO: 12358 - DNA, 1029 bp, Homo sapiens
catgtgtttatactcattttgtttactgtcagtatctctcctctagaacataagtcctttgatgccctttctgtctcttttgttaactggtatatttctggctacttagaatagtacctggcacacagaaggtattcaacaaaaaaattgctgaataaataaatgagtaaactgcatgatttattctttagaaaaatcactttggcagcactgcgggaaacatttggaatgtggcctcaagcaggactgttaggagattgttgcaatagtcccgctgaagttgacggtggaggtgtagatgagaagactcagctaacgggtgagttactcaggaggtagaactaagagaacttgtaatgtgattgtctatagggcttaaaggagaatggtcactcccaggttcctggtgtaggcactgacagaaagatagggttattttctgaggtaagaaacatacaaagaaaagtagactttgggtctgggttggaggtactgagttcagtgttggtcatgtttagcttcaggtagcagaatgacatccaaatcaagatgtctacttggtggtgactgagagggggctgtctaggctggatcttcaacttagacgtgaacctaaagctgtagaaatggatggtgttgttcaagtagaaggtgtagacgcagaagatgagaacaaggagtattgagagaagaaaatagaaacaggaaatcaaaataagcagtgaaaagtttactgcacttccaaaaaactcttgaattccttattgttatgtttgtcattacattacagaactttaaaacaaatatgtagttcagattctagctctgaagctgtagtcttggtaacttaacctccttattccttctttttcttcatctctaagatgggtccaattataatccctacctttattatagatatgttgtgagggctagatgaaatacatgtaaagcctttagtattagaatgtgcattcaataattgttcactcatttttaattattaagtttaaactttcattattttta

SEQ ID NO: 12359 - DNA, 1046 bp, Homo sapiens
atacaaaaaataaataaatggaggagaagaagcagtatctcctacagaattccaaacaattgatgcagatacttcactctcaagaaagtggtaattttccactccttaaagtgtaggttatgcatagtgactttgtttcagagtatagtgtggaaagggcaaggaagcgactttatggtagttactcacagccagatgatcaagacatcagcagtgataagcactattgctattatgtatgatgtgataaagataacacttcacctctgtggtcttccttcccaaaatacataactccagtctcataatgagaaaaacgtcagacaaattttaattgatggcattttacaaagataaatactcctcaaatctgttaaggtcattaaaaccaacggaaatctcagaaattgttagagccaagaggaccgtaaggaaacatgacagctaatgaaatatgttttcttggatggggtcctagaacagaaaataatattaggtaaaatgaagacaattgaataaagtatggactttagttaataatgatgtatcaatattggtcctttagttgtagcaaatgtgcacttagaacgtgtagtaataggggaaactctctgggttgatataagtggagcgatgaaacaaataggtgaaactgtaatatttgtaatttttgcaatttttgtaatttttctataaatctaaaactgctgaaatacattttattttagaaaaatcaatgtaagtatacctactcatgtgttcatttgtagaattattagccgaaccattttttccagtttcaataatttctgctgaataaaacttttggtattcatgctactcagtttatttctggaatacagcaattctttgatttctccttataaatatatgcaagaacaacagtgtcctttagttgttagaatcttatatagtccatatattcttcagcacccatgttattcattgtctttttacaacctgctatttaaggacaaaatacatagagtcacaaatggaaagtaaagaagaaccatctctttcat

SEQ ID NO: 12360 - DNA, 1092 bp, Homo sapiens
catattgcaaactctagaaccaccactaaaaaagttaaaagaaatataattgagatgctcagagagtagataacatgttatataaaacgctcaattaaaacgggagaaagaagaacaagaggggagaattaaagcaagagaaggcaaaataagaaaaaaatatataaaacataggaaacctagagtcgtaggcaaatccttattgtctacaagaagcccactttaaatataaagcatcaagttaagagtaaagggatggagaattatacagtatgttaacaccaatcaaaagaaagctggagtcactatcttaattttagacaaagcagacttcagtacaagggaaattatcagggataaatagggacattaagactgataaaagtatcagttctccaggaagacataatcataaaaacatatgcaccaaacaacagagaatcagaatacatgaggcaaaaactgatgaacttgcaaagaggcacaatttcaaaataacaaattgactattgtagctgtggacttcaacacccctctttcactagttgatagatcaagccagcagaaaatcagtaaggacgtagttgacttgaatagcattatcagtcagcttgatctaattgacatgtataaaacactccatccaacaatagcagaatccacattttcaagcttgcatggaaattcaccaagatagatcacatcctgggccataaaacataccttaacaaattttaaagaatagaaattatacaaagtatgtactcagactgcagtgaaattaaactataagtcaataacagaaagatatttggaaaatgccaaaatatttacagattaaacagcacccttcacaataacacatgactgaagaggtcacaagataaatttaagagtattttgaatagcctgtagtctcagctacttgggaggctgaggcaggaggatttcttgagcccaggagtttgagtctagcctgaacaacatagtgagacccaggcacttgaaaaattttttgaataaaataaaatttaaaatataacttataaaaaattgtgagtttaactcctgtcttgccatatactagcagta

SEQ ID NO: 12361 - DNA, 1026 bp, Homo sapiens
acaacaggagagatgaaaaaaaaaaaaaaaaaagacactagaggactttgaaacctctgacaaccacatttatagcaaacattatatacaacccaatcttagacagataagcctcaagctgaagtcctttttgcctcatttcctgttatctgatacatcatgtctagctttcaacagaaaattacacagatgaggctgggcacatggctcatgcctataattctagcactttgggaagccaaggtggacagatgacttgaggctagaagttcaagagcatcctgggcaacatggtaaaaccccatctatacaaaaaataagaagattagcctggcatggtggtgcatggctgtagtcccagctacttaggaggctgaggtgggaggatcacttgagcccaggaggtcaagactgcagtaagctgtgatcacatcattgcattccagcttgggcaacagagtaagtaagaccctgtctcaacaaagcatgctaacaggcaaggaaaaacagcctgtagatacaaagcaagcgtcagaaccagactcagatgtgacgcagattttggaattatcacacagggaatttcggtagctatgattcatatgttaagggctctaatagaaaaagtagataacatgcaagaacagaggggtgatgtaagtggagcgatgaaagagctaagaaaagatcaaaaggaaaagctagacattagaaacacagtaacagaaatgaagaatgcctctgaagggtcactcagaagacttaacacgatttttaaaagtctcagtaatcttgaagataggtcaatagaaacttcccaaactgaaatgcaaaaataaaagaatgggaaaaaaaagagccaggcatggtggctcacacctgtgatcccagcactttgggaggccgaggcaggaggattgcttgagcccaagagttccagaccagcctgggcaacatagtgagaccctgtttctaaaaaaataaaaaaaattagccaggcgtggtggcatatgcccgtggtcccag

SEQ ID NO: 12362 - DNA, 1068 bp, Homo sapiens
ggaagtttatagagtacagttcaattgcctctccataattaattgaaagctctccaaagggatggcatttgaaagatgttttggaggcagatagaaattgttggttagacacattagcagatacacaataagagtaagtgattagatagtagtagcagctaatatttttcctgttatttagctagaaaaaatgaagattcggagaaatatagctaaatcttaacatgatctgtttcatagaaacatggtattctttgatttttatgtgatatggtcctagatattatgtgatatggccctattagattgaacacatgtggtattccttttgccctgtagtacttacctaatttatttataaaatactgtgctagaccctgagaagagaaagagatgtacaagacagagttagagttgcttccctcgagaggtccttgcctagttcgaggtgacaataaacatgtgaaaagagtaatgcctgacagaaatttgtgctgtcatatgatctgtcactctgtgagctgtagcaaagattttgaaatcaagaaagagaaatctttgagctcctgaatgtggaacaacttaatgggagggaagaagaaaaattgggggctttgaaaggagaacagcgtgagaaaaattatgagtgcaggaaggtgtaagacaaatgaacaggggaatgagtgttcagtgtagcaggtgtgatgatctgttaccaaaatatctcacactatgaccaaggattaacaaaaagtataagtagatggaaccatgatatataattatatcttctctctctgtttttctttttggtgtctttactctgaatcctcttttgcatttttaggcttctccttgtgctttcatatgtacattaattatttagatagttctgtattacacttttccttggtgatggttaataccctttgccattatctttatgacttctagttggttttaatattcacttacttaatcttctctttcttgatttacaattttgctttatttcttcataacttggtcaaaattttcattcaattaacaaaaagtgtgtttgaatag

SEQ ID NO: 12363 - DNA, 1234 bp, Homo sapiens
ctctgccttgggccaaattatttcctccatccctccctttggagcctgctcccttctgtccttaggtttgtgccagccagtagcctcgtaggtgcattagaaattaccctcagatgaaggctgtcaatgtgacttttaaaatgtttattttttatttttttgagacaagatctcgctttgttgcctaggctggagtgcagtggcatgatcacagctcactgtagccttgacttcccagatttcagcgatctctcacttcagcccctcccctacacacctttataccactccggtagctgggactatagatgtgcaccaccacacccagctaatgtttttaattttttgtagagacgggtctcactatgttgccctggctggtcttgaactgctaggctcaagtgatcctcctgcctcagcctcacaaagtgctggtattacaggcttgagctaccatgcctcgcctggcttttttgtttaatgttggtgcctagcagcctacttgactggacacaggcagctgttgggaaagtggtttttcacttgcctttgatgcttgtatttttttctgacttgtttctggatgtctctttctacccctttccctatatatttatttacgcttactgtgtcaggtccttaagaaaactggtactgtctttcccattaagatgtattaaaagcattgatgctacctaatccaatcctcacctttgaaaagccaaggagctggtatgtggatattatgcatggaagttcagggcaatggagatttaaggtttaacgggcagattagatgattggattccttttctgtacttggtcaaagagtcttatttaaatgtgatgtaagtcactagtctttaccattggtgtagttgttaagtatactttcaggtcttccttgttctgttttaatgctgatttaccatttactaactctgtgactctgggcaagatggataatctttttgtgtggcagttttcttagctgggtttgataatgatacctacctcccaggaaggtcgtgaggaatctcttcttccacgagtgagaatgcctagtgcagtgcctggcactcagtgggcactcagcaacgacaagtgcaatcacacagcagtggccatggttggtgttccacaggctgcctgtgtttgaatcctggctctgatacttctagtcctggtagcttgacttcatttttctcttactataaaatttctatgcaaatag

SEQ ID NO: 12364 - DNA, 1270 bp, Homo sapiens
gcatatttataggtatctttagaaaaacagttttctgtgatcaagtaaattggataaatactaggtaaacaaaattaggcagccttctttttttttcccagattattctgagcctttaccatgtgaatgtgtattttgagtctctgcagggggttatggaatggaagttttctcaaatataatggaccacagaaccccctttgtgttacatttgttataattcctgaagaaaatctttagaactttttgggaaaaagttgctttaatgtggtagcctctcaggctatcaatatgtatgggattatttgcctctattttgaattaccccagactgctgctgaatttttgtctccttttaaaatacattttctacatattcttgttttctgcagttttcatttgtcattgtgagtgctttggtttctcctaactgcctgataccatccccttagcccccaccagttatgatacaggtgctcatataatttatcattcaaaccagaatacttttggaagtgaaagagaactttgttaatagttatgctggagtagtagctgtaaactgtgactctccagggcaaactgaaattgtcacagctaatataaaatctaatacaaactcatataaatagtagaagcgttttattggcttacgtaaatgaaaagtttagaggctgactgggtgctgttatggcttgatcagggatctggattcatttacctgtctccatgtgtacagattatctttgggctggtctccatcatggtacaaaataattgcagtatttttaagttttacatcttgccagccagtttgcacagtttgtcagcagaaaagagagcatctttgtcccagaattcttagtagaaatcttgagcttgcgctgattggacaaactcctaaaccaatcgccaaggcctgaagaattccaagtccttattggtttggatatattgcagcaattagtgaggaatggagatgggattactctgctattaccatggttgacagaaaatatccctggaggtgggactctatcccatccagataaaatggctgctacatgttggaggctggatagaatggatattgggcagacaaccacattctctaatatacatcccttctttatttgtttcctcagctctgtaggagacttggcaaccagctatccaagttaactagaattccctgtaaaataacaacaagtgttcaaaaggccctcctgtaatgaatgtgcatgaatactggatttgtcacatctatttg

SEQ ID NO: 12365 - DNA, 1031 bp, Homo sapiens
gaatttttgtgtctcagtgctttaaattctcaagcgtttggaatttctatcttttttagagaaaggaaccattttatttcttacattttacacaagcacaggctatgaagcagagtgtttttctctctcaaagaacagtgtcagtgcatcttaagcaaatatatagacagctaaaactactgcagtacaaatgacatgaaggactttaggcatccccataacccagagttacatggtttcagattaagtaaatgctattgtgtccttaaatccttgcttcagccacctgagaggtctgcagaagcagatgacagtgatggtgctggaggtggggccaaagctaggacttgtcattaaccagcagggccatttctacttcacactctattctaatgctactttcttgttgtctctcatgtggggataatatttctgatttcatgccaactgctcagttttcagctgctgaggattctgctgagtgatgcatcatgtatccctcctcctgtagaaattcaagggaaattgctctctcaccatcacaacatggttgaagcccttaagccggattgtttacactctgcctccatcgcaggattatttgtttccttccttgcatcgctttgggtatttgatgctctattcgaatcattccttttccctccctcctcactctctccatttcagatgctcaacatggaattcctgtcagaagtctttttagagtgcttctccaaagctctgaggacttcctgaattataagagttcaccaggcccaagttgtagtgaagatgccagtctgtctgctatagcaggatttattttaaagcatctctgaagctttttgttttattctgctcagagtcaagagaacccctcttggggacagtgaaatatacttaggcacgtttctcctgagcacatgtttatattttagcgtgaaagagccccctaagcttgctaagaatttatatagcaaagattgcaatttctcaagtcccttgtaaagtcattatggttcatatgacct

SEQ ID NO: 12366 - DNA, 1093 bp, Homo sapiens
tatgatccagcaacccccaccattggatatatatccaaaggagaggaaatcagtatatggaacagatagctatagagtatatggaagagatcagcgtatgagagaacactcccatgttgattgcagcattattcacaatagctaagatagggaatcaacctaagtatctatcaacagatgaatggatgaagaaaatgtggtacatacacaccatggaatactattgagccataaaacgaataaaatgctgtctttcacagcaacatggatgagtctggaggatatcatgttgagtgaaataagccaggaccagaaaaataaatacagcatgttctcactcatatgcagaaactaaaaaagttgatctcatagaagtagatactagaatagtggttactagaggttgggaaggaaaagggaatggggggatagggagagattggttgaaggatataaaataacagctaggagaaagtataaatgggaggaataaattctagtgttctgtagcacagtgggatgaatataattgacaatagtttattatatatctttggatagctagaagagaggatttggaatgtttcttgcacaagaaaatgataagtgtttgagatgatgggtattaattgctctgatttgatcattatacattgtatgtatcaaaacattactatgtaccccataaatatgtacaattatgtgtcaattaaataaaaaataaattgtagtatatccatacaacaaacactactcagtaattaaaaaattaactattgatatatgatacaacagagatgaatctgaaaataattatgctgaattaaacaaggttgacctcctcaaaaagaatgtttactgcatgatctcatttgcctaaaatttcaagaaatgcaaacagatctttttgttgttgttgggggacaggaagaaggagggatggaaggtgggatgtggtgggagaaaagagaccaacaaaaagtaaataaggaaatttttgagagtgatgaagcacatattttacatattggatatccaattccatcttgattgtggtgatggtttcttgggtgtatatatgtccaagagctta

SEQ ID NO: 12367 - DNA, 1045 bp, Homo sapiens
taggaaattattttgtcataaaataaggctctgtgatgggttcttaaagagattatattattcaaaagaaaggggtcaccatttttctggggcttctgaggagttgtttcctctgtaatagattgaccatgagatatgagatcatcttagaaatatgtttttctgctttcaacagcacttgagggcatgttaacatgtgtgagactacagtcagctaaacaggccatcaggataatgaagaagaggaaggattacagagagccgaaaagctggaaagccagcttcaatagaaataatgacaggagctaacatttattgattacttactaggtaacaggcattgttctaagggcctacgtgttttaactcaatccttaggacaaccttttgagggaggagatacggttattaacctcatttaggaaacctttgtaggggagtgaatagaaaatgggacactatggaagtcaaaagtaaggaagtagaaaacaagcttgagaaaaaattttcccaacaaaaggctgaaaatgtagaatatgagaactatggggaaaattatagcagcttttaatggtgttatctttgaatggtaagattaggcatgacatttgttttcttctttatgtttttcaatgttttaaaataagaactttttgaaaaatgcttttttttaaacaaagagcatagttgacagagagcatctaaggttttcaataaataatcttaaataattcaatgaaaattaaattgcattacaggcagtattcagggagtagacaagagtgaagcagccccgacagggagttaacctcctaattgggaaaatagagcagagagattcatgctgctgaagaagcactgtgactatgcaccttcactcctccaactcaaaaagaagaagaagaaaaaaagcccgaggaaaatgaacaccactggctagttaggagtattttgagaattcactttaaagtgctgagaaagcactgttatacatgataattaaaagttagttaataatttatgcttttaattttaataaattatt

SEQ ID NO: 12368 - DNA, 1074 bp, Homo sapiens
gcttttcaaccagaggcaactccccaacatcttgcacccccaaggtatatttggtaatgtctagagacatttttggttgtcgcaactgagcatgtgactgcatttagtgggtaggagtcagagatgctgttaaatgtcctatagtgcaaaggaaagtccctttccccatcaacaaagaattatctggcccaaaatgtcagtagtgctgaggttgagaattcctggtatagatattcagaaagaagtaggggaaaaaattaggaacaaaaactccttttaggttaatttgatttgaaatattagaatgaataagtatttaacaacattaaagagggtctattattgtaggtaagagtaaggaaattagagacagttggggaagaagcataaaggcaatagattttcctaggcattttaacaaatatttgttgagtgactacacatcctttctggaacaagatgaggggagaataaatgtatatatacaaacatatacaaatattgaattctgttcatgtgcgaagcttctacagggaaaagaaaaataaataactatgatttcctgtcttcaaaaagcctgcaggctagtagaagatggcatgagaaatatactatcttctaagacaacgaaaagcctatagatttcaaaggaaaatataccatgtctggtggggaaaattaggaaaggctttatggagagcatcctgtctgaagtgtatccctaaccatggacaggacagcagtccgtggagatgttggaagggcatacaaaacaaagggaacagcatggcccaaggcacggaggagggaagatacagggtatgtttggagtctttaataatcaagttgatgaaagggtagaatctcaatgggaagcagttggaaatggactaaaaaatgaaaaccccaaacaaaagaagacaaacaaaaacaaataagattaagattatttataatagatggggagattaaaagaaagaagagatgagagaggcaaagtgcgtaggaatagacatttgatttgatgtaggcaaataaaaaagaggaaggaataaaagataatcctgaggtttt

SEQ ID NO: 12369 - DNA, 1024 bp, Homo sapiens
cctccagcaggttccttttgcccaggtggtttgaagctaataattaagttctttgttggttcttgaaacattgactgaaaagtttgacttgcctgaaaacatataggaaaagttttgaattaagagtgttgtcccttattggaatgtgttactgagaggggtcttacaatcatttctttacagcctttaaataacaatttaagtttttcatcagccttgatagattaggcttagaactcctgaggggtaagcacagattaaaataaatctccaagttgctttctatcttttcctggctgtattatgtgctactcttttcagattcaacaaacatttaggatggcaggaacactgtgcctgatatttttacatatattaattcagttaaagtaattctcacaacaatgtacaaagcaggtatcattgcttgtgttatagatatgagacaaccaatggttcaggaggtgaagttactctttgaaagttgcacagctaggatggggtgggtgagagaacttggtaccaggacttggagaacttggattctgtcttaaaattccattgatgagctctgaatctcaggccagttttcagtcttgttttagactccagtttcgtcatttggagagtgaaggggttagaatgagaagattggaatacatttctttgctacttctgtgatgtgtgacctaggggaagcttgagagaggtacatactgaatgaacattactttgtttttgtacacactgtgagaactccttgtgtaggtatatagatgtatattattactgggatgagaattttgggtgtggacagaaagtaaaacctgacatctctatatgacctaatgatcaaatatgcagagcaagtggagtagaattctcttacagccatttcttaatttgtctttatatatatatatatatatatacatgtagtctttgatcccaggtctcctaccacccatcacattggaaatttctgggtttatgtctcctcctgaatctcactatgtttgattat

SEQ ID NO: 12370 - DNA, 1031 bp, Homo sapiens
aaaaattaggaacatggtgctagttaattcaagtcttcatgtaaaacttcttctatcatagtggacattaaaaaaaatctctctgcaaagtgcattgaccctacctctagtagatgaatgttgaacaagtagcctatctaggaagcaagtgactagcatccatgggcatcccacaggttgtagtccagccccgatcttggtggttgggattgatgttgctgccaagtccctccgtttcatgttcaggctctgcctatgttcctggtgtctggtacctgatttttcaggatgctgacatttacttcttgcccacaacaccatataccctaagtcttgccaacatctttgaatgtcttctgctggtctgtctctcctccgttgttcttttactatgtcccaagtgcatgctttgttcagtatctgcctaagtctcaggatactgattttagctttttactaggtcctgacattcccgtagtttcctcttacctttctggacatgccagacaaactctgaccttaggttctgtgaaaactggtacctgcagaattcctcagtgtttgtttatatgaaagttcattgtgcctcttgattgtgggtgagttgaggaaaaggggtaaagcagtgggcagaggttgcaacatttatttggttataggacacctttgctactggagcatcttgtagggtaatgtagttcagaacatgcatggagaaatgctaccatagagtagtagtgacatttgggacttgaaaaaaatcttaagagcaggtataattccctcaacaacagaagaacatcagtgctttagaatgtttgattttgaactttcttgatgttttctctgccgttctgtagtgttattctaattaaaatctttcctctaaactctgctcttttttttccaattgagcaaattcggcatttattgaggccctactacatgtcatatgctgttctagttgctggaaacacaaatgtgaatatggtaggcctgcccttaaacaatgaattacagtgtaaaatgaa

SEQ ID NO: 12371 - DNA, 1035 bp, Homo sapiens
gagatgaggttttgccatgttggtcttgaactactgaccttaggtgatatacccgcctcagcctcccaaagtgctgggattacaggcatgagccaccacgcccggcccaaggatacacatgatgttttaaagcagaaaaacagtagaggaatgttttgtagtgaaaatctttgtctcgatatttattctgacatatgatttttgtgttagcaatcgtgtcataatcttatttgtgtccacattgcctgccatgggtcaagacatggtgtagatgtttaatatttgttaagtgaatgagtaaatgggataaaatgagtttacattttaaacaatagggcaggaaagagatattctatacttctatattcccaaggtatctgcttggtttctctccttatcccccagctttggaatatcagaataacaattttatgactttactacatttttttaaatgcctggcacagcattcctcaggcattcattaaatacttgttgactgagtgatctaccccttcctcctgcagactatttaacctaagggagactcctgaatgaatcaaaggcccctcatggattcctcatcatggaactagtcagttagatctgggatatatgcagtggatgaagaatgaatattcactgatataattttttccttctgttatgggaaaacaatctaggaagcttgattttaggatagagatttgggctttaagaatctgaattggattctaagtctaattcctacactaagtggtcctatagatttgaacatactatttgacttctcaagttcttcctttgtaaaataaccatagtaatacctactcttcagggttgttgtaaagatttccttcctccctccctccctccgtccctccctccctccctcccttcatttttgagagagagtctgctctgttacccacgctggagtgcagtggcgtgatcttggctcactgcaagctctgcctcacgggtttacgccattctcctgcctcagcatcctgagtagctgggactacaggcacc

SEQ ID NO: 12372 - DNA, 1033 bp, Homo sapiens
aacaaggcaatataagtttagtttctttgttaccatttcacattttctccctgtaattttagttatgaaaatgaaaatttgccaggctagaatcagacacctgtagtgctgcatctgctgagaaagcgcctcatctggctttgttagtgagcctgaatgctgatatacatataagatacttgccaccaaagggtagccctgttttgttgttgttgttgttgttattgctcacagtaatataaaattatgataatagcattggctctatactcaataactgcatttactcagacccttaccctcccagaccctaatgatcatactggaaaaagaaggaagggcagtgtattagtcttcccaggtttccacagtaaagcactatatgcttaaacaacaggagtttttttttttttttttttacgttcttggagggtagaaattcattatcaaggtgccaggttcctggagggctttacctttgggttgcagatgactgtcttcttgctgtgtgctcacatggccttttcttggtaggtgtagtgcagagagagcggggaggggagtgaaagctctctggtgtctcttcttataaggacactaatcctgtcagatcagggcacacccttatgacttcatttagccctcattacttccttagagacctttaatctccaaatgcaaccacacagggggttagggattcaatgtatgaatttgggggccacataaacattcagtccggccaggcacggtggctcacgcctgtaattccagcacctagggaggccgaggtgggcatatcacttgaggtcaggagttcaaaagaaaccagcctgaccaacaatggtgaaaccctgtctctactaaacatataaaaattagccaggcgtggtgttgggcacctgtaataccagctacttgggagattgaggcaggagaatcgcttgaacccgggaggcggaggttgcagtgagccgagaacatgccattgcaccccagccttggtgacagtgtgagactccatctcaaacaa

SEQ ID NO: 12373 - DNA, 2069 bp, Homo sapiens
gggtgggtgggaagaaagaagtttctgaagacagctgtcagaggaggtggcatagaggaagtgttaaaagacttgaaggaaggggaggagattagagagttgggaggggatagaaggaaaggaatttcaggcaaggagcatggtatgttccaaagcattgtgaaatgagacattctgggaaccatgactggtttcttaaaggggatggagtgtagagtatgaacatacttatgagcatagaatataaatattcatttcccctatgggatgaggaatggagctggatgggagcattagactagaaagggccagattggaaagggcttcgtatgccaggttaaagagtttgattgcatctggcaggcgataaagaattgataggcttccaacagaggagtgtcaggatcagatttttgtcttagaaagctcatcttggcagcagggaggaaacatttgaaaagggagggacttggaagggagtgaagcaggtgggaggctactgctctgtttcaggccgtgcagctactcaggagatggacttggtgaccaggtaaatgtcggaaacatgaagagtgtagatctctggttcaagtactgattagaatcagaattgtatattgagacccagtatcttgatacagagcctggtgttttttctatcacatattgccttttttattgcctcactccaccggtcaatgtaggggaaaaagtaaacataatgtggtagaataatataaaaataaggaaccaccaaagtgatggactaccagactgtgccatgatgatagcttattgtacaatagctttcttcttttatttatatacaatttatattacctattcttaaaggaaaaataattattctgtacatttatctcctaaaactaatttagaattttacatgagtttttaagctgaaagagagggaatggttgtactgtatttattttttagatttatcttccctggtaatgcaattgggtagggttttaagtttattattttctgaaaacaactaagtactctgtgaataaagttttaatatacttcttgtactatactcaaaatcagaaagctggagtttaagtcttctgtctcttagccattttccctggctatttggcctaggtatagaccgaccatcttgactgtggctttctcatctgtaaagtaaggatgattcttggcatactgacctttggggtttatacttagaggtgaaagctattaatgtaacgttactatatcacaaaggccagaaattgtgaaagacagagggtcttcaggtacatttgcctattagcaggccatctctggatggaggcattatttggataacttgtgtttcataaattggaaatttttattaaaaaatttcaatccgtagtcttccaaaatgaagttcaaacatgaggttcccctttggactcccatttgtaacaaaataactcaagtaatgcaacaaagttacaatgcatacaatgttgcagttatccaaggcagcctcatttctggctgcagctggaaaagtccagctcaaatactgagtgggctctgccactccctggtgttacttatctgcttctttcagtccaggcttctgacaacccaatatccaaaagatcattattctcaattaaaatgatgtttggaaccttttgaagggagaaaaaattcttgcagctctccactgccaacacatttttttttttttttttttttgagacggagtttcgttcttgttgcccaggctggagtgcaatggtgcggttcccggctcactgcaacctccacctcctgggttcaagaagttctcctgcctcagcctcctcagtagctgggattacgggtgtgcaccaccacacctgactaatttttttgtatttttaatacagatggggtttcaccatgttgtccaggctggtctcgaactcctgacctcaggtgatctgcctgccttggcttcccaaagtgctgggattacagatgtgagccactacacccggccaacatcatttgtttttattatactacttaaatatgtactaacatataactacatgtaa

SEQ ID NO: 12374 - DNA, 1044 bp, Homo sapiens
aacctccttaacaaaaagtccaatgtggaatttgactttttcccaaggaacaaagtaggtaaaagagaagaaagcaaagaaatctagggcctgctttgtttcaggcaccatgttagatgtttcccatgcattatttggtacagtcttataacatgcctgtaaggtaagtgttattattcgtcaccctgtcagatggggaaactgaggttcagagagctaatgaatttgccagaacttataaagccaagacttagggcatttatttctaaagagatatttaaaaagaagtcaagttacacttcctgaggtgaagtttgtagaattttattaacattgtaacatctttccctttcggacaaaattctaataaactgccatcaaatctttcattaggaattcattagagagtttgcttagttatgtatactgggaaaacacttctacagtatattttggacttttgacaaggcttttgcaaggtagatgtgttaattaactctaacaataaggattggaacctcaacatatttttaagttgaattatttgactacattttaagtaactcatttaagtgaatgggttttccaccaaagacttgccattattgcatatttttccttttttttcaaagcgtatttgccatgaaggcaagcattaacaagaattgaatgttcttccttactgtgaaaaactgggaaatgattgtattgttaacagccattgtatatttgtcctttgccgacattttatttaattaaagccaaaatctgaactctggctacctaacagacagcccagtggtcaaacaaagaggcttcagttaatactttcttctgcagcaactgattggtttcgttcatgaagaaaaagaaatttcaactgatattagtaaaagaatttgagaattgaatcttatgggttttaaaactgttatattaaatgctgcagatggcaaactattaaaggcatttaggatttgattcatttattttcaattaaattataatagtagttagtaatacaaaatacaagaatgatagtaa

SEQ ID NO: 12375 - DNA, 1044 bp, Homo sapiens
accccactgcaggagtctcctgctgaccttgaaagagcaaactgacaatgtagcagggactagcaggtggcttttaagggagtggaagatagcccccggctgacaaccaacaagaaagtatgtctttgtgcctacaactgcatggaactgaattcagtcaacaccctgaacatacttgaaagaggatcccaaactccgcgtgagaaccacaacatggatgacatcttgatttcaactttgcaagaccatgaaagagaacccaggtgctttgtgctcagacttctatcctggagaactgtgatgtaataaatggatgtttttagttgctaagtgtgtaataatttgttatgtagcattagaaaactagtacatataccctcagtatgaagaaaaagaagaatggcctaatattaaattctttttagtaggtttgtttttcatcatcatatgggcataacaaatctcaaacttttgcatgtattgtatattttaacaaatgaataaatggattgatgttggaagccaaagctctagttgtagaagggagatacaagaatggactggggaaaggcaaaggacaacactttggggctaaaaggagtagaagattttactataaactcgtagtttctaaaatatatacattagagctgagatttccaacatatgcaaaatacaaagcatctaatatatttctgcttgttgaaaaagcttagaagcaatgctatcccaacagtgatgaacatatttagcacccagatattgatttctaaataccattaccttccaaaaggagccagggctccatgaagaaatggccagttctgaggttggtacagagaaggtataagataaacctagagcatctcattgtgccataaattaagaaaatactaaaaacagttgcagggcatgtcaagaagacacaggagtcaccttaagcatcaaaataggcctgatgtggtggctcacgcctgtaatcccagcactttgggaagccgaggtgggcagatcacctgagatcaggagtttgagaccagcctg

SEQ ID NO: 12376 - DNA, 1088 bp, Homo sapiens
agaaaaggaagtggaccttaattggacaattatcaatacataagtggatttgagtgttattcacatagaagttactgtgttacagggtgctttacagtttttataatgtgcttttgaagtaaattatgcagtagttgaggctatgagatattttttctgaggaaatgagatttaagagcataacagtaaggagtaaaagggagagtagagtcattaaaatgggactaagaggaaatttaaacaatctattggaagcagaggcaagaagaaattaaaaagaagggaaagaacactgtcaaatgttaaataaaatgaaggtagaggtgagcttttatgtttggttagatatgagtccttatgaatgaacttcaagaagacagtttcaaagtgattgcattcacttttaaactccacagatctgggaagctgtggtaccattgggtaaggaggaaatggtcacagctgggcaaagtaaaacattgtaccgtttaataagtggcaaaaagatcaagaaagaactctttacaaggggaaaagtgtgttttgatggagtaaggaaaggatctagtttggagagacattcaaatggctgtggggcagcagagcaagacctcctttgcagtggtcagggaaagatgaaaagataatttattctgtaattttttttttgttgagatggattttaaagaatttaggataattgcagagatacttgtttaaatgaaaacactgatagatgcaaaagctcatatgggatggctttattcttaccaggaaagttgagggtaaggaattgaattttaggattttggagattacttgaattacttcctttgagtaaaagccagctcagtaaaggtgaataagatgatggatgggtaatcaaagggaggggtcatcttttcccattggtctctcagagttgaagtaacacagtcaaatatttcatttttatgattgacgtgattcatgttgttgtgatgtttttgggtagatgcagtgaaagcttgcacagatgagagccttgctgttgaggaaagaatagaggcctgccttccactttacacaaacatgattgctctgcacca

SEQ ID NO: 12377 - DNA, 1028 bp, Homo sapiens
tggtttaaaagattttttttctttttactgttttgtctttgtcttattagattttaagtatcaggacacttaaaatgtacaaataaatgtgacctttttattatttcataaactttagcatagtaaaaattatgttaatctggtactgacatctctaatttttttatcaaaaaattttaaattttgcctagaatgcattgaaatctgctaatgatggaatagtagctgaataccttaaaaccagtgatcgatgtttggcatggttggcctacatacatcttattgaattcaacattctcccttcaaaattttatgatccatctaatgataatccttcaagaattgttaacactgaatcatttgtaatgccatggcaagctgttcaagatgtaaagactaatcctgacatgttgttagcagtttttgaaggtaagtataaagtttataaattgtaatatcaactgttataacatcagtgtttagaacattaactacccattattgtgattctctgtaattaagtggaacaaatttatatctctatattgcaagttttagtttcacaatttattaggcaaattaagtcttgaatcagagaagatggacactggcatctttgaaaaccaataactgcacgatattacattgtttatctttctgattgtggcaaaggatatctgttaaatgcgtagagaaaataaattatgtaagtttgatgaattgattaaatcagagaactaggtacttttttttttttttagcagtccattaaggtggaagtttaaagatttctatcttttcaaccaattaatattttctccatcagtcagtgagtttggttgcttctctatattaaatgatacgactattgtggaacacattacaagatataaagcctcttcctgaaggaagtatatagcctagtcagaagataaaatctatacatttgtcataattattaaacatacaaggccatataactgtgtgttagtatatagtctaaattgtatgctacgtaaaagagacta

SEQ ID NO: 12378 - DNA, 1488 bp, Homo sapiens
tcttggtagtagaaataagccaagaataatcttttcataattataactttatagttacaataattcaagggttttttttttttacacgtttctttgaaatatttgactatcttaaagcttttaaataaggcagtgctgcagagtgctaataaacccacacatgcctggatgtgttgcttatttaactttcctgtgtgtcatttccatgttaatgggataagttacagtgttttcttttctgactcatttactgagtgaaggccaaaagaaccatacattattttatgaataggatcatgagaaagaattatcttctccaagagatagcaagcccttgaccgttgaaaagaactattatactgaaagctttgatattttgtacttgcagtagctggccttgagagagagttgtttaacttttcgcattcccaaatggtgtaaatcataaaaggtattgctgaatatggacataaagcacatttgaagttgataatcttagtggttttataacactgtacttttatctgtggtaaatgcttactgaacattcacttaaaaaaattgttgggtctgtggaaaatcagaaacttttaggcatgtgatttaaaatctgaaatctagtaccccttttcataagtgatcctgacttcttggtaaattctagtagaaaatggaattttaaaattgactcattggattagccctatttaaattttcaagcaggttctaaaaagcacttccaccttttcttttatatatacagggagtgctcagaatccttggattctgctttaaatgttctggcgcgagcattggaaaataacaaagacaatccagaaatttggtgccattacctcagattgttctcaaaaagaggaaccaaggacgaggtgcaggaaatgtgtgaaacagctgttgaatatgctccagattatcaaagcttttggactgtgagtagaaaagataacgtacgtgtgtgtgtgtgtgtgtgtgtgtgtgtataattatttggatcatcttaaaaattgataagtagcttaatagagcatatgctttatctgaatatagacataataaccttactttcagtttctagtaaccacaaagccacttctggatcagaatttagactaagcaagaagaaaatatttagtgaagaggtgatttttttgttgttgttaactttattggtaaagaaaaaatgtaaaattgttaaaaatttcacacttacctatttttacacagttttagtttgggcaaagttaagtgtagcttttgcaaaacacctgaaaaaattgtttcttttaaatttatcttaaattgcctctataaaattataatgactgccaggaaacatttttgtctttttattatttgtttccattgcttatagaaataatcccaatctgtaattcacactaatatctaaaattgccaagctaaaaacatttgattgagaaaaaatggcctcttcctctttctccaaga

SEQ ID NO: 12379 - DNA, 1050 bp, Homo sapiens
ttaatgtaatacatatcattccaggctgggtgcgctggctcacgcctgtaatcccagcactttgggaggctgaggtgggctgatcacttgaggttaggagttcgagaccagcctggccaacatggtgaaaccccgtctctactaaaaatagaaaaattagccgggtggtggtggcgtgtgcctgcagcctcagctacttgggaggctgaggcaggaaaatcacttgaacccgagaggcggaggttgcagtgagctgagatcgcgccactgcactcactgcactccagcctgggtgacagagtgagacttccatctcaaaaaaaaaaaaaaaatacgtatcatttctaagatggagtgaatgtagttcttctcaaatattatttgagtatccttcaaaatgttaaaaaaaaaactagttatatcaattaacaatcttctcctatctactttagctcctccatttacaacctacaaagataaaagaaagtggaagccaaagttttggagaaaacctatttcagataatagcttcagtagtgatgaggaacagtctacaggaccaattaagtatggtaagaagttatgtaatttaagatccagaattattaaattgtggtgttccatctttatttaacactttgctaatcctttggtgtatcagcctgcctggttaaaaaaaaattttttttaaaaacgatgccattgggtttttagacaatacagttaattcactgtgcaggattgcctctgaaattgcgggatatttgtgttcatggctcctctccagtaaatgcaaggagcactgcttagttaataattatgactgcttcagatatttccaaacatacattagttggtggggaaggtagctcccgtttgagaaccactgcctagcctgtgtcctccttaagggcaggtgttctattttacttcatctttgaatatgttttctgacatgcagaaggctcaaaagatgagaatgaacaaatgatgaatgaactaatgaacaaaataatgtatgaatgagtgcctgtatgttaggcacatttt

SEQ ID NO: 12380 - DNA, 1021 bp, Homo sapiens
cctgttcactctcttcaccttagatttagtccatattatcgaaccaaggaaaaacttcccctgagctcagtatcatacagtaatatgattgaaccggatcagtgtttctgccgttttgatttaacaggaacatgtaatgatgatgattgtcaatggtgagtagtttttgtgaacattttgtaatttgaaaaatggtcttgtttgcttaactttgatatgtacatgattatcttttctgtgtttttttttatcttaggcagcatatacaagactatacacttagccgaaaacagttattccaggacattctgtcatataatctgtctttgattggttgtgcagagacaagtactaatgaagaaattactgcttcagcaggtttttaaagacttcctattctctcccaaatgaaaattgaatttaggcaacttaaaaattctatattagttgttgacattgtaaaatacttactataattcagtgtatttacccataatactttatctagatttgctgtatccagtataattacggtaaaaatttacttcctctgttacactagccacatttcaagtacccaatggccacatgtggcaagtgcatgccagtaggacagcacagatttaagacatttccaacatttcagaaagttctttggacagagctcatttaaatatttagttccatttatttaaaagaaaatattaagctatttgtatagaaactttactattgattttaacataggagcctatttttacttattgttttcaaaaaatagaggaaggctggaaattacgatggctgttgtttccaattctataatgaaataagacttgatacacttgtgagcaaatattattaagctttttctcagatttggtgccaagtaataaacctcaagctacaaatcttttggaagtaaagaaaataataattactaaatttggtgttatcacagcccagagtgattgtaatgtcactgaatctattttatcgctcccaatttgggactttaact

SEQ ID NO: 12381 - DNA, 1056 bp, Homo sapiens
atctaatttgcactccacctagatgtatttcttcaaacataacataaacttaatatattcctgatgaagtatttctgttattaaactcttaacaaaaaatttttttacagctccttcaccagtgcaaccgccatttttctctgaatgttcattggggtatttttctccagcaccatctctttctttgcctccaccacctcaggtttctgtaagtcagaattgatttctaagaaaattattttgtcttgtcttttctaatttgtttttaaaaacgaatggttaggtttgaagagggcttaaaaaatcagaattgcttaccaagaattaatagcaatgaaatacgtagaataaacagttgattataccagcaagctatccatttggtagatttttttcatagctaatttttaatttcatgttgacttttcggtacctatcatgtttccttcttcactttactctcagatagtagctactcagaaaatttattcaaaaacagaagttatctactgttttggactgtctcttttttagggaattggaatttacatgcattaggatgcttctaaaaattaatactctcctttctcctcttttcataaaaatggttatttttaacttgaaaatccagcaaaagaaaagcattttctatgaagttaatttcttttcccccccatctccagtcctcccactaaaaataaaacaaaaaaataaaaacaataaaaggaaaaggaaaaaaaggaagtagaggaatcacacattaaaagttttgacattatttttagattgagaggacctagagatcaaattgagtatctctcagtaggtgtaagagggaacttttccgtttcaggaaagacgtctagtgtctttctagaacatatatggtgaggggaatattagagccgatagtgagagagaaaacagcactttcttcgttgtaatgttttctttttgggaatgaataaatgaactaaatgccaagggaaatagtggaagatctttgatgcaaatacatatccaaatttagggatttgtgtaaaattagtttccttt

SEQ ID NO: 12382 - DNA, 1031 bp, Homo sapiens
cttttcttttcttttctttttttttttttttttttgagacaagagtcttgctctgttacccaggatggagtacagtggtacaatctcagctcactgcaacctccacctcccgggtccaagcgattctcctgcctcagccttccgagtagctgggactacaggcgtgcaccaccatgcctggctaattttttgtattttcagtagagacagagttttgccatgttgcccaggctggtcttgaactcctgacctcaggtgatccacccgcctcggcctcccaaagcactgggattgcaggcataagccactgtgcctggctgctcgaattattttctaatgtatcagtcatgttgcaacaaattcacatttatagactaagcctttcaacagaactcatttgtcttgaaatttggtcattgccttctatttacattgatttagatgctagattagtcatttatttattgaataagtcacgtattctttggttcacttgagcagtcaaattaggatgtttggaacattgacaggtgtggtgttatggtaaaaacaccagacttaaaattaagatctagtttaaatcctagctttgcaatttcagttttgtcatcttaaggaaagatttctgagtttttaacataatctgttttagctacaaaagtatctcaacaggattgtagatattctgtaactttatcatgtgatgtttaaagctgttgtagattaggtaatatataaatgtaagattttgtacattatttcatcagtcatctgggcccaaggctagatatctggaaaaaatgtatggatggacttaattttattgatacttaagctgcctctactgatgcttttctaggtaaatgaccaattctctaatgcacaaatccaatacagtctgtaaacattgcattcattccaatttagaggactggattaatttagtcatcattatattctatcagtgtggataatccacttggtaattaagtgttgctgcttgtttctatgctttataaattctcttctca

SEQ ID NO: 12383 - DNA, 1089 bp, Homo sapiens
tgtcaaagtgacatttaaaaacaagcaattaatcaacacttagtgtcatgatgaggatgattaagacaagtatatattttggttaaagtataaatatatgaggaagataggcaatgccatttttttcaaatgtacacatacacacacatacacaataagaaatgtatttaataatacattttaccttattttcaaggcttatcatgacagtaactattctttaaataataagaaggaggaaggtaatattatgaattactaccaccaacagaaaataatgctgttgattacccattaaaatggtacagtagtatcattgtctgttggacatatagatcagtttttttcttctaaatgctatttcaactctctattattaacatatatatgtatgtgtatatatatgtatgtgtgtatatttttattagaaaaaataatctattattcaactagataaaataagaggtaagagataacatagtagaactcaattatctactaaataaatattactcccattctctgtggaacaccaacaatattctcttcagggaagtgacactgactattgtagaaagaacaagttaatgtgaaaaataatgtttcaagtccttattattttattttcttaaagagtaatcatagagggggaagcataatacttcattaccatgtctgtagaggaatggaagagcatattatgcaaataagaaatacaaggcattccttgaaccatagtcatccttgagagaagtggaatgtgtctcaagttctgttttatgaagatatcaacatttttgaaaaatatggagatgaaaaatagcaacataaaaataaatctcagaccttgactactgattgaattttttcacctgctatccattattatttaatctgtacatagagaaaaaaatcagctgagctgtccagaaacatctggatgttatgataccccacaaatataatagccacaggtaatgagcctaaagataggaaaagcattacctggttgctgtttcagccttcagccaatgaatataaataagctttcgttgatcttttgtcctactaaaatgtaatccagtttat

SEQ ID NO: 12384 - DNA, 1074 bp, Homo sapiens
ttctctaattccaaaatgagctactctttacctaacggatacaaagatgcctgctaatatatattagtgatgaaaaactttcaagcacaaatttctatggactgaatgtttgtttctggggaacctggcatggacagcattatgtcaggttgtggaagtgaaggtgccaccccagggggtctggaaagcagagccattaaagcaaagaggattattcttgaggcttaggatatcatggactttgccttgctaagttttgagtttgtttgggaactctcacctcttctttccttcctatttgtctcttttggaatggaaatgtctatcctatgcctctcccaccattgtacttctgaagcacattactttgtttcacagcttcacagctggagagcaattttactgcaggatgaattttaccacaagtctcatttgtccctgatttagataatatttagctgagactttggacttttaattttagagttgatgctgaaataactgaagactttggggaatgttgggatagaatcaatgcatttggcatgtgagaagaatatgaattcggggaggctaggggtggagcgtatggactaaatgtattcttctaaaattcgtatgttgaaactctaattaccaatgttatagtatttggagatggggtctgtgggaggtaattaggtcacaagagccctcatgatggaagtagcacccttataaaaacagacaggagagagttttcttccgctttctctgctctctgccatgtgaggatacaagaaagtggacatccagcaaccatggaaatagtcctgccttcactggacactggatataccagtaccttgatctttgattttacagactccagaactatgagaaataaatttctcttatttaaataacccagtgtatggtaattcgttatagaagtccaaactgattaaaatagaagtcctttttttcctatcttaataaataaaaagatgcattttctataaatcgcggagttttccaggactaatatcgagtagatgcgatgaaaaactatttttgaactgaataaagaatata

SEQ ID NO: 12385 - DNA, 1115 bp, Homo sapiens
ataaaattacttgctaatggatgcagagttgctgaaatggtgaatgtttgtccctattaataaaaactggaagtagaacgaaaaataacgagcttcaatacctcctgtggaaatttatccacgattggacaggtctaaatgctatttctttttttttttttttactataagttttagggtacatgtgcacaacgtgcaggttagttacatatgtatacatgtgccatgttggtgtgctgcacccagtaactcgtcgtttaacattaggtatatctccaaatgctatgctatttcttatagtgaacaaaactatcttttctgtaatatttacttttctgctacagatttactttcacagtgtcttctcccccttttctgtgactaatcttcatatattgaagaaaaagttgtcatgtattctctaagaatttttaaaggactgtaaccacactagaatcgtgattttttttttctccatagcatatgattccaggaaaacttccaacaactcacgtgtacatatgtcactcttaaaatatgatgttttcatggtagcaagtggtctgactagcaggaaacagtgagacttgtctttcatgccttgtgaacttgaatttccttaaaatagactgtgccaatgatagactcccttgataaatctgttagtagtttacatatattccttgtgtttcaagtagattttcagtaagttaaaagcagaaataactcattcatgttacaatgaattcttacataaactatttcctcttatttcctggtcagttgagtattcaatggaggcttgaaactcacactataatgtggaattctacgcgatttaacatcttatgttgtcactaataatactgcatagttgaacgtcttaggcttaatttcctaaattagtggatctctctttaacaaaggaaagattctttcatgagtagtgaagtccctgaaaaaaaaagtttgaaaagttctttttgaagtcttagcagtaaagtcaaagacatgacagggtactgtgcatttagacgtatattttcactagcttttgctgggataagcactctctggaagaaactctcagaatgccaaaggttgaaactgcttcc

SEQ ID NO: 12386 - DNA, 1027 bp, Homo sapiens
gagatgtaggcccagaactttaaaatgctttatatgaggcatataagtttctaaagaattttttaatacaatgtactacaaatactcaaaaataacaaaacaaacaaagaaaagactgacatagcaaaacctggagagaattcaaaaatagaccaacaattgacttcagttttagcattttcagctacaaattaaatgcacacaaacatacacacgtgtgcacacaaacacatacaaattttaccatgctcatacagagttctaaaaagcataaaattttagcacaaaataaaaatctataaaatctgacatagtatatttgaataagagtgaagtagaaattcttgggaaaatgtacctgtacgttaacccatagtaacataaaaaaagatactactaaaaactgatagtaacaggaaaaaaaattcactactaaatagttttgaaagcagattctgtatgtatgagcggtttagacacacctagagaaagaacccaccaactggaaaatagatctaagaaggactcaaaatacaatattgagaaacaagaagactcaaattagagaaaagaggataataaaaccacaaatacagtaagcgattcaaaaatctacatcactgaagtctcagaagaagcagatagaaggaataattcaaaacaatgcttgaatataaaatgagaatgttccagaatcaatagtgtcaacagtccagagtcaagaagctcaccaaatccttagcacaacaaggtaaaatacatttttaaaacaatttagtagtattttctccaactgaacaatggcataccctagtgattttatttctaggtctatgccacaaaaacaaaaatatatgtgcatcaaaaatatgtataagaatgttcatggcagccctaaaccgggactgactcatatgtcaattacagtacaagacatgcattgtctgtatttttcaataaacggaaagtagaaagtcacacagcaatgaaaaggaacatgttagagctacatgcaatagcatgaata

SEQ ID NO: 12387 - DNA, 1043 bp, Homo sapiens
aaataacttatttaaaccaattgactgtaataaccacaaaaaagttgtttacaattcacatagtcagtgtccaaatatttaaataaatgccattctaacttttcattttgtctacactgactagctattccaaaattactaaaatttattattccatattgttcacacagaaaaacgaacatattttgtctctttctctttgtctctctccctttctcacacacacacacacacacacacacacagagatttgaattactgctacttttgcacttgggacatttattgaaacaaagactaccattttgccataattagacttcgtgaagagcagtattagattttggcaattttagcaggcatgctttttttttttttcttttgaaatggttcattgaagataattgaaaacagcaaaggaatgtccttggtgagtgttagctggatcacgtgatgatgctggatgggaactaagctataactaggactacatgaaacctgcaaaagaccaacgattaaaaaaatgaaaacattattgtagaagttcagatgaaactaaaatggctagaaattaacattatctgcttatgtctttcagtaatattcctcattcactttggtaataacaaacttaaaaataagcccaattaagggcttatcagagatgttgcccctcttttttcttttattatagttatttctgttttgtttattttgattattagattttgaataataaaagttaagaatataaaatagactagagaattgaagattaaggtattttcactcaggcctaaacatacacacacacacacacacacacacacacacacacacacacacacgcaaagagagagagagagagaatacaatagacaccaactagaatcaactattttaacactgtcacatgtggttcttgtgatttcttgtttgattttgttttaaaaatataaaatattgcatatggctaactctctgtttgaataatgtcttattttcatgtaatcttgagtcccatttagctttctgcttcccta

SEQ ID NO: 12388 - DNA, 1075 bp, Homo sapiens
gcaggaagaaaaagtgctgagcgaagagggtagagctccttataaaaccatcagatctcttgagaactcactcagtatcatgaaaacagcatggagaaaacagcctccatgattctactacctgtaattgatctctcccttgacacgtggggattatggggattacaactcaagatgagatttgggtggggacacaaagcatgactatatcattgtatgttctcacttttaagtgggagctaagctatgagaacacaaacgtataagaatgatacagtggactttggggacttagcatggaagggtgaggtggtgagggataaaagactacacattcggtacagtgtacactgctcaggtcatgggtgcaccaaaatctcagaaattactgctaaataacttattaatataaccaaacaccacctgtttcccaaaaactattgaaataaaaacataaaaataggccaggagcagtggctcatgcctgtaatcccagcactttgagaggtcgaggcaggcagatcagctgaggtcaggagtttgagaccagcctggccaacatggtgaaacttcgtctctattaaaaattcaaaaattagctggacgtgagggcgcatgtctgtaatcccagctcctcaggaggctgaggtaggagaatcacttgaacccaggaggtgaaggttgcagtgagctgagtttacaccactgcactccagcttgggagactccatcccataaataaataaataaataaatgtctacattgtttggtataaagtaattttttaaattaacgtaactattataacattaaaaaatagaaaataagactaaaatataaatacaacagtttgtatcatgaatggaggttggattttatcaaatacatcaattgagatgatcatatttttcttctttgtcctttttatgtggtggattatatttattggttttcaaatgttgaggcagtctcgcgtggttggaatgaatcccacttgatcatgaagtagtgtataattctttgtgtgcagtgttggagtccatgtgctaatattttgttgagggtttttgcatg

SEQ ID NO: 12389 - DNA, 1242 bp, Homo sapiens
cacaggagtgtgtgcagacaggcacacatttcagacttaatctaaacagatccatgcagtccctgaaatacttttttgtcccaaatttgatcccaggctttaggctgaggccctagagaggaaaaccagatctaagggatccaaagccactaacgggcacaatgtaaatgtacaggaccaatttctgctgactaaacccttgcttcatggaaggaggccatgccccatgacatggatgaggctcaggaaactcaaagattgtcaacagcaggggaaatagggcatatgtgggtaggagcagatactcccagcccctggggccccttgttaacatgggtgaaagccactttggcacccatgggtggcacctgccaaggtctccaggacttggggacaaaaagatggaagagagagaggggatgcccactttctctccatcacaccctgagttatcatggaaagaaagaagggaaatgaaggacacctttactaccctgtctttcagaatggacaactggctatctttaccatccccagtttataatcctctggagtgtatcctgaaccactgagactgctttgaccctctgactctggaggaaaaatacctcatagccctctgcacaaaggtttggccaaattataacagactagcttggcctcaggaaggaatcatttattttgataccatccagaagttggaccttttctgtaggcatgaagacagatggtctgaggccctatatgtgcaagctttctataccttgcagagcaatccagacctttgtcaacagtgtaggatcaattcagccctcctgtttgccatctcaggagaggctgcaagcagcaatccctggaagctaaagaaatgaattgggccgggcatggtggctcacttctgtaatcccagcactttgggaggcagaggtgggtggatcacctgaggtcaagagttcgagaccagcctggccaatatggtgaaatcctgtctgtactaaaaatacaaaaactagccgggcttgggggtgggcacctgtaatcccagctacttgggaggctgaggcaggagaattgcttgaacccaggagacggaggttgcagtgagccaacattgtgccactgcactccagcctcggcgacacagtgagactctgtctcaaaaaaaaaaaaaaaaaaaaagaaaagaaataaatcccagaggcaccgccagcagagaagccagctccctccagccccactcct

SEQ ID NO: 12390 - DNA, 1081 bp, Homo sapiens
atctgtaagccaaggagagaggcctcagaaaaaaatccaccctgctaagagcttgatcttggacttacagcctccaggactgtgagtaaataaatttctgttttataagccattcagactgtagtgttctgttatgttaaccctagcaaactaataaatacatacctatcatatatatgtaatatatattatatatacatttttaaaattattacatttattattactgataatatacatatacgtgggaaacataacggaaaatatggcattattacatacatgtaagttatggcttaattgattcactatcttccaattggttataattttgtttgggaaattttttccactgactaataagttatcacctcataatccttttataagtgaaggtggtaaataataaacattttaaataaaagaaagagagttctgccacacattttttcagctgtatattttaatcagttctacagaaatcagttaggtgaaagacttataaatctctcttggaatataaagtaaaaattttaaagtgaaatactagagatatcaatatctaaagacattgttaaatcagttattaatacataagggaataatatgtagtattagtacaaaacaaaaatgatcaaatatttgtgagatttatttaactgtgagaaggttttaaaaacttatttcctttattggggaggttacacattttccttaaatatgacgcatacttcttcattttcttgctaagtagcatcagctaaagttaagatgatgcagtcaatttaattgtttgtttgagacagggtctcaatctactacccaggctggcacagggtgatgcaatcttggttcagtgcagcatcagcttcctaagttcaagtgatcctctcacttcagcctcccgagtagctgggactacaggctcatgatgccaccatgactagctaagtttgtttgttttttgtttttttttgttttttttttttgtagagacagatctgactctacttaagctggtcttgaatcccagagtgctgggattacaggcatgagccaacacacccagcctttttttttt

SEQ ID NO: 12391 - DNA, 1021 bp, Homo sapiens
aggtgaaattagggctctatctccccaggaaactgggagacaaacatccctagattttttttttaaagaggcgtacttagtctttaaaaacattcatacatatttcaaaggactcacaagtattttaaagtaaatgtcaaagaatagatgtttgtggggcaggggtctcttaccctttttgcgccagagaaaattaatttttcttttttaaatttgtatttacccttacagcatacagttcacctgtgtgtggtggtatccttttgaagggttacatcaaaagtgtgtggtatccgtttgaggggttattttcaactggttcaaaggtcattccaatgcatacacacacacatacacgcacacctattgatatttatttataattatcaatcacacacacatttaacaaatcttacatctgtttataaagatttctacaagctttgttatgtttcttaccttcatatattctaaggaattattacaaaaatatttggagcaaagtttttattaaactctgaagaaaaaaatatctgttgaaatatatttctaaaattgaaatataaaccagagaggggccaaaataactttaaaagaaaaccagactctgctcctatacacaagttactttaaaatgttttctgggccaggcgcagtggctcacacctgtaatcccagcactttgggaggttgaggagggtggatcatgagattaggagttcgagaccagcctggccagtatggtgaaatcccatctctactaaaaatacaaaaattagctgggagtggcagcacatgcctataatcccagctattttggaggctgaggaaggagaatcacttgaacccaagaggcagacgttgcagtgagctgagatcgtgccattgcactccagcctgggcaacagagctagactctgtctcaaaaaaaaaaaatatttctattgttgttgttgcttgtttatcaaatgcttctctaagcaagtagcctttgaagtcttgctactcaaaagtgtggtcc

SEQ ID NO: 12392 - DNA, 1046 bp, Homo sapiens
aggcaatgaatacacgattttaatttgtgtaatgtcctttgtggttagaggtgagaaatagccagattaaaagtcagatgcttttatcttcttagtaatcaggtaacctcacaaagtcaagtgcttcagtggtccaatgaggaagtggaacaactggtacctgcaatcacatgcaattaaagcaggctaaacattctggtattttgcgacttattttaagatgtgttcatggtgtagtttcaagtctaactaggtgtcagtctgtgatttaattcattcattcaacaaatatttttgagctttcattatgtgccagaccgtcttcttggcatttgggatacatcagctagaaacatcaaatagacaatctgggaatatccagtagacgataaacatacgtactataaaaataaatttctagaaagctagaatgtagtaatggctgcagaagagaacctggagcatgatgagggggttgaggagtagaggtgagtggagaggttgtagtttaaacaggatagtcggagtagcttccttgagaaagtgacgtttgaatagatctgaaagtaccataattaacccctgaaatgtggtgctgaggcaaatggctttctagattgaagccatcattcaatgttcaaaggcctaaggcaagctaccctggtctgtctttagaggatgaatggccagtatgcaggactggtgcctgagtgagacaggggagcagaaatcagaaacaaagagacataagggtgggaacagaaaccttagagagcagagtattgaactcaagtgagatggaaggatctccagccttgtgggttgtaagagcagaagatacgcaattcagaaaaggtccaagaagccttatttttgaccctgttcagggtacatttcctttcccaaggaacaagtacatctagaatataagattacatgcagaggccatgtgtctgataaattgtttctgttctactcagtttgttacgcagaagttaaagtattggagagaggtgaaaaataaaatagtgacaaaaagaattaat

SEQ ID NO: 12393 - DNA, 1035 bp, Homo sapiens
tattttacttgcaatggatttcaatgagaaaaatgtcactttaaaagtattttaaagatacactaataatattgcaaataatattcataagatatttattaataaataattactaacaaattactaatagcaaacttatatgcttttaatatttttgaagccaaaaaaaagttatctttcaacttgacttgaaggtattgcctaataaaaatggcagaatttgttctcattagcctccctcagattcattttattatgctttattactctaatgatactatttaataaagttatatttaatttatttgaaagtactgattacaaattatttctttttagcatctcacatttcgagatttctatagtctgtgagaaacaatacaactttaaaaaattatagtcgtacataatttgtattgtcagaggcactccctttccaccccaaagtttgcctttttgggcttccaaagcaagagattttatttggacttcaggtaaaggtccacgctgagactggaactctggttgctggattcagagtccagggtgcttaccattacaccatggaaccaccggagaggtggctgctctgactcactggaggtgtgcaagtccttcctcagacttttaattagagttgcatccattgtcatatctattttatgtcttctagaattctcttatccctttactaaagtcattagaatatagtcatttgcatattttgaccctttgggtttttttaagcttctatccacttaaattttcttttgagtacatctttctcacatcacccaaatctgtttccaaaatgcagttgagcaagcctaaaggcaaacttgccttattccactgatcgcgtttggtttcaagttaaagccagttactgtggacaatgctttgcaactccttaaattggaaattaaatggtccatagattattttacagagctaacctgagacttcaaaatcccttattagacactaaggatttcttcaacatgttccagttttgttctatctccaagtaaatga

SEQ ID NO: 12394 - DNA, 1033 bp, Homo sapiens
tcacaatgacatgtgaggtttcctttgtcagttgtcacatttcatttttgtgacacttctatttattagtcttacactttcttcattattagtggttataatatggtttaatattcacaatgttaaccatgattaggttgaaaatccttaatctgaaatgttccaaaatatgaaaatttgagcactgacattattccataagtggaaaatttcagggctgagctcatatcacagtcaaaacacagatgcatgacacagtttattcagaatccctcagagaaaaataaaattaccttcaggctatgtgcataaggagtatatgaaacataaatgaaactcatgtttaggcttgaatcctatccccaaaatatttcattgtgtatataaaaaaatctccaaataaaaaaaaaacaaatttgaaacacttttggtctcaaacatttcaaataaggaatacgcaacctgtaatgctattttagcagcttttaaatagtgtaatatttttcttccttttcagaaatactgtatgaattttgattcacatttatagaatattaattcttcaagagttatttctttaaataatttaacattctcttttagacatttggcatttcttcacattttttaataccttttaaaaacttttgtggttttcttctcatgtattatagatgtatctcttttttagaaatttattggccttttatattatgttactattgtgaatgaggtttattttttattttttattttattttatttttttttgagacagagtctcactccattgcccaggctagagtgcaatgttgcagtcttggctcactgcaacctccgcctcctgggttcaagcgattctcctgcctcagcctcccaagtagctgggactacaggtgcgtgccaccacacttggctaatttttgtattttttttttttttatttgagacggagtctcgctctgttgcccaggctggagtgcagtggcaggatctcagctcactgcaagcttcgtctcctgggttcatgcca

SEQ ID NO: 12395 - DNA, 1028 bp, Homo sapiens
ccacaatatttccccaatttctcctgagcattttattaagtcgtgcttttctgagattttactgctttaaaatttattgttacaaagttgttcataatatccttttatctttttagtgtctacaggatatagagtgtgccaactttttctctgttctagtatgctaatttttttctattttatttttcatatgaatcttatacaagtttatcatttttgttgtctttttcaaagaactaattttgggcttgctgtccattttattaaatttctgccattctcattttatcttctttctacttttcttgggattaatctttttatctgtttttatttatgaaagatggatccatcaatcatcagttcttttttttaataagtacatatggaagttttcagcctacaagatatatattataatgcatccagaaggatacagggagacatcttatattaaacacactaatatttctgcatgtaaacataagtattacattagtataaattaagactttagataacctcacttcagttcaggcaagatttcctcaccaaatgagttatgaaaatctttagtttcaaagcattttggtgttggaattgtagcttaattgttctgaacttgtattaaaaattattttttaagactaaatataattagttgaacatttatataatgatgttaaaagtcgtataattgctcctcaaaaatgtgaaaaaactaataattccaaaagttgatttctttggcaaaatcaataaaatgactaaaaatattgttaggtttataaagaaaaagaatagatggcaccagtgactattgactgctcttggccaagaatagccagggcctttctgaagaggatgaacataggcaggaaatattttctaacagatactgagatttggtaaaaactttagcaaataaagaatcaaataacttgaaataaaaaaagtaagaaaagatagagagcccagaaataaactataatttttatatagttgtaggtagcttttctatagtttct

SEQ ID NO: 12396 - DNA, 1043 bp, Homo sapiens
tttattacattcctctgccctctgatgcagaagaaaaaactatctctagtttccaagaatcttttaataacaaacatttttttaaaaagattgtcagttcttttggctcaggggaaccagatcatgcagaaatgtaagatattcaaggaggattgtctctcaccacatgtatgcacaccacctacatgtttgaatgtaatattttatataatgtatgcatatttacattcacatattctatatgcatatccgtgtttttacataattaagatcatactgttaatcctattcatactgtagtttactctatgtcacctaataagagataatgtacttttaccatacatttatgtattctttgaaaatacaattttaattattgtttatcatatcatggtgtgacagaatcatataatacactaataattctctattattaaatatgtagtttgcaaatatttaataatgtataatgccataacaatagatgcttcatggaatatgtcttcacattctgttgatcttggaagtttgaataagaagggaaatcagacatcactttttatgattattttccctgactgaatactgttatgacattttcctaatctgctcacataatgaatatatttttcataagtatacaatgagtcagagataaataatattaggcatcaaaatctatgaaaaattctttaaatttctatttcactaaactttatttccttacatgaatcccttgaactgatgacttttattgtctcactcttccaataagatttagtgagttataaatcagtaaaagataagtagcatatattagatattatgtcattgaagaagaactaatgatacgttatccttgccactcatgggtagtggaaatgtgtaagcctaagtcatagtttagagtggttattgtacacattggtgttgctcagacatctagagactcataagaactcagcagcaatcaacctgtcagccagccaaacacatcctaagtagggtagccagataaaatgcaggccatctcatgaaac

SEQ ID NO: 12397 - DNA, 1050 bp, Homo sapiens
ctttaattcataagtaccatcttttttttttttagtcaaatataagaatgaagttaaattacatgtctcaaaaacatggatcattttgccccacctgacgtgggcaagttctatgattgctacccaattgggtagtagcaaatgagttcactaggtgaggcaacatagtacactttaagtaaatctcccaaacacattttaaagcccaagaaatttatatgtaaatattatttgttatgcaatggttggagagtaccagaaagactttttaaagattgttttgttttttctatttttcctaatgctaaattcttactcagctctctgtctttcctaagcaccctgatgcagtgcccatccactcctccaaaaacttccctcagaaataactacctaaaaattacctcttattcctttgtaccaccacacatcctcaactttttctttttctttaattttgtatttcaaaatgcctcctcctttccaattctctcccaacatgtttttctatatttcttcctcaagaatctgtagatgatggcaataattgccaaatgaataatatatggagaaaaatgtgattagctcaaatgccagtctcatttttattgcaaaccagcaacttaaattatattgaaataggccattcttttacttctggatttggagaaagtgcatctttatttgggactctgatcagaaaaggagtcttagatagcctattatctaattttgagagtacatgaaaaataaattaggcattttctcagtatagtgaaatcatatttcaaatgatgcacctgcaagactagagttgatcgttgagcttacatataagcattcttctgtagaatttttagtaatcttaatggcaatccacaatgatgaattgaagctcgtgatgaactgaaaacaggatgagctcattaatcattttaatacagtacctgtcacaggtaactttagaattatctatttccttctcatatctgaaaatgcttagttgttagatgactattgataaaatgtcatagtgaaaaaatatctcaa

SEQ ID NO: 12398 - DNA, 1042 bp, Homo sapiens
aggtggtttcactgacagttaaaaagttcttactagggttaagagttaaaattctgattaatatatggtaattaaaatgagataagagggaaaatgactctctctatatatattatataagaaaagtaaaacatgtttttggtaaggttatatgaaacatatcaatattctttttatgcttttaatcttacaactctaccaaaagagacataagagtcattttttcttttaaaatacaaattttatttttattttatttatcctctgatatggttgatcacttgcttctcacttttagggggacatttttattgatacataatagatgcacatattttggggggctctttttaaactattttcttcattgaattcttccaatgcataattcttcccctgcatcactttccactttttctaaaaattttgtgctgatgtctcccatttttctgacctttaaacatagattgttccgggtctatatctgagatatttaatctaggctcacagttacaaatattgtttccattctgataatttccaaatttatgtctccagcacagacttatctcctgaactccagagatgtatattcaactttatactcaatatttcctaatgcatatatctaatactacctcaaaattaacatgcctaaaaatctccttttctactgctctgtttccccaaattggtttctcttacagactttgtctctcagttagtggcaaatttattcttcctgttaccaggcccaggaacttagtcattcttgacttcacaaacttcatcgtattctacatccaatctaccagcaaatatctgtaaagtctacatttacaatatatatagattctgaccacctccactcttttattgctaacactctggtctaaattcactgctatttctgacagagattattacaaacctttaactggcatttctcctttcacacttgctcttgcatgagtttattctgtacaatgtaggagtatctaaagattaaaggctgacattaatgttactgcctccaaacttg

SEQ ID NO: 12399 - DNA, 1046 bp, Homo sapiens
aggttcccttgttgagctgagttaaagatttacccttcaacttattggattttatgggtgagtttatatttcccaccttctaattattttttgttagagtgagaattagttttcttttaaatgttaccattcctgctaggaatcctggctatgagagaaaaataatgctgtttggtgaaaccttactattcaatcactgctaccccttctcatctgagggagcatggcttcctagaaattagaaaccttccctgccacttaccagccaccaagcaagctgtacctgctactcactactgtgcactgtgcttgaaagacaaaatgtcttatgatgatcccttatttgcttgcttaatttgattaatagtgtaccatttttggctgatacactattgatatttctgtattattctttggggatttttcctctctttttcacttcctctctctaatctcccagagattctgctctcactttagtagaataagtcttttcattaggaaactacaactttactggaaaaggcctgacttcccagtaggctttaataacaacaaaccccccaagaaataaactttctggatactactgtatttcgccacacaaaaacattttttactgcaactatagagctgggataaaagggacattacaatacagcaaaaactgtcagctatcaatcagcagctctctgcagaaattggaagaaatgttctttgtacttttaacctattgtgctccactaaatgtatgttgtaggagcaactataacgtgctttgaaagagggaagaaaagcccaaatgggtgaaacatagttaattaccaagaagaaatatccaaactgataaaagagaaattgaagaaaaagttagagatagtacctaaaaaattaactacaaaataaccagctaacatcataatgacaggatcaaattcacacataacaatattaactttaaaactttcctatattatatttttatgatcaatatatctgttaatttatctcctactgagagaatcttttcctaaggaacctctatt

SEQ ID NO: 12400 - DNA, 1029 bp, Homo sapiens
cactactcctattaaaataataatagctaatcactactgggcacttattatgggccaagaatcagccaaataaattttgtgtattgtttctttgatctttaatgtagccttctgaaataggtacattacctattatgttctgaagattaccattatgttcttatcgaggaagaacctgagcatcatagaatttagctaatgtgtcaaattaattaaacattacatgataaaatggtgagtcaacctttctggtcataacctcaatactatattgcttgttttagctgtatgagaggacatatacatagatgccattataattaattgtttttgaatgattaaaataatgtctgtatactcgttgaaataacatgaacatcattaggtaatttttttacattattgattataagtgagattttagtttacttgtagtttactgtagtttacttgtagtttacttgtagtgagattataagtagattgttgtttacttgtacaggaagaggtctctgtagtgatttcgagtgacatatttgtgaagtgaaaatttgcaaattgctgaagagggtatcaatatgctacacacacaagcaaaaagaagataaatacgtgcacacacacaaacacatacaatttctgcttttgtttgaaaatggaaacactggctgtagaaacaagaaattactacctataaggggctaggtggaatggagaacaaaatataaggatgaaatagagcataactttgtatgtaattttgactaccatattacaatgggtttagttttgtgcaaccaccaccctcaaaataagatatgttaaagtcctaactggcagtacctcatgatatgaccttttttgaaaatgtggtctttgcaactaaaattagttatgttgacaataggtcatacccaaatagagtgggcccttaatgcaatatgacttgtgtccttataagaaaatgatgtggagctgcatggagagaatagcaggtgagagaagagattggggtaatgtagctgcaag

SEQ ID NO: 12401 - DNA, 1685 bp, Homo sapiens
tggttaattgatttaattttagaagtgccctattctcatccttcacccatgtttatcatatttttgatttcataatttatttgtgaaaaccctttataatttaaatttttttctttgatatatgtatctatgctgcaattgtttttctactttcgatttgtattttagttttattcattgtatttattgtgccaatccaagacatttgattttagatagtcaaatatatcagtgttccacgatattgtttctggtttcacttttaagtttttactgtccattgatacaaacttgtttaccaatgctttcttctgatattttaatagtattaatctcatttttatgaatgtgaaataatttttaactgagcagtgaaatggtaacctagcttctatttttaaaataactagcccattgccttaattgcagttatttaataattaatcatatctatacaaattttatatatacatttattgtatataagatatctgtgaatacttatgatttctgagctctctattctgttcacttactatgcatcatgagtggtccaagtaattctcactattagcaaaagaagtggtcccctgtgtatgaggaacaattaaagcatgttatacagtgtatatttaattacacaattaaagtctattctattgctagagggtgatagtagttcaaagcaagcaaagacactcataccatcttctcattttagtcctggtagtggaattccttaatattaggggtctttgcttaggagtttagtagtggagacctggttgaactagatctccaacatggggcttcatggggaaagtcagagagttaaatgatgtattttatgcatctcacttacattcttgaaacaagtttattacttgaatttcccactccaatttgaaaaagcagggctctgtttttccaagttgcatattccccaagactgctataatataactgggaatggtccttatttctccacattttaaaagcatttcttattacatcaaaatatcacaaagcttaagatttgtgtgttttgggtatatcaattttagtaatttcttctactggtacatacacataattgacatttgttttcttcatattagaacaaaataatctcaaagagaacttttttagacctttctcatatactcttttgcatatttctacttagacctacacaatttaattatagaagtgttactgatgtttttgaggactcatattgtaactcatttattttcccagaattcaaaaatatattcttccaagaaaaacaaagccctgtctatactcgatgcaggttggtttgatttcattgttcaattttggggaaagttacatctttataagattatgtttttctcttcagaaaaaagccacatctctccattaaaaatcaatgtttatatcccttagcaaagttgtacagctttcactctgtataagcctatgcaagtcttgttaaattcataaatatgagtcttatttttgagttattcttcttaatggacattttcttgtatacatctattgattatatgatgcttttaaagtaaatatattatccaaaaataatggttatttctccttttctattccatattggtatcttctattttttcctttgattactttgtttagcaactcaggtgggctattggtggcaatag

SEQ ID NO: 12402 - DNA, 1058 bp, Homo sapiens
aagtaggatttaaggaaatagtcttaatatagttgaatccagtaattggttcaattatgccatttatgccatttttatgtatacttgtactaatatataaagtattttatgatttgttttatcttaatctgaagaaatttctaactgctttaggcaagtgtttttatattttatactgtgatcacctttcaattattcaattataagaatactctgaagttaactgccttaaacatatattctttgttaaacatatattctttgttttacttggtaaaatctaaagtattacatgtgttgtgcttttaatttgtctagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggctttttttttttttggtggtggtggttgttcatagaagagtgttctttataaattatattattattgtattttttgaaaaatttatacgagaaagtggtatataagtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggtt

SEQ ID NO: 12403 - DNA, 1811 bp, Homo sapiens
taattttatgagtaataaattactttgaaaaatttacatacctttaatattttaggagcttcacaactgtctgaaattcacctgtgaagtcccaatttcagtatgcctgctccaggccatgatagttgtcatgtatctgtcccagtctgagctgagtcatgtttctaattgattacctttcatcttaaatggaagatgtggatgtgtccaacttttccttgtttattgctgatgctatgcccctagataactgcattttttttttcaaactggggattgaaacccattagtgtattgagaagtcaatttaatggctataatgagcctttagaaaatgacatatcacatggtaaaagtatctttttttgatattggctttgtttgtgtgtgtgtgtatatgtattaggttgtgatataaaatgtgtttctaactgtgggactgctctggagttggttgtgccattgtgggtgaaggtggctcagcaagctgcaggttgtgttttgtagctgcatctgggattgagctcattttttttttgtaaactcatagagactcaaccatatgttgaattgttcagcacttaactatgttgaaatattcttgagattatgctcacaagtgagaaaatagcattttaattcgctttgttgaaatctgttttttcctgttgaaagttaatgcttaagttttctaatcattgcttttttctgaaactatgataatttgcttttactttgtatttagtcccctaattagctcgaaaaaagtttgaaagggaaagtcaattcttacccaatggagcagatggtagactggagctgggtccagaatagggaagctgtacagctttacatttttaccttagtcagattttaagtatgacctcatttgtttgatttataatttttaaattagaggcaatctatattccagtgggtacaaagtattctaaaaccaagggtaaatggtttcaattgctccagtttcttatagtctgtaaagtgtgaaagtaattgagtattcattatttatacttaactacctagcttcttcagggaagtaattgataggaattgagaggtgacagaaattaataggttggttaggagaggctttataattatctaaaaaaactcatttttagacaactgcttgtttgctctttccttctgtagcatgttaatgcaaccctggacctgatcgaaggcagcatgactgtttgtactacaaagaagacttttgatccatatatcatcattagggccagagatctgataaaactgttagcaaggagtgtttcatttgaacaggtaaatctagaattacagagactttgctttgtttgcatcagtgttaacctataacatcccaccatcaagttttcatatttgtgcttaggtaacaatagcgtgggcctggaaaatgaatgtaattgtaaaaaatgttgataatgtcttctttttttttttttttttgcaaaaggcagtacgaattcttcaggatgatgttgcatgtgacatcattaaaataggttctttagtaaggaataaagagagatttgtaaaacgaagacaacggcttattggtcccaaaggatctacattgaaggtattttttaattagtggaaaacttgagtctcttccttaatactttttcagagtaatgaattttaacttgatctcttgatacaggcattggaactcttaactaattgttacattatggttcagggaaacacagtttcagccattggaccttttagtggcttaaaagaggtgagaactatgtattatcttcgattcattttca

SEQ ID NO: 12404 - DNA, 1029 bp, Homo sapiens
ctcaggtaatctgcctgccttggcctcccaaagtcctgggattacaggcatgagccaggccaaagtgggattattttaattgtgaataatgtcagacccacttttgccctgtgcttttctattaaatagaaatcctaagccaggtacagcttcaggcacctgtagtcccagctgctctggtggcggaggtggaaggatcacttgaggccagcctgggcaacatagcgagaccctgtctctaaaaaagaaaagtgctaggggcacctgatttagttagtatattgtctttctgaactaggactgtctcatttgggattagtagacttaaaactgtacagctgtttgggtactgtcttttaggaactataaagtgatcctctgtggttgtttattatgtccttctatttgctatgtacttaacaatattaacaataactatatattaacaataacccaagggtttttttttttatttttctatttggtgttttcaataatattttaaaaggaaaattgcggacatgtaacagttgcttttatgtatttatgtttaaaccagcaaaaactaagcagttctaatttttattcttcacaatttatcttagtatgcatactggcctgctagcttattttctttttgttaaaaacttggaaaagttattaaggaaatttaaaaatgacaaatcatttgttaacatggtgtgagaaaaatcatggaaagtaaaaagtaaagttgagcatttcttcccttcatcatataatttaaactgaagagtctgtcttttttttttttttttttcggttgcccaggctagagtacactggtgtgatcacagctcatttcagcctcaagctgctgggctccagcaatcttcccacctcagcctctcaagtagctgagactacaggcgtgtgccaccctgcccagttaattgtttattttttgtacaaacgcagggggcgtctcactatgttgcttaggttgctcttgaacttctgggctcaagtgatcctcctactttggcctcc

SEQ ID NO: 12405 - DNA, 1825 bp, Homo sapiens
ggtgagtttaattttactaccttaacaaaatgttttttctgtttttgttatacttgatttgtatactcggttattttcagttacatatgtacatagtctgtctctgaacattttggtaatatgttttctgaaaagtgcttatcaagtttcctgtaattctccttggacccatgactgtctcacatatatttttgcagaggaatgcttctttaaattatactatgtgtttgtgctaattgtaaatgtgtttattttaaatatttgcttagaaataaaatttttccctttatactgctatagaaaacatttgaagcaattcacccttctaaaatttgaaatctaaatagaacatttacttctaaaagtttagcagttgaaagattgtcaattgtaatagatttttcttctttgttttgcaaggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaaggtaaataatgttttagcttgagtattaacggttgttttataaaaagcattgcttagcttcttattcattgtaatttcttttctcaattttgcagttcctgagagtggagatctggtaagttgaattgttatatatttattgaattgttaagtatatttgaaattaaagcactgaatttcaaaaatggagagtgggatggttgttacattgagttctgaggcctacaatgcatggggcagactttttggatatgaaaaataattccattcaaaattatatcagtgcttctgctgagaaacactgagataaaaagcttaaggttttcttttcttttgaaacttcacatattgctgtgagggatttaacttttcaaaactgttgtcttccttagtaaaaccagaatatattaagtcacttatactgttacattcctaactacattatggttcaaattcattcctgaatttgttactccaatgtaaatatggtttcatattgtgactaagtatgttcacatatatggcatatggcaaagaacatgaaatgttcctgccatatagactgaactgaggaacaaccttaaagaaagtctatacacacaaggtagggcaggtatgttttgaatttggttttcttttgggcatgtttttgaatttaaattaactgagatagtttaaatagtttgtacatatatggaattagaaattaacctaaactgaatacttttgaattggaatactcttggctaagacttagaacaaatttgtaaaaggcaaaagtaagtatttctggcttggcttataggacaaaaaaagagaacataaagcagtgtgaatttcaggtgagaaaaactactttaagtattaagatagagcatcacactattttcatatcagtggatgggttggagtttgtgttcaagtttggggtttttttttgtttgtttgtttgtttgttactaaatattgatgatgacaaaacagtctagttaaggatagaaaacctccacctgtggtttgaattcctccccacccccttttggatttttctatttattagattatgttgttgactcaaacattcatggaattcacagagggtgtgctcattgtttagtatcatagaacttgtatcattgtttagtatcatagaagtgggattattttattttattattattattttttttttgagatgaagtattgctctgtcatccaggctggagtgcagtggtgcgatctccactcaccacaacctct

SEQ ID NO: 12406 - DNA, 1050 bp, Homo sapiens
ttcagtgctgtgttaagtgttccacctctctagcattgctattttatgttgtttggtaaagagaatataatgttttgattaagaacaccatggggtgaggcaatggaccaaattagtatttctgttgcttttcttgtttattatgcttaagtcttcatttttaattagtttttacattttttttttactaaaatggtttttcctacacatcttggtcaccttagtggttctctttggaggggtgtggtagcagtaattttgatgggattaaggtttgttatgggcaacggcggtgtttacacagatagactagaactttgaaggtaatatctggtgactgtgctttttggtttttatacctttgctactttatcatgaggtctaatctatgtattaaataatgtttgctgtcacttaatcaaggaggaattgaaagaaaaggccaagattgaagatgagaaaaaagatgaagaaaaagaagaccccaaaggaattcctgaattttggttaactgtttttaagaatgttgacttgctcagtgatatggttcaggtaattttattcataaatgtaccagtttactttgaagggtaaacctttgaagtttaaatggctgtgatcactgttctcttcagtgttgatctttctagaatgattgcttacttttgaaatagctaatatctgtagaagagaaattacagctttgattaatgtaatcaaataaattagtttattttaaaaaatgagataatgaaatggtcccattgataatggctcattatcgactggtgttttcttataaccctgtgccttttgtctttacatacttagtatggaagtatgatgggaaagttaatcttatagctgcaattatgcaattcccttaactcttccaggagaaatttgcattttaaaagaataccataaagatgttaaactcattcacaatggttacattctctggcaaaccataactgttgtcacctttgggaaactgcctcaagcatttcttgagtgagcccctaccgtctacattgtagtagtacatgt

SEQ ID NO: 12407 - DNA, 1024 bp, Homo sapiens
taaagatttagggttgacaatatgatttacattttgtttatcaatttacccagttacatttctacttttgaaatatagccagtggatcaatgtatttatatctatttgatttttatttactttgaatctaccttttgcttcagataaaaaacctgtcattcactaactccaatgcttcagtttcagtatgacaaaagaagtgtgacttccattttactctgatgctatataactgatttctaacctttcagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataaggtaatgctttctcctactttgtttaatttaacattctagaagacgaattctagaaacataagcagacttggaagaggttaatctttagaactctcattgaaattgttattagaggcagcacttggaggaactatcaataatagcagttaaagttgtggtatgcatttgttaaatttgtaagacttcttagtgagaaaccactggttttagcttggatgccagtgtttttatacagccttttttttttaaatcattttagcgatttgaaattattaatgcaatttatgaacctacggaagaagaatgtgaatggaaaccagatgaagaagatgagatttcggttagtaccaactttattttggtatgtttttaagatgataaaatcttaggacttgtcagaaatgttagcatttaatgatggagtacaatattatataaccagttgtattttttcattttttaattttacgtctttattacacgtttttctattactttatttttaaaaaacagtcattcaagattgtaatttgcatggcaataagcagcggtttcatgggttctaagtttcttaagtgtccacagcagtttaaaacaccacaagtcttatttccaatttgcagcacctgac

SEQ ID NO: 12408 - DNA, 1088 bp, Homo sapiens
tcatcattcctagattggatcaaatacatgtttgaaggctttgaaccgtgcagctttcatcaaccctcgcattgggctcttgtgaagggtgaagatgacagacaacgattgttgcaaggcaggagcagaacttaaaaagctttcttgcggaactgctatcttccagtttgtccgcactgctacctgctgtggccattccctccctaagttgttggttaccctgtacagttaaacacaacctccagtcttacctgaaattgcttatggtgtgtgtgtgcctcagtagttacttcattcttgttctaaagtttctgggattagctttttgggggagcaagaaaagccagaagcccatgccagttcaccaccttggcagaatagtgcttttcacttaaaattaacagaaatagaaagttgatatcttcaagtgtttgttttttatttctaataatcttaagtaaactggtggctaagtaagtgaattatttgatttacaaaagtttgtggcaggaaagtttaacctggattttgtatctgttgcacagattccctgaagttatttaaattttaagtgtgaacatttattgttagagaggtttaatcattctttaggagactcataacctagtgtgtataaccttttaaaaatcagtgccccctgttcacattagcagacatggaatcaacctaaatgcccatcagtgacagatctgatacagaaaatgtatacaccacgtaatacttgcagccatacaaagaacgagatcatgtcttttgtgggaacgtggacggagctagaggctattatccttaacaaactaacacatgaacagagaaccaaatatcgtacattcttacttaccagtaggagctaaatgatgagaactcatgaacacaaagaaggaaacaacagacactggggttacttgagggtggagtgtgggaggagggagaggagcagaaaattaagtattgggtactgggcttaatacttgggtgataaaataatctgtatagcaaaccttcacatacacccctaaacctaaaataaaattttaacaaaatagtgcttcacagttcattgtatg

SEQ ID NO: 12409 - DNA, 1191 bp, Homo sapiens
tgtcttgatcttattaagtttttagaatattaattttgcttttggttttccttttccatactgtcttttgttactgctgctgttatctcttttttaggattgctctatgttattctttccagttttttaaattgaatgcttaattcatttgatttttattttttaatttgtgttttttatggccttaatactcttacttttgtaaatgttgagtgtgaagatctgtatgctgaaattaatagctcaagcttattgtattgttcagcttctctttatttctgcttattggttgtctgtttgacctgacagttttttctgtcatttgtagattgaaatattttggagccatattaggtgtatgatatttgtgatgaacatttcttgttctcttgtttcattttactgatatgtgtcttcctttgtgttttataatgttttttgggggggtcataatttttatttgtctgatattacaataataacccccagcttttatgacaaggccttactctgtgatccactctggagtacagtggcacactcatggctcactgtgatcctcccacctcagcctcccaagtagctgggagccacaggtacatatcatcatgcctggctgttatttttgtagagatgggggtctccctatgttgcccagactggtctcgaactgttgggcccaccttggtcttccaaagcgctgggaatacaggcataagccatcacccccagcctctttttttttttttttttttttaaacttttaacctagtatgtcttttttttccatcttttcatctgtgtgtcttcctctagtatcagtgtttgctgcttttattttttggatacagtgtctcgctttgtcatccaggctggagtgccatggcacaatgacggctcactgcagcctcatccttcggctcaagtgattctcctgcctcagcctcccaagtagctgggactataggcatgcacaaccatgcctggctaatttttgtatttttgtagagatggggttttgccatgttgcctgggctagtctcgaactcccgagttaaagtgattcacctgcctgggctccccagagtgctgggattacaggcatgagccaccacactcggcctcaatgtttgcttctttattattagttgcatttcttagaagttgtattgtttttggatttattgctgc

SEQ ID NO: 12410 - DNA, 1169 bp, Homo sapiens
cctttagagtctacctttgtattagttgtacgtaggcttccagttccttttttttctgcctcattttttgagccaggtttgtttgtttgtttgtttatttatttatttatttatttatttatttatttatttattttgggtcctcctccagtgacatgagctagttttttttttttttttaaacactattcactaatcaatccattgttcccccatttaggtgtaccacctaccttcattgcatatcaagttgtaaacacccgtgtttgtctttgagcagcactcttatgttttattggtctttgtctcttgtcattgtcatacttaattactatgactttatagttgtcttaatatttggcagggcaggttgcatcctttcatacttctcccccaatcatccacatttttgacagttaagtttaccagggttgtcaacaagcaaaaaaaccttaaaacgttgataggaattatattgcatttgtagatttacagaattatatcttttaatattgtctcatccacatacttctaattattcaggtcacattctgtgtctttagtttcaaagttatcctcatagagtctattggttaagttaatttctgtatattttgtgtggctgttgtgaatagcatcttttttgtattttctgtttggctgttcttgatttacagaggattgctgttttttttttttttaagttgctcttgtatccagtaactttgctaaatttattgtagtaatgtgttctgttttgccccccagtcacaagattttatctgcaaataatggcagttttagctctgttcttccacattacattataccacatacttttctttacaacattaccaggactttcactactgtgttaaacattagtattctttgtcttatttctattcatactgggaatgaatataaaatctccattaaattcagtgcctatttactgttttttaatctgacctttggtttttttttttaactgtatcaattaagatgctctattgaacttttcccttcagtatattaagtaaatagtaaatacatgttttggaaatacttattttggatatcaaactagccttgcattcctgtagtaaattgaatcatgatgtgttattgttacattgttgagtaattgaattttacagttcttactt

SEQ ID NO: 12411 - DNA, 1469 bp, Homo sapiens
gtgtgtgtgtgtgtaaggggcgggtaggtatagatacagcaactcaattagaagtcattgtttgcatcctgcactgttggagtgacttggtgtacttgtgtcaaacagctgcccatgagttttgtctgaatttagaaatgttacaggttgtgatgtggtgcttataacagtatgtttagtgtttaatatatggagaacatgtagtgtgtgtctttttaaagatccactccttcaagcagaagagccatttattaaatgtaggtaatattcacaatttattttagcagatatttttaaaaggagtggtggtgggggattgtactacttagggtatgtcttgtagatctgcgccaagaatattaaggtaccagatgactcagcttttcatttttaagccggatggaagttaattgtgaaaagacttcagaacttgtattaatagcttcagcttttgtttagtaacattttcttaacagatacagaactgtatcctcagtgaccaatattgatatttaaaaatctgtattggttatcctggctgtgtgtacatcatctagtaattgaattattatcagaagtaaattgacctcaaaaaaagtaattgggaaaattaagtttatggcactttgtgtaataactgtattgatgatgaagagaaggttagtactgtaatttgttttgtataagtctagtgcatatttggattgagtatgtttttaaaaagccattgaaaaccacattttgtttggctttagttacagtctttgactgtcccaactattaactttattaactttattcatacacatagaaatacattacacaagcatcaaacataaacattcagatcactcacttcatctttctcctgggcctaaaactgtcagtatatttgcagttttctgatatgtgttgtctgcattcagaggactgtcaagagtcatagataggcatctgaatgaagctttgagcttcttaaaatgcaaggtgggtgaaacacaggataccaggaagagaaaggatattgttcatatagttgtggcagtggccttgagaactgtcttgactagagatagattaggaatctgaattattcctgaacattgggttttcctttagtgtattctctttagctttccctgcccgtctctactcattagatataccagcaatttatgggccagttaggaaaacttcatgagattggattgtcctattaaaaaagcataatacattttcataaaatccttctttcgatgcccttttttttttaaagcacgtcagctaactgttcagatgatgcaaaatcctcagattcttgcagcccttcaagaaagacttgatggtctggtagaaacaccaacaggatacattgaaaggtacagcttttccatagtccttatttatctttctataatcaacgttgcaggcgtatctatttttaagaccatctaggatttagatatgca

SEQ ID NO: 12412 - DNA, 1056 bp, Homo sapiens
tagatgtaatctcatgttcaataattagatttttggtgattttttttttttaagatgaaatgggaaggatgctatcttattaatttttaaccttctctttgaatggtgctatcatcttggctttgttctaaacaagagctagactcagaagtcttcactttattctttctcacctccactgtgaagtaaagaaaaggaaactccaaagatagtataggctagtattgttgctccacagccataagggatccaggactcttctgttttcctaactcctttttctttagctggtggctttcattctctaggatgcctcctggtccagtgtggctgctggagcttgagccatcacattcatattctaagtgggagggggagagggattaagataaaggcttcccagctatctaccatcctgttaaggatacttcctcaaagaaatacagcatttctgcttttttatcttgctgtcaaaatagtgtagctaaaggtaggctaggaaatgtagacttttagcttggtgtgttgccatctcatataaaatgagaatgttgttactaagaaggaaaagtaaaatcagtagatattcggttgaatgcacgtacttgttgacatcacattccccaaaaacctgcaaaaccaattttataaagcttcaaaagtataaactttacatttgaccagatgcttttaatgaaagtgtaagcacttccagtgtgtacttgtttacatatgaagttagaaaacggaattaccttttgaatttcctatttcatgtctttgaaagagatactaattttgaaaatgaattttaagtttttctgtaactttttttggtaattggtacatttgaaccttggtgtgatactatgatattatagcaaagaacagtctgaacttgatcaagatttggatgatgttgaagaagtagaagaagaggaaactggtgaagaaacaaaactcaaaggtattactttaaattacttcaggagccagtgattgctggcacatgtctactagagggtagttataagtaccagtctatttttttggacc

SEQ ID NO: 12413 - DNA, 2587 bp, Homo sapiens
acgactattctacctttatgccggatagtttgggtgtaggatagtaagatgggatcatttttcttcagaattttgaaggcattgctccattgtcaccttgcttccagtgttgctgtgttgaagttcagagtcattgtaactaaccatttgtgtgtgataattaagaaatatgtacatttacactatatatacatttctggaagctactctggcttcagagttctgaaattttcacattattatttttttctcttaatgttacatattcagtggtggaccctttcagtgcagcaattcagtggcttttagttcagggatattcttgattgaactttgtgattgtctcatttgttttctctttctggagctactattagatgttgtgtgttggattgctctcatgaccttttgtcctattttccatctctgtctctttgctcttctttctggacagaactgaagactttcagcttgtgttgagttttaaaatttctgttgttttagtttccaagacctgcttcgttcttcctgtttttttgtttttttttttttttaaatagcatcctcttcttgtttcattgatgataatgtcttttctctggatgtttcttccatctttatagtccatttgctcttacattttctttctctcatttgttttggtctcaatctaggatgctttcctcaaatataaatcaatacttggttggctgctcattaagattggattgggtggggtgtagggacacttcagacatgtttaaaaaagaaaattgattggaaaatttgagcgttggagtggggaggcttgttaatttgggatttcagtgtagggtcaccagagtgggcatttgttagaaaccccagtgttagaatggtcatttttttttttttctgggctagtcagattcatcgttgaacagtgtctgggtaaagatctggcttctggtgttcctttaaatgtagaggaggctctacatttagcattctaatgtgtacatagtcctatatctttgatactgttgactgtgtctgttgtcttccagtccaagttctgaattttaccctttcctgagaggaaactgaatatttctgctagtgtagagaagatctaatgatttaactgcttatcagtttttactttcttgttttagcgaccttctctcctgtcccaccccttgccctagttctagaaatgtacctggtgctaccagttcttatccttttgaagactgattgggctgcttctcagctttccccactgctaatcttagatttcagttctctcaatgaaattatcacttgtctggtttccagcttccaaaatgttgctgcccttgttttctttgatttcagtgttagcctgctaacaaaacaaaacaaaaaaaccctttatcataattttagtggagattttagaaggattaagatcagatgagtttgtggcatctgccatcttaactttgcaactctcattttaaactttaaaaagagtaaattggttgtgacagcttgatttcccccttccttattatttaattttggatgcctgttagccctgggagggtggaagtcagaggggagtcttgtgcttgaaaaccagagtcagtaaacctttctctgtaaaaggcttggtggtaaacattttcagcattttgggccacatacgattctctaactgcagttggccctctgtgtctgtgggttcagcatccatgagtttgcatctatgaattcaaccaactgcagatggaaaatattagggtaaaaaacaataaaatataacagcacaataataaatacaaataagcaatagaacataacaactattgtttgtttgttttgtttttaatagagaattcttactgtgttaatcaggctggtcttgaactcctggcctccagtgatcctcttgccttggcttccggaatgttgggattgtaggcatgagccactttgtctggcccagcataatacaactatttacataacgtttatatggtatatagtattattataagtaatctagaggtgatttaaagtatgcaggaggatgtgcataggttagttgtaattactgtgccattttatataagggacttgaacatcccaggattttggtagggaggtttcctggaaccagtccaccatagactctgagggatgactgtactcaactctgctgatgtagtgtgaaagcagacaatacataaatgtagtgcatctgtgttccaataaaattttatttacaataatagggtgggctggatttggccacatgggcatagtttgtggacagctgttttaaagcctttggatatagatgttcaattgattaaagacacgagaggaggagatgctccagttatctgtaaccagtgaccgttaagtgtgtacacttatcaaacacttaaagtttatactaaatcaaagttcttccagaaataggctgggcgtggtggcttatgcctgtaatcccaggattttggaaggcggacgtgggaggatcacctgaggccaggagtttgagaccagcccagcctgtctctactaaaaatacagaaattagccaggtgcagtggcgcac

SEQ ID NO: 12414 - DNA, 1030 bp, Homo sapiens
tacattacctttgattgaataagggaaaaaccttttatgtatagggtaccatttaaaaatcgaagggaagtaaatgacttttacagttattttcaaggcactcttgtgtttcaagcttgtttgaagttgcccaagtttaaataaatggcctaaatctatagtttagttctaagaatactgtcctttggagaatgtatggaactaaaccctggtaggtggacttggacatcttctgtcataaaacctgactttcatagattctccaagtcaacattatgttagtaaatagaaatttaaaagttttcactataccaatttgaatatctttctaaattttatctgctacaaagtgcctatttttatattaggcccattgatttgcagaattataaagctaatactgaatatggtaaattactgcacttggcctttaatgagatttttgaaacgaatacctgtaccataactaatgtaatccaaaatgccatctcattttattcagcttgctcctgttggctcctggtaaaactgagttgattctaaattctcaaaatatattcaaaactaagggtctttttgtagaaggggctaaagaagcagtatctgttggacttcaaaggtctgaagatgtcaaaatacaatattttattcacttcttggttgtaaatttgaaacaaaggattagagagaatgactcatcaatatcaaaatattaatgatcagtgtattcagatcttcaagtttaatcaaacctgtaattgtgttctcagtttagtctttgggtaactatctagcacctgtatggacatgtatcttatgtcatgagcaaaagaggcaaattggttgcttagatgtagaatgttaaattgtgatgagagctataaaggaaggaaagggtaaaggggtcaaagagtaatacagcgtttacacaaaggaacctgttataatttgatgattttaagttccatttcaaactagtttcatctaaataagtttttgggcagaataggggttagaaggagagagttgt

SEQ ID NO: 12415 - DNA, 1209 bp, Homo sapiens
ccggcgagttgcaggaattaggccttgacagggagcgtccgccgtctaggctgcggcgagcgagggaccaggcgactggcgccagccctgagcgttcccagcacaacgccgaagggggcggggcgggccgggcgccgggcacgcgggccaggccttccccacaactgatggggttgaaatttcctttccggctcagcagggagaaaagatatggtggggtgcttaacagaggaggttagacaccggcgggaaccagaggagcccaagcgcggcgcctgggcctcggggctgcaggagtcctcggtgggggtatggaggtcgccggggaaggaggacggttcagttgctaggcaacccggcctggacccgcctctcgctcgcgttgctgggagactacaaggccgggaggagggcggcgaaagggccctacgtgctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccggtaacggatgggggcctggaagggaagggggaacgtggtgttggctgggcggcctgcgcagatgggagggccggagggatggagggactgggagccgggagtcggggccgctggccgcccgtggcctccggggtcgtcctgtgaggtcggacaggaccgcggagtccggaccccggagcctgagaggggccccggggccgaccagcgcttttatcggggacggctgaggcgacgtaggggttggcgcggcctggaggcctaaggttctctgagctccaccgtcttttccgcgtggaccggagcgaggccgcggtgacgcccgggtgccctgagactcggctgcgccgcgaggaccgggaggcccccggcgtacgggccgggccgagtgcagagccggccgcctcttggacacccccctgcttttccctcaaaaataataccaggagggaggccgctgggagatgaaaagaacggcggaggctgcgaattccgacgggagggaggggctgtggagggacgagtccccgaggcggggagggggcgggggaggctgcgacgctcccgggctctccgcccattgggggcggccgcgcggggaggggaaacccccggcg

SEQ ID NO: 12416 - DNA, 1049 bp, Homo sapiens
gggcttagggttgccgctccaggcacagctgctggaaatcctagtctgttttttctgccttcgcgtacaacgggccagctcaccccacctggcaaagctgcagggcttttccaccaggcggacagaagggcagccctctcgcccaaccaagaagccgtgctaccccggcttcgactcctggcttccgggttttctccccgcctattccgtttccggccgttcccacccctgttttcggtcggcccgggtgttctgcaagctggtcaaaaaggggaagcggcccagatatgttaagttctatggccgctgcagggtctgtgaaggcggcgttgcaggtggccgaggtgctggaagccatcgtgagctgctgcgtggggcccgagggacggcaagttttgtgtacgaagcccactggcgaggtgcttctcagccggaatggaggccgcctcctggaggcgctacacttagagcatcccatagccaggtacccgcgtcccacacgctaacccgtagccgggcaccccaggcagcctctgtggagctcttgtcccatcctgaggcgatgcgtacttagaaagactgacctcgggtgaaaccgctgtatgctcggaattagagccctgcccaagggaacactcctgcaccccaaatcttaccaattctcaagaccacttctccccactccacccaacggtggaatcttggaatagagcagagttttttccaagaaaggaaaaaactaaggatgtatccaaggaacaatattctcattttatgcttatggctgtgtaaacatggttttaagatgtgggaagccagccttctgaaaatgagttgctttatttcttttttgtacaggatgatagtggactgtgtttccagtcatctcaaaaaaacaggagatggtgcaaaaacatttattatctttctttgccatttgcttagaggacttcatgcaatcacagacagagaaaaggatcctttgatgtgtgaaaacattcaaacccatggaaggcattggaaaaattgttctcggtggaaatttattt

SEQ ID NO: 12417 - DNA, 1015 bp, Homo sapiens
ccttttcgatggaatcacactttttggctgtcaccttgtgccatatacacacaaaattttgtggaaggcagttttaactttctgaagaatatctgtcaaaatttaagaaaacaaatgtataaaattccattttttccagtgtttagcatttctagtaagcagtgaggttgtttgacatacagtgatgatggcattattgataagccatacatgagactgcagattatattgaatcatattaaatgtacagaaataaaatattagatttatatcaaattttccaatttgaaccagtggggaaaatcccacagaaatcagtaagtttacatttcaatttctatcttatttgactaagtggaaagagattctttaaaatgtataacctgccattatgtaatttggtttcattttattctacctgttgtgtgagtttagtatatttaatttactttttgttactctttacatactgtttatttttgttagtttttaattgaagatggactgttgaaattgtataggaccagtgtcttattaatatgattaatatatttagaagagccacgtgaaacccatgacaaaatgaatgtgaatattctttctaaaaatttagaaaatgttatctttttgcatttattatgtaaaactgttttacagtatcaaaatttttcacttaaagaaaaaaaatgccatgaaacatttgaactgatgagccacagaacttcagttgaaatttttttcactttttagcatgctaaatatacatctgagtttaaatgttctgtttaatggccattcataaattcaagcactaccactggtcagttttgtgtgatagaataaaaatatgttacctgcagtgtaagtacagcacactgtcaaattcttttccttaaggtgcacagtaaatgtacagatagttataggccactgttttgtaatgtagtacatttctaatctattattcctaacctattataactgtttgcagaaagaaaagaatttttctaataat

SEQ ID NO: 12418 - DNA, 1059 bp, Homo sapiens
tactaaaagcaacctacagattcgccacaatccatgtcaatattccaagcctatttttttgcaaaaatgggaaagcagattttcaaattcacatggaattgcaaggggccacaaatagtcaaaacaattttgaaaaagaagtataaagaggactctcacttttcgatttcaaaacttactataaagctatagtaatcaaaggaacgtggtacttatgtaagaacaggcatattgaccaatggagtagaattgagtgtctaaatgtcaagccagacatccatggtcaattaattaatttatttattttaattatactttaagttctgggatacaagcacagaatgtgcaggtttgttacataggtagacacgtgccatggtggtttgctgcacccatcaacctgtcatctacattaggtatttctcctaatgctatccctcccctagcctcccacccaccgacaggtcccggtgtgtgatgttcccctgcctgtgtccatgtgttgtcattgttcagctcccacttatgagtaagaacatgcggtatttggttttctgttcctgtgttagtttgctgagaatgatggtttccagcttcatccatgtccctgcaaaggacattaagtcatccttttttatggctgcatagtattccatggtgtatatatgccagattttctttatccaatctatcactgatgggcatttgggttggttccaagtctttgctattgtgaatagtgccaaaataaacatacgtgtgcatgtgtctttatagtagaatgatttataatccttcggtatatacccagtaatgggatcactgggtcaaatgttatttccagttctagatccttgaggaatcaccacactgtcttccacaatggttgaactaatttaccctcccaccaacagtgtaaaagtgttcctatttctccacatcctctccagcatctgttgtttcctgactttttaataattgccattctgactggcatgagacggtatctcattgtggttttgatttgcattgctctaaggaccagtgattatttttttt

SEQ ID NO: 12419 - DNA, 1035 bp, Homo sapiens
gaatggactcaaccaagtaaatattggtccttcagtgacatgtgaggctgaagacttctaacaaaattgttaatgaggctgcttggccactgcctaacattgcaaatgctagaaatcacacagtgcctgaatccaaaatccatgtttatttttttcaatcacaattttcacagagcccctaacaacatctcaggttctgcagaataccaattcagaaaccttggtttggagagtttccaaaaactactttagcgaagacccaggcagtgtatcaaagaataggaaaatgggggaaaatgtgaccaggttaagaaaaacagaaattgatttacatggttgaaaattgattacatggttgttttgtcatccatttaaaataagaattatgttttccaatcatgtttcatactcggttattggttaataaatgtgagagagaatttgtgatacattttttaaaatttttgtttaccgttttgtgttttagggcagctcttgaagaaaatccttatttccgtttgaagaaagtagtgaaatggtatttgtcaggattctataaaaagccaaaggtaataatgtttgtttacattttattgtctttagtgttttatgaattctttatattttatgtaatctgtagattgtgtgttaacagttacattactgggcttctttgacgtagcaaaattgcaaaatacctgatcatttagacatgtattatgattgaagtcatttaattttatttaatgtaaattttatttactttgaaattttataaggacggttcccagatggtagagttaaacccattttgactagtttaaactattttgaatcctttgtatttgtaatttgaaattgcttttttttttttttaccagggactgaagaaaccttataatcctatacttggcgagactttccgttgtttatggattcatcccagaacaaacagcaaaactttttatattgctgaacaggtattagaaatgcatgtatggaaacaaaactgatctggaagttattggaatattt

SEQ ID NO: 12420 - DNA, 1033 bp, Homo sapiens
gtaacttaatagacaaaaatctgatagaaaggaagcattgtgtgatttactgaagagttagcagttcagagttttcttcttcatcctccatggacatattaacacctttttatttgttagtggtctttatggtactcttaaagatatatttaatactttttatattttactactaaatgttaccatttatgagacatatacattgttttggttttgtttttttttatgtaagagattcgagtacaaccttttttattcctcctttaacacttaattcatgaagcaaatatggagagagaaaaacttaaatgatatcaaggtaactttaaaatcttaataattaataatggattttgtcctcactttcatgctttcatgtttcatagtttagacaaggttggtatagggaatcttctaaccttccaaagtttacttttatctgattttttttgttttgttttgtttttgtttttgagatggagtctcgctctgttgccagcctggagtgcagtggcacgatctcggctcactgcaacctctgactccctggtataagtgattctcctgcctcagcctcccgggtagctgggattacaggcacatgccaccacgcccagctaatttttgtatttttagtagagacggtttcaccatgttggccaggatggtctcacactcttgccctcatgattcgcttgcctcggcctcccaaagtgctggggttacaggcgtgagccatcgcacctggcctcagattttttttttttttttttttttttttgaaacggagtctcactctgtcgcccaggctggagtgcagtgatgcgatctcggctcactgcaagctccgtctcccgggttcacgccattctcctgcctcagtctcccgagtggctgggactacaggcgcctgccaccacacccggctaatttttgtgtattttcagtagagacagggtttcactgtgttagccaggatggtctcgatctcctgacctcgtgatccgcctgcctcggcctcccaaagtgctgg

SEQ ID NO: 12421 - DNA, 1025 bp, Homo sapiens
gagcgagactccatctcaaaaaaaaaaaaggaaagaaaaaaaaaagaaaaacagaaattaaactagaaagctccggattcaggtagataccgagttctaccaaccgttaaatgaaagaataattctagtcttgcacaactgctttcagaggatggaagtggagagtgagaagaacactagtattagtataactttgacatgaaattcaactgaaagagattgtcctataatttttccaatcagtaatgaatatggattacaacactccttaatggtagtagcaatatctttttataaagaggacaatgcgttatgactaagttggatgaaaatctaagaaagcaggattgacttaacattagaaataaatgtggttcactacactaacagattaaaagcagaaaaaataatatgattatcttaatagatgtgggaaaagttttgatgaaatccaaatttcgttttgttaactcttagaaaactagaaggagtgaacttccttaaatatctgtatcagtacctgttccagctggacatggtggcttatacctgtaattccagcactttgggaggttgaggtgggaggattgcttgagcccaggatttgaagaccagcctgggcaacatgatgagacctcatctcaacaacaacaacaacaaaaaagtcaggcctagtgacatgtgtctcttgtctcagctactcaggaggctgtggttgaaggattgcctgttacaggaggtcgaggctgcagtgagctgagatcacaccactgcactccagcctaggcaacagagcaagaccctgtctcaaaaaaaaaaaaaaaaaaaaccagaaaaataaaccctgttccttaaatatatatattaatatatgtaccaatatcaatatctatatccaaatatatatataaatacacatataaaaatatatcaaaaatctacattaaacattgtacttaatggttaaatattgacagttttgagattagaaacaagaatgcattcaccatttctaggcaatactg

SEQ ID NO: 12422 - DNA, 1028 bp, Homo sapiens
tcagtttttattactgctgttgtgatttggctttcttggatctgcaagaccatgactacttgttcatctcgagctttgcagtgtcaaatttatgttgttaatatatcctctcctggatatgtacttttgggatatatatagatatttgtttatttttttaaaataccccttttcttgattttacttgagttttaggagggaacgcatttgttcagtatcttcattttgccattttaacctagactcttttaagactttgtgtatcatctgatttaatcctcataacaatcctataatatcagtactactattagcattgtatacgtgagaaaacaaagactcagagaaattaaactgtttaagtatttctaggaaagataaaacagagatttgaatgcagtttaatttcaaatcctgcttaactattatactagcataatgctgtttgtgatgttctttatgcctttaaaggcaagcaccattacatgaattataattatttgttgtctacagttaataataatgtacattttatgatatggagaaaagcaaaaaataataataaccaaaccaacccctaaaacccacaaacttgttgcagttatgggtattagtggtaaacttattctccattaattgattttgaaatgcctttgcccaagaaagaatatgtcacatacaagaaattgagttttgcctggtgcggtggctcacacctacaatcctagcactttgggataccaaggtgggtggatcacctgaggtcaggagtttgagaccagtctgcccaacatggcgaaaccccatctctactaaaaatacaaaaattagccaggcatggtggcaggtgcctgtagttccagctacttgggaggctgaggcaggagaatcacttgaacccgagaggtagaggtggcagcgagctgagattttgccactgcactctagcctgggcgacagtgagactccatctcaaaaaaaacccaaaaaacaaaaaagaaattgagttttgctttttcatgtgttct

SEQ ID NO: 12423 - DNA, 1090 bp, Homo sapiens
tcttgattctaggtgaaatgatgggaggagagagtcttccttgagaaattctaaacacaagcacatatttatatgagtttggggtcaaaatccatattatctctgtggcagaaacacccttcagtttagtttaaaacagtttgggttattagtatacacaagtgcctggaagaactgacacaaatcttctttagagaagagtattttaaacacagacttcaaagaagtgtatatgagctcataatttaaaatcaataaaaaattaaaatgagatgccattgtgcacctgtaagaaagagtagcttaaaatctaaaataccgtcaccaccagatgctggcggggatgtgaaaaaaaaatcatcaatacgtgggataacgaaccattttcagagagaatccacatgaggtacctactgtgcagctgtataaagtctgcatcagttggaactatcagttgcagaatgaaatttaatgggtgagagtcatttttaaaagagataaagctgaggatctttcagaattcttgaaagacaacaactgtctgattaaggaggccccacaattcccaagcaggaaatctaaaaaataatagccttaatgctgatatttggcaagaagaaaggctcagaagtaatgaactagaaaaagaataatagagtaaacccaaagtaaacagggaaggaaataataataaagataataagttaattaaatagaaggcaagacacggttgagatcaggaaagatgatggttgtttgtaaaggctaataaaattgtcaaacctttggcaagcttaaggggaaaaagaaacattaggaatgaaaggggacacaactaaaaatacaagtagatgtttaaaagatattataaacaactgtaagccaataaatttcaaaaacttaatgaaatgaacagatttctggaaaggtgatttcccaaaactgactccataattagaaaatactagtgatttttataatctttaaagtaacctaattagtaatacagattacttttacaaagaaaacatgaaactcaggtttacaaacaaatcctaccaagcctttagggaaaaaaaaaggtaatttc

SEQ ID NO: 12424 - DNA, 1047 bp, Homo sapiens
cccattacatgttaatgtaagtaacatttttattaagaactacagtgttttctttccctctactccccaaaaagttgattgagaaggttggtaatggtttatcccaggacttctcaaccttcgaactattttcaggacttctcaaccttggcactgttttggcctggaaagttctttgttgtggagggctgtcctatgcattatatgatgtttagcagtatccctggcctctacccagaaaatgtcaatagcagttaccccagttgtgacaaccagaaatgtttccagatgttgccaagtatcccttgagggacaaaaccatccatgattaagaactgctttttggcggtttttgcaaatcactttaatgtctagcttaaaagacacctgcatttttgtatctgcttctgcagtctgttgtgatgtgatgatccgattgaagtatatgaataaaatctggtctcatgcatatatatatatggggggggtttatacataattatagatattctttgataatatgccaaaacttgactagtagtaattttctttatgttaattgcaatctggaatctgaaacgctgtcagtacacttttcatactctgttaaaattcactcttgaattttgaatggctctttactcatgcatgattttgtaacatcatgcattagtcatttggaaaatatttgctcactgaattatgcagatcttccaagtgttgacacattaaaaaatatagtacagagaagggctttatgtatgcttctcattctgttgcacagaatattaaaatcttacgtactaaaggttcaagagcaataatttttacttcttcatcaaggacatctgtaagtgaaactgtcattcttctgtgagtgcatgactgaagaattcagtgcctactactccagtttggtgcctctgccttgatttatgctaagttgccagcagttttacccaagattgcttttgtgccatcaatgaaaatggcaacataatgaaaaagtattatgaaactagttttcaccttgcagatcctctagaa

SEQ ID NO: 12425 - DNA, 1045 bp, Homo sapiens
agaatcttaaaaatgatgttaagatggtggtatcctcatcttacagatgcagaaactgggataaagagaaattatatagcttttcccgagctatacgacaagtagacgatggagtcaggacttgaactcaggcctttgcatatcgaattacattttctttctatgagttttagggcattatgtgtttagcgttaattcatactggatgagataacattgttatagatgaccatatacgatgcagaggggatcagaagagtcagttatttgagtggagttgaaaagtcagtatcaaaaaagttttttaagacaaggtaatgcttaacctgagtgttgaaaggaacttaggtatttgcctggtgaaggtgagaatggcattgtaggcaaaaggagctgtgagagtaacaagtaaattgttcaacaacatggtatgtttgaagaagtgaaagtcattttcagtttgtcacatttgtgaagtgtaggattgatgggtgtttggaggaatgcatgacataagattgacaaaattgtgaagagccttgaagatggggttaaatgtttttctctccaattttggtaggctgtgggagtgcagaatcattgaagtgactcaaccatgttgttgaacaactttagaaggctctctatgatatcggtatggaagataaattgcttaagtgtaagaaattcaggtggcaggtagtagcagtaactgtggatatgagaaataaagggtaaatatgagagactacgtagagctttaggaccttgtcctggacttaatattaggagtggaggagaatatagatgaggaaaataaaagtgaaggagaaatttagagcgacttacaggtttctgtgttgtgtgatttggtgggaggtaccattccttaagggagaaaatataggaagaagagcaggggcagagaaagggaagatgaagtcggttttggacatactgagtttgagatgtgtatccaagtggaggtgtacagaggcttggtgtcccatacagtttctcatttaatcctttctataatactgta

SEQ ID NO: 12426 - DNA, 1038 bp, Homo sapiens
aggccattattctttcctccagagccagtattaacctctggagtaacctaacctattggaagtgggtcctgttgttggataacccaaagtctgtggtctgcccaggcatctcacccgaggagttgccagctagattgaagtcctaaataatgaaaattcttaagttgcagggatctccttatgtaaagttaaaataactgtgaagattttagtcactagtttattacttacattcttattttctcatgttaaaataacttcatcttcccaacagctgcttgctaactctaacagtttgtattaatcatacatacaagattgttaatagaagttattcttgaactgaaatggagtagtagaacgtatcccaatatacccattactcatcttcaacaattatcaacttggattgacattgtttcatctatactcccaccttcctaagccagagtttttgaacaaatcttagataaatcattgtattcataagtatttactgtccgtatatatctccaaaatataaagactttaaaactttgatcataaatacattattcctaaaaattaataactctttagtcagataattattcagtgcctacacttccctagttctctcatattcttttttttttttttttttttttttgagatggagtttcactcttgttgcccaggctggagtgcaatggtgcgatctcggctcactgcaacctctgcctcctgggttcaagcgattctcctgcctcagcctcccgagtagctgggattacaggcatgcgccaccatgcccggctaatttttgtatttttagtagagacagagtttctccgtgttggttatgctggtcttgaactcccgacctcaggtgatccgccagcctcggcttcccaaagtgctggggttacaggcatgagccaccgcgcccggcctctcatattctttttatagtaggttgttgtgttggacttagttgataagtcacaagtctttttgaatcttttaaatctctccgatatctgttaatttttacctttc

SEQ ID NO: 12427 - DNA, 1085 bp, Homo sapiens
taattgtgtatttccagacaaaaaatttacttttttccccaattattttattatggtaaaataaatcatcttaaatcatcttaacccttctttagtataaagttcattggtattgtgtacatttatattgtataaacatcagtatcatccatttccagaactcttcgtcttgcagaattgaaactgtatgtccattaaacaataactctccattctctcctccccctgtcccctggcgatcatcattccactttctgtctctacaattttggctattgtagatacatcataaaagtggaatcatagagtatttgccattttgtgactggcttatttcacttagcataatgtcctcaatgtctattcatggtgtagcatatgtcagaatctccttccttttaaaggctgaacaatattccattgtatgtatataccacattttgcttgtgccttcatttgttgatgggttgtttccacattttagttattgtgaataattctgctgtgaacatgggtgtacaaatgtctcttcaagactctactttcatttcttttgtttacttacctagaagtggaattgctggatcatatagtaattctgttttttaatcttttgaggaaccgtcatactgttttccgcagtggctgtaccattttacattcccacctgcagggcacacaagttccggtttctccacgtagcatacatcactttttaatacacttattttggtagggagaaacattagtcttgttatttacgcccctttatagtcacaatatgtttgcataattaggaattgagttttgactgttgtggaaacccaaggtatgtgttttgaacagttgagagtattattattcacactatgctgagtggtgagttagtgggtgtaagaaagatttggaccctgctgttggattcttaaaatataagaagtgcttttaggaagaaaatggctggataagtaaggtgatggaaatagatactttgctctttctgatacattattcttttgagcactttcttgtagagcagaagaatgtcaaaattttacctgctcaaattgcttctcttccacagt

SEQ ID NO: 12428 - DNA, 1029 bp, Homo sapiens
tgggtggcccaagacaattcttctcttccagtgtggtccagggaagccaaatgattggacacccctggcctaaacaaatacacgttttttcccctgtaatctcagctgtcatgtccacaggttgtctctaaattatgaaaaccaataaatagtgttgataccatgactgtgtaagtattatttaatgctaagccagataatgtgcttagatgattattccttttctgtccctgggctgccagaagaaacatgttgataatatagagaattagtagactttatttattttatcaattctgaccatcaaattaaaaaaaaatttggatatgaccaaaatctaactttggaattaaaaaagtttttgaataggacttcctgtttttcttagtgtcttaaattgccctcttttcttgtactatatgcctctattatagcctcccctacaccccagcccccccacaccccaactcttcagcatactgccttttgtgctgcattctctatttatctgtatttgtctgtaactctgcctccatttggactcttctaggtcttttcttgtaacttcctttctccttactcttgaattggatccattctgttatacatatttttttttccttttttttttttgcatctgcttgatctgtttattggagtacatcttcaaataactctttgaaaaagaagtatgtatgagaggcaaactttccgaattctgtgtaaaaaagtctccattctattctcacaaatgattgataatttggctgggtacaatattgttagttagaaataattttcctttagaaccctgaaaggattgctttgttgtcttctagcatctagggatgctgattagaagtcatacatcaacgcctgtaatcccagcactttgggaggccgaggcgggtggatcatgaggtcaagagtttgagaccagcctggccaacatagtgaaaccctgtctctactaaaaattagctgggcatggtggcaggtgcctgtaatcccagctacttaggagtctga

SEQ ID NO: 12429 - DNA, 1090 bp, Homo sapiens
ataaacgaaacaaactaaaaataaagcttgaggcttctggatgttatattctgatacatttctgaagcaactgtcatatccatggaggaatgtaaataatcctcgaatgtagctggccagtccagatgctgtctcatggcttttgggaagccacaggataaaccaggaatgtgagggagcctcagccttcaccatttgtaggccatgtgtctgtgccaccattgttctaaggaaaaaggcatctttggaacatgtgtaaagtctaactttttcccctgcagtggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagaggtgagttgggagaccgttggttaccttcagaaatgagttgcgacagttagtgccgcttgctgaacaggaacctggcagtctccagatttttagttgaaactaagcaaataaaatgggactctgattttctaatgtcaactagttcaaaatattgagttttggacctaacaaagttcttattaataattccagtgatttctacttctggctttatagcattccaagctgtatcaaggagtcgtgttctcaaaagcaagtgatttgtatttacttcaatttcacagcaccttggagaccggatgtcatgaaattaaatggtagagaaatgtgctgtgtgaatcatgagaggtgtttctcatgtgcaatgtaagcagccaatgaaaattcctaagtcactccttctatgtaaacatttttcatcaagaaatcacttttctctaacttaaaattttttacttaaaaatggaaattacttcttatttttgattctttgagagagtagtgttaaactttaaaggctttgttgccaacgtatcaaggtgctaaatttgtgaaagttcacttagtatttcatattcaggttaaataacttatttgtttagaattccccccacacacttttttttttcttttttgtcac

SEQ ID NO: 12430 - DNA, 1023 bp, Homo sapiens
tcttttttcttttttcagtcaccagttccagtgacccccaagagcatccaacgcacacatcgtgagacgtttttcaagacacccggcagccttggagaccctgtcctgaagagaagagaaaggaaccagtcacgaaacaccagctcggcccagaggagactagaaatccccagcggcggcgctgactaacctgccgctttgccaggtgggggtgggatcaaacgccctgagagtcccggatgtccgaggcgggatgcaaaccatcccgtcctgagcacgggtccttcctctctctttcatccacacttctgttaacttcccaccaccatcaatcatctgatttcctgaaagtaattaattgtgcatttaataccagttagagttccgactctgcatggtgtcacagtgaaagcgccgactgacttatggttttgattcaagaatcgtcttattctggaagtagatctgaataggctaccggagccttgtttttctaaaggggggcgctgtctagcacttaactagggtaagcattcttaacatgtatttccacttgccctgagtaaatctgtggtgagagaagcttcctttctgcagtttaaaaaagctactgcttccttaggcttcatcaggaagccaccttcagttgtgaatcctatggtgttatttattttgttcctgaaatgggatttagtgcaaaaagtttacaactacagtctttaacacatttttttcagggtatgacgacttgaatgtttatacttttattctataatttgccctgcacttattttacaacctagtaataatgtggataaatgtatctacatgacacatgtcaagaccaaaataactgtgaatgacacaccttgctgtaaatgaactgtgctaaccctgactgtgggcttgagaacaaagatgaactctagaactctagcagcctaactgctgcttctcaaataactgtgtgaacagtgagatattactgtttgtttctaaaaatcctactgtgcccagtttcct

SEQ ID NO: 12431 - DNA, 1025 bp, Homo sapiens
atgaattcctcctcagaatgttacggatgcatagaattaaatacatgggattacaaaggaagccaattatattgaatgcaactagaaaaatcatttttaaaattactgatagtaataaaaagacctggcagcaagcccaatagtgtcaaaatttccaagttgtgatgagcttaacagtatattaagaaatctgtaataggtttaatgtaatatgcacatatctgtactatttcctaatgacaaagtcaaggtactgttaaaattgttaatttgttgcctgtgataattgagggaaataaaaattttcagttaggaacttataaagatattttggccaggcacagtggctcatgcctgtaatctcagcactttgggaggctgaggtaggaagatcacttgagcccaggagtttgacaccagccgggcaacataggaagaacctgtttctacaaaaaataaaaaaaaattagctgggtgtggtggcatgcttgtggtcccagctactctgcagactgaaatgggacgactgcttgagcccaggagggtgaggctacagtaagccatgatcacaccactgcactccagcctgggtaacagagcaagactgggtctcaaaacaaaacaacaaaaaataagtaaataaataaaaataaagatgtaatctttcccatctaagctttttgccttctcagtttgggttcagtggaactcatgttaaaaacttcacaggcaccaactaaatgatcacacagataaatgtgggattacaatcttggccacagctgtgaaggagcagggtgtgggctgtttggcctggtcagctgggggaaggtctcatcattcattgatttattgtggactcccgtttgaaagggccatgacaaatgtgagcttgaatgatatcctcatgatgacatatattgattttcgcctgttctgcttttctttcaggattaaatggtttcaatgtacttttatctggcagtcaaaccccccctactgtgggcccgtcctcaggtcagctg

SEQ ID NO: 12432 - DNA, 1050 bp, Homo sapiens
attaagcttctttccacatgtttactggccaccatgttttttgctcctctgtgaaatgcctgtttgtgttctttgccaattttaattggtttttttttgtcatgttgatttgtaggggttgattatataatgatactaaacctttattatatatgttatgtatctattctttcagttcggtaattgtcttttccctttatgttatttcttgatggacaaaagttcttaagtttaatatagttcattttttccttttaagggtaatgttttttgtgtctgaagaagctcttccctattccaaggttagaaaaatattctccttcattttcttcatttaaaatttgctttacatgaaatccttgatccatttggaattgctttttgtgtatggtatgagtcaagatacaactttgcttttctatacatatcatcagttgtccctgcaccatttattcaggaggtctttctcttccccctagctggcagtgcaactgctttcatattaaaattccatttacatgtgtgtctgtttctgaactcctcctgttccattgtccatccctgccctaataccctattgtaataagcactgatatcaggtaaaatgggaccctcaacttatttttcttcagtgtgtgggctactctgggctgtttgttcttccatgtgtattttagattggattttattgagattgcatttaatctagagattaaaaattaacctctttaagatactgagttttcttatctatgaagacaatatatttcactaaattttaagtattctttaaaatctaagttttaggattttatgcaaatagatttttgctagatttatttctaaaatccttatcatttttgttgctttcgtaaatgatgtcttttcaatttatttgctgttactgttgtacaggaatgcagcagactttaaaaaacatattatcttgtattcaactaccttgctaaattctaaaactatttttaatgatttgtctgaaattcttttgagtttttttgtatgaatagtgacatcttctgcagaaggaaa

SEQ ID NO: 12433 - DNA, 1096 bp, Homo sapiens
agactaggagagttttaaattactgttaaccaggcattgtatttctttgcataattacacattgacatcacatattaaatggtacatttctcccaccttggagtattccaattactttaacatttttatgttattagataccatattaatgttgtcctggaaaccaaaattacactggtgttcatatgtcttctgtattataactcaaaatgaactttggactatattttcaccttatagtcgacattataacaattccttgcccatataactttcctacctactatattggtaactactacgtgaagatattgattctatgtgtaatttgtttttatatccctagagtctagcataaatctaggaaataataattgtttcataagttttgtttaataaataaatagatgacttcctgatcccataatagactgacgtattaggaggtaaagaacgctttttactcaaaagaaaagaaaatagttgtttaaaaagttacaagtaaggatttattatgaaagcaatgggattactgaattaggaaaaaagatttagtccatatactgagagtttggacttgactatcactctggagagaatacatacgttcatttatgtagaggattgcctcattttccaaccaaaccaattagttccaatatactataatatgcaccagatgggaaaattttatttttgatgtccatgggtgatgtcaatttgtatttaaaatgtagaaatatagaaacccatcattcctgctgagacaatttttgagctgatacttttggctagagcactatggcaactccatttttgtctgaacagccaggtttcctgttaaggatgttaggtgaaaatcagaacagcacaatttttgtgctgtttagaaaagcaaatcagagatttgtggttaaggaaaacagtttgagactcaaaccatctgattaaaaaagcatgatctaatcaaataaatatacatacatttaaagtgcctttcctgcagtttgttgacctggaatgaccaaggaatcatccaaacacaactgattttgaagatttgttttgccgtatattatgtatgtgtctttcaaca

SEQ ID NO: 12434 - DNA, 1025 bp, Homo sapiens
tatgtctgctaaaatattactgaaccctactttggcatggtccctctaaagtctgggttaattaggtatcctgcttaattgttgaagtacactctgcactatgcatgccccagattgggaagtgttcaacaatcatttgttgaactaatgaatacagtggagatccttttagatctattttcttctcaagattcagagtaaattaagagatatgagttactccttttaaatgtgttttaaatttacagggaacacttgaaattcacagatgaactttcaatgaaatagtgtagaatatacatcctctcaaatgcatttcatcttgttcccttgggcattgctcataaaatactctgtctacatatttcagagattccaaagtttccttttgagggtggtgggggctagaggggtgtatgaatctttatgagaatgtgatgactcttccaataaaactacatgtacattcaatatattgcctaggcttgcaggagatcaaaaacaacctaatagactcctaatccgtgattttgggttaagaattcttgctacatttttctctatttctgttccctactggttcacaagtatgttcaattttctccatactgagtcaaaatattaattccacattgcatcctatttaaccatatactcctctttctcctatttacaattaaattttcatagtaaatttttatgcatttacttccatatatagatatgtaatctttagtaatctaggttccccattccatcctactaaagtcatcacaaaagtcctggttgtcaaatcccatacctcgttctcaattccgaactcctctacattgttaatattgttgagcttcttttcactctttgtttcaaaattttggttccgtgtcaatgcacacacattttgttttttctagttttgtgttctacttcagtgtatttttctgcttactcttcctttatcatatctgtgtttaatttcccccaagtttttatcctcggcactttcctatttctataatcttcta

SEQ ID NO: 12435 - DNA, 1030 bp, Homo sapiens
ggaccgccaagactctatccttcctgtacaatatgaaaacgtcagccatcaggctcttttttgagtctcatattttgtgtgactctcatgctcatgtgcatataataaatttgtatgtgtttttaccctgttaatctgtctcttgtcagttggttttatagacacaaattattgaatcttcagaaggaagagggaggaaagttgcctttgtccctaacagttttggtgagcccaggcaggagaacaagtcactctgctcagtttagaggctgtaaatgggaccctgggacaactaacaaaaaagccagccaagaaaggtaagaatttttaccaaggtcagtattcccagatctctgcctttagagcccagttgagtaagagtggcaagagtcactccttgtctctttttccttcaaatttggagttgctggtgaaaacaggtctataaatgaagtcttttattgatttgaatcacttttgtaataaataaattggttatatgtagaaaaactctcatcttaactattgctatctatgaaaagatcaaattaaaaaaaagaagagacacacgtaaatataactgttacccttaaagactcctttggcaatattaaaataataaaaatcagttttagaacaaagttaaaatccttttaaatgagaaaagtttttggatctctgggctccaaagtttaaaacttcccttctctgaatccacctccatttttttcagtacatttctttagctcaggagataaatacttgtaagaattagtttataagaatttatttgaattatttgttttgaatttgtataactcttgacttttggggtactcgtttgataatgatcctcttccctctcatgaatggcttttgttttcctgtttgtcttaccaactgttgtcttttttaaacattttgtctactgagggcacacaggttattaggccctcatgtatgggtggcctaccaaaaggttgagagacccacaaatatggctggacagaaatatgggttgtaccccatt

SEQ ID NO: 12436 - DNA, 1014 bp, Homo sapiens
ggtttcaccgtgttagccaggatggtctcgatctcctgacctcgtgatccgcccgcctcggcctcccaaagtgctgggattacaggcgtgagccaccgcgcccggcctgaaatatgaatctctttattgacttctttcaaaggaatttcatatttttctacagtcttttatttctaattatacgagtgatgaagagtttgaagaaatgagagtttactcaagatgtgctaaagatttataatttgaagactcttataaatcttgccaggaaatatgataaacagaagacatctacttcaaaaagtgctgaaagcaatgacaagagcagaatattttcattaatctgtgtggttaaattcagcttttcttagttcccctttaccacagaagcagggcttttcacttttttgtatatatcaggctatcttgtattaggaacttaataaacactagtcaaattgaattacatctactatttgtatattattcaatacattgacaggttcttgatatttaaacaaatacaaggcttgagttctctatacaagatctgcccttaggacattaaagacaatacttgggctccagaattttattttttgaaagcatctaataagaaaatttcctgtctattagcacctctggtggctcagtacgcaagtgcagccgactcattgctcgttagctgtctctggcctgactttatacccacactaagaaatgggcatgggagcaggttatggggtgagggggtgattgtggttagcaagtcctgagtggggatagaacaaaagtgtaaaattgaaccctttattcagaggctttgcttctagaatcagagagaggctagcaatgttgaatagcagtctgcctttcttttgagatctatttgatgttactgaaagctttccctacattttatttaagattattcataagatgttagaggaaacctgacagacaaagaaaactttcacccttgattagtatatgaggctatctactcctgcagaa

SEQ ID NO: 12437 - DNA, 1026 bp, Homo sapiens
cacaggattactgcatgatgcttggaacccatttcttccctggctcttggcaattctgttcatgccttacacaacaagctactcaagcacattcaagggcattccccaagaaacaatatgctaattctgcatctcaaattgctgccagttaaacagggttctgatgcacttgggcagcaccctgaagaaagaaacccaagccaatgacatacactgtttaacctaatgaattatgcatctgaaggcaaggtgtccttatggccctatgacgtttcttagaaaatatgggctccataagacagaaaaaaattgtgggagcattagaagcaatgaatatcatacacaaggctcaaattaattatgacaagtggaatatgtctgaatatcagtttatatacattttagtagatatcatcttgtttttcatgtctaaataatcattgctaatctagatattttttatctttttcctaattattcaatgactcctctttgtctcattgtcagtgctagaacaacattagttttacttgtttggactatgaaattcaaaataatttaattataatatatttctcatgtttttcaaatatattaacctatataaccacaataatataaatggaagaaaacaaaatgaatagcttattttagttaaaccagcatgtctaatattatatatattatgtgcctaaataataagcttaagaaatggcagagatacaaatacgcattatttgtacatttccaaaggagtataattttgaagaaataaagaatacatagagtgtcacagtatattaaaatatacaattccttaggtttaattaggaaaaaaattaacagacaatattaatgtaccaatgtatagactgaatttaatcagataaagctggtagggtgaaggagacgagtatgaataaacatcatatggaagggcaaaataaatatttgttgctgaattaaaaacaatactgaactttgatatctcaaagaaaacagatggcatacatgcttgtttccaca

SEQ ID NO: 12438 - DNA, 1026 bp, Homo sapiens
atgcatccaaaatcaatacctctagttctatcttcttttctgagctagggccaatattccaactgcctgctggggatcccacatgtaagtcctacttatatttcaacctcagcatgtccaaagccaaacttgatgtcatagcccaacatgatcttctttttgcccttttggtcttaaagacattacctcatcagccatcttagacatcacttaaatgtctctccctcaccatctgcattcagtagcacaacaaagcctaatagttctattttctaaatatcttaaaacatgatcatttcttcccttcaatcacaaccgccatttattctcaacatctccattatatttccatgtaatactcagtaagtatttttgcaacactcaataagtatttttgcaattaatttatgttctcatttactcagtggctggaaccagtgatcaattctacttttgcctaagttattatacaatatttcatagattctgagatgcattccctgctacattttaactccgagaaattggaatgtatctaataacagacggtgtttaactggaagtatttttctttcttaggatttcttaaaattaatgtgctctacagtcgatggtgccttagatttgatgaaacatgctaatggttttctgtgtacagtaatctccctttctccatgggggttacgttccaatttccccagtggaggcctgaagccttagatagtactgaaccctagatatactatttttttcctacatatacatacctatgataaagtttaacgtataaattaggcacagtgagagagtaacaacaattaccataataagatagaacaattataataatatactgtaataaaagttacatgaacatggtctatctctctgtctctctctgtctcaaaatactgtaatattttcaatctgtggttgaccacaggtaactgaaaccttggaaagcaatccacagataaggggggactactcaaccttcccagccattctgtcttctgtttcctcttt

SEQ ID NO: 12439 - DNA, 1486 bp, Homo sapiens
attcttcctcttctatagttatttagtaggagcaagaatcatcttccttaaaaatatttctactcttgccacataaagaataaaatacctaggaatacagctaactagggaggtgaaagatctctacaaggagaactgcaaaccactgctcaaagaaatcagagatgacacaaacaaatggaaaaacattccatgctcatggagaggaagaatcaatatcatgaaaatggctatactatccaaagtaattcgtagattcaatgctattcctattaaactactcttgacattctttacagaactagagaaaactattttaaaattcatgtggaaccaaataaagaccccaaatagccaatgcaaccctaagcaaaagaacaaagctggaggcgtcacactacccaacttcaaactatattgtagggctacagtaatccaaacagcatggtattggtaccaaaagagacacatagaccaatggaacagaatagagaatccggaaataaaactgcacacctacaactctctgatcttcaacaaacctgacaaaaacaagcaatggggaaaggactccctattcaatcaatggtgctgggataattggctaggcatatgaaaaagattgaagctggacccctgccatatataaaatcaacataaaatagattaaagtcttaagtgtaaaacctcaaactataaaaactctggaagacaacctaggcaataccattcaggacataggtatgggcaaagatttcatgatgaagataccaaaagcaattgcaacaaatgtaaaaattgacaaataggacctaattaaactaaagagcttctgcacagcaaaagaaactatcaacagagtaaacagacaatctacagaatgggaggaagtttttgcaaactatgcatctaacaaaggtctaatatccagcatccataaggaacttaaacaaatgtacaaaaaaccccacaaacaatcccataaaaaagtgggcaaaggtcaagaacagacccttttcaaaagaagacatacatgtggccaaaaatcatataaaaaaagttcgacattactgatcattagagaaatgcaaatcaaaaccacagtgagatactacctaacaccagttagaatggctagtatcaaaaagtcaaaaaataatggatgctggcaaggttgtggagaaaaaggaatgattttacattgttggtgggagtgtaaattagttcagccattgtagaagacagtgtggcaatgcctcaaagacctaaagacagaactaccatttgacccagcaatcccattactgggtatatactcaaaggaatagaaatcattctattataaagactcatgcatgtgtatgttcattgcagccctattcacaatagcaaagatatggaatcaacctaaatgcccatcaatgatagactggctaaagaaaatgtggtacatatacaccacggaatactatgtagccataaaaaa

SEQ ID NO: 12440 - DNA, 1037 bp, Homo sapiens
cactttgggaggccgaggcgggcagatcacgaggtcaggagattgagaccatcctggctaacacggtgaaaccccatctcttaaaattacaaaaaattagccagtcgtggtggtgggcgcctgtagtcccagctactcgggaggctgaggcaggagaatggcgtgaactcgggaggcggagcttgcagtgagccgagattgcaccactgcactccagcctgggcgacaaagagagactccgtctcaaaaaaaaaaaaaaaaaaaaaaagttacaacaggagcaaagtctctcttttttctttttaatttatttttgatagaagagggagatgtaaaggcctagagatggaactgaggcggagcttgcagtgagccgagattgcaccactgcactccagcctgggcgacaaagagagactccgtctcaaaaaaaaaaaaaaaaaaaaaaagttacaacaggagcaaagtctctcttttttctttttaatttatttttgatagaagagggagatgtaaaggcctagagatggaactgaaatcttccatggatcaatttgacatagctttttttagtgactgtactcattgtatagaatattaattgaagtgatctctaacttttgtatagtaagatggtactagatgcttttggtagttatgaagagatatagcttagttgaagcaagccaatcggctctcagtgttttttatagaagttacagataaataatttggaatttcctttctccgttgctttgctgaaactcaactctgaactcttgctgtttctgagctgcaggcacttgacagaaaatctgagcttgcagctcacagccctcttttatcacactgtgttcaaacagtcattgttttgtcacacagtgaagcaaaactttaaaatccatctatacacagttcagactgaggtaaataggatgatggaaaatgttgcaacctaccagttagaaataatatatcaataaataaaaatatctaacatttattaagctatactattacctagacattattataag

SEQ ID NO: 12441 - DNA, 1049 bp, Homo sapiens
agccaagattgtgctactgcactccagcctgggctacaagagcgaaactctgtctcaaaaaaaaaaaaaaaaaaaaaaaaaaaaaagaaagaaatgcaaacgatttgtgagttggtcatgcatagttacatatttagtgaaagtacaattgaaaatagaataatctcagatgcataagattcttattaaaatcttaatcaaaatccagagattttggatctacttccaggagatcatggctgaggctaacacatatacatagatacgaatttttattttataattgactatttctctctctctcttttatgagatagggtcttgctctgttgttaggctggagagcagtggcgagatcatagctcattgcagccttgagctcctgggctcgcatgatcctactggtttcagccttctcaagtatttggattacaggtgtgagccaccgcacctggccttgttctcttttttaagtttttaattttccattactagctaccaatataatcctaaagggtagaattggacagatatcggctcagatcttcttcgtttttcagtttcttcttttgtaaaatgaggataatcagaccaaatctgtaaggtttttatgagtatgaaataatttatgcaaaaaaattagcatagtgtctggcatattaatttgttccattgctccattgttcaattgatccactggcatattagtttgttccagagatcagtggatcaatggaacagactaccagtggatcaatcaattgattgatcaattgatttatccacacatctctaatagcacttggcctcccagaattgtccagaatgtggaaattttttgtttccaactcaagtcacgtcccagaagctttttctgattatctgattttgttcagtttaggagctcatctccctggaaaactttgaagttttgtttgctctgttgatacaacttgggtaaaactgttgatattaatgatgtcctaacttctgtatttcattgagtcagccagactaaaattgtacacacacacacacacacacacaca

SEQ ID NO: 12442 - DNA, 1030 bp, Homo sapiens
tgtttgctatcaattttgcaaaaaacacatctgccagatagccaagatttagttcagagactgaaatcaattaatattctaatttgttacccgtcattagcatcacagtatgttatgccaagtcaaaagtgataacctttatatatcttatagtcctaaaggaatttgattttaaggatgtgttttatttttgtttagtattgcctcctgcatataaatcctattagaaatgtcaattatataggcaggaaaaattatgacggattaaaatgaaagtgtaaaatacatactattacacacttttaataaatggcatggcttttatttatgatgctgtgttttctaacattgatttaacataccactttaaataaatggcatggcttttatttatgatgcagtgttttctaacattgatttaccataccactttaaggttttagttaccttacttttttcttcctgttaaatcaaggagagtgctagcaacataatattttttaggggtggtactcagattctttgacattctgttatttcaggttgctggtcaaaggcaaatctccatggacaagcagattgtttatctggtctgatttccagtgcccaatagagggacacaggactaagacaatggtttgggaaggaaaaagatgagattacccaagagaagcaaaagaaaggagagtttcatagataatttttttccagctgattgctttcctactaatgaatagggaggaaaaaataaagtaatagctggctctgagtgagaaaggctaaaagatggaggagttgtgaccaaagaaacaattacattttcaacgtttatgacacagtcaagcattaaaatgatgctttcataagtgttggaaatttaaaatgtatgatttagtaagatgcttaaatttgtcagcatattaaggcctcaaagtctaagaggaatggctcaggatacaagttaaattggttgtcattaatccactcattcatcaaatatgtatttagtgcctcatatgtgctaggcatg

SEQ ID NO: 12443 - DNA, 1049 bp, Homo sapiens
tcaaagttctgcacgaatacatacataatgaagttttttttttcttttttcttttcttttttttttttttttgttgacggagtctcgctctgtgcccaggctggagtgcagtggcgccatctgggctcattgcagctccgcttcccgggttctcgccattctcctgcctcaaactcccgagtagctgggactacaggcgcccgctaacatgcctggctaatttttttttttttttttttttttgtagagacggggtttcaccgtgtgttagccaggatggtcaggatctcctcacctcgtgatccgcccgcctcggccttccaaagtgctgggattacaggcgtgagccaccgcgcccggcaataatgaagttcttatgaagtcaaagccaggttagaagttatttatttatgtttgagttttcaagcaaagaccaaagtgtcattttttaaagcatggcttgcttctacacagaggtatggcaatttcagagtcattccttcggccagaaaactcattgctcataccttatcttgtagccataatagctatcattccagtggaaaaaattttcaggaattgcatttacttgccaagacagctacctacttcatcagatgaagtttttgagtaacttttaaagttctcattccattattgccacatagaaaaagaaactaaagatagaaatctcagttaaaaaaaagccgttcaaaagtcaaactagaatcccagcttcactagctcaacatgtactaaactgagatgtgtggaaacttagcggggaaggttaatataaccatggagcactttagctttttttttttttttcttctttttttgagacagggtctctctctgtcgtccaggctggagtgcagtggcgtgatcctggctcactgcaacctctgcctcctgggttcaagcaattcttctgcctcagcctcctgagtagctgggactacaggcgccaccaccatgactggctaatttttgtatttttagtagagacagattttaccatgttggccaggctggtctcgaactcc

SEQ ID NO: 12444 - DNA, 1015 bp, Homo sapiens
tggacaagggtgataaaaagaaatcaaggcatccccttaattttccagaaaatcataataattgagataagagataaatgactatgattccagatagaattaacgataattgcctcagaggccattattgtctgaatgtgtcccccaaaattcatatgttgaaacttcatcaccagtgtggtaattttaaaagtcaaggtatttaagaagtgattaagtcatgagggctcctcccttgtgaatgggattaatgccttataaaagaggcttcacacagtatttgcccctttgctcttccacctgccaccgtgtgaggagacagtgttcaaggcaccatcttagaagcaaggaccaggcccctatccagacactgaacctgttggtaccttgatcttggactttccagcctccaaaactgtgagcaataaatgcatgttctttaaaaattatccagtcgcacatattttgttatagcggcaggaatggactaagacagaggcaaaagttaaaaaaaagtggaaatccagagaaagaagagaagaactggaatggacttatgaaaggggtatcatgaaaaatgtgtaaaattcacacatgcgaagctgatgggtgaaagagaggcaacgtgaataaaagagtagaggcgaaaataagtactacattgaaaaagagaacaatatcttttatgcacattgcctcgtcttttggaattgaccactaacatgtctactggtcttcagattctgttcttcattaagacttttgcataatttccataaaatattttaatcttatgattaaaatactagtaaaaatctttaataactccctattttttaaaataaaagaaatgctctgctttaaattgatattaaaagtactttatatttggatgctaaacatttatctcatactatggtgcaggggctgattttctgcaaccaaactgatctttccacgtatctcaattatgccctgctcaggccacatctatttgctcatgtggttccctttc

SEQ ID NO: 12445 - DNA, 1021 bp, Homo sapiens
tccttttgatatttccatgcgtaaattgctataatgatttctaaacaaggaggcaagaaaggtctctggctttcatgctattgtcaaaatattttttcttttttgaatatgctaattttcctcctttaaagaatgtcaggtacaatagaggttctccatcacctgcacaacccaatctctccgtctgttgagtcctagtttttttctaatatatttttattttaatcaatctaatcttactgtaccctttatccatctcattcatctcacttactattaaatcctgtcttttggatctaaaaataatcttctcaactctccattaatggaggattcacttaaaatatttttttcagaaatctcattggtttgcaccaatgttatgtgattagttcacctactttaatgtggggcatcctaaggaagatttaaatggactgtgccaactgggtcaaatgggcttagttctgtgtaagttaactttaaaatttgacttaattattcggactattcttcgctattttttctaaccaataagatctttattgaccttcattttctgaacacgtaattcaagatgttctttcttaagagaaatattttcagcagccaagatggctcttattactttcatactttgtgttccttcactgtgcatcttcctagattttcactatagcttcctgcggtttttgaaatactgctctggaagctgtttttcaactcttattttttttttgttttcttttataactgtgagccttttgagtatctatgtttgtgtgctgaaagcatctattgtattgtaaatgtcttccactgccattgttgtgtactctagaaggttgtttagtacacagcaggcactcattaaatgtttagagatccacggccaatgtgtaggtggttgctaaacaatctaccatgtattaagggaatatatgtttttacctttctcaattgcaggtgggatgctaataatcctggagttcttaataatttcccataaattgtttctctc

SEQ ID NO: 12446 - DNA, 1034 bp, Homo sapiens
tttccttagaaaaataatctaacgcttagatgtaaatggaagaattcctaatttcaacttttgaatagatttttattactggatggggattgtggagtagagaaaaatataatgaaatttaggagctgcaaggaagatctcaaccacctgagaaagttcaaacctgggaaaggcaggaccctcactgcttcctatcaaccaaagcacaagacagtcttagttcagaaagacagtgatactagaacacaacagaattttgtcctacagtttaactggctcagagttactgaagcactgggatttgctgtcactttctgggtattagggtggatttcaaaatacttgttactacagcaattttcattccataaatctgaatttcttgttaaagtagcattatgtcaaaataagactttgatgatatttgtggttctctgaggaagtaccttgtgcttctgcttctgaagttgtgtgtgcatgtgtttgtgtgtgtgtaaagttagctaccaataaaaatttcttctctgacagatttctgttgtataaagaccgtctgcattattaggggccacagaacaacaacagaatcttaaaaacaattttctttgaagttcaatgaaacagccttttgctctaattgcttatttacttcaactagcaaagacaagtcattcgtttagaatacaatactctccagtttcagagaaatcaagggaacctgactgaaattgatcaaaataaaataaaaccaagagaacaatcgcagctaaattataggttctacactgaattttttcataagagttctgtatttgactttattcaaggcctgaaaaataaggaacggtggaatcaaaacaaaagaaaatctttttgccaatcatactcagcaagttttgctctttctggctgtggatacttatagaaaaaataataggtattttaaagtagttctaaggtatatttgcactttgccccatatggctccacataatcaagtcccttctgaaaataaatatgagtttttttgtttc

SEQ ID NO: 12447 - DNA, 1032 bp, Homo sapiens
tgactagaattgtaatattagtggaaatttgcattttaatatgatttagtaaaatagtgaaatagctaaaggatttccttaggggattaaaagctatgaaacttaataaaagggatagctgtgttttttgtcttcattcagtattttgcttatatgtaaccatctaaatcaagagcctggtcactatacaaatattataatgtttttaaccttacaggatcactaaatccagccatttcctggaagaaatagaattattttaatatacttgtggcttcttaaatcaaaattttttgaaaaactacagtagacacataacatatttaggcaaatgtctttcaagcaatgtaagattttataattgaagttcatcttaatacttttaaatgaaagaatataaaacacaaaatatagtgggcagatatgggtaaatgttttcactaaggatgaaattattatttctgaaaagatgtatttattttaaattaagtattattaggcagaaagaaagaaaatagtagaactctggacataaaaaaaaaaaaaaaatcaccagaagaaggatcttaagaaagaacaacaaagaagtgaatggagtgtgctatctcctattgaaaaagcttagcactcaccccagaatgcgagctcactgacttgtaagtggtgactaattgcactgaacaatttctttaatcatgactctttgaagtcctatcacgcattggagacaaatggaatgaaaattaggaatgcattctggacattgcagagggggcagtaagcgaccatatgtttatgctaatataacttcagttctcacctgaaccctgtgctccaagctttgctccaggactttcttgaagcacacagtgctgtcttatgcctcggttttctcttttctatgtactctatcttttttgtgagctgcttttttgcctatttgttttgtagggaaatcaacagagggaagaatacagtgcagaactgtggaaagctatttggagctgttttgttcttttgcactttttctga

SEQ ID NO: 12448 - DNA, 1051 bp, Homo sapiens
agaggaggacggatgatttttagataagaggagaggcttaggtttacaggctgtttaaaataatagaacatatatacataaatatactaaaataaacattgagttttctattacagttgtctctctgataaaagttaatatattttcttatttggtatgccttacaccatgtgcttataaaaaataaggtgacatggaaacatttatgatttcagttagattggaagggaagtattcataatccaaatcacagctattgagattaatcagaagtaattagatttgtctgttgtaataaaaaaaaaagatactgggcactgaaatgataagaaaaagccaaataaacattactagaaccaatgattgctgaacaccagtcaggaatactttgataaagtaaaaacacttaaaaattaacctctcttcaaaattgagaaaatctactctctttgcttttcctctgcatttagtatcattgtgcagaatacttactatgcataatattctggcttatgactggatactagatgttaacctaaggacataaaactacaacttttgaaattgtgttttctaccaaagaaatacttatgtgacagttacagataaacccacacctaaagaagttttcttccagttctctaaatttattaaacaaggtaaagattacataaaaagtaaattattttatgtaaccaatgatatcattcataatacttcatttaaaagcatctatctccattgatttagttaaaatcctgtcatgcatgaacaagagagtgtatgtattcattgcgggaaagacagcattcataatgacccttcattttgaacctcataaattattctcccagttggacttgtgtggtgatagtcgctcagagagctacataaaagtctcttaaattgtacaagacaagacaaagatgatttgacaagttcacaaaaagaaaatagtgaaagcaaaggaacatcatttaatcaaagggagttaaagagctaggaacatgagattacaggaagaaatttgaaataatgcaacttgaaagta

SEQ ID NO: 12449 - DNA, 1193 bp, Homo sapiens
agtatttccagaatgtctttactgctactttaaattcactgcttaggtacagaaaaaccagattttaaataagattactgacaatacatgagggacctttgtcttgaaaactcagaaattttagagtgaatagaaagacacttcccctttacataattgaaaacaaggtttgagaaaatgactcatgccctcattttcaatttatttcatcccagaatgtttgccaacacaaggcatatgctaagcctggctgatggacgtggtgattttgaattagcctgctggcatattcacagatatttcatttttcagaaacatattgttctaagtaatgcattaaaaagtttttttcgcacgttaaagatatccaccaaaagaattgtttttaatgaatgatttcaagccaagatccacgaagatcctggagacctgcaggacatgttttcctgatgagatattatatggctggaatctctctgttgtttgtcaactgaggtgcctcaacaagatgaagaacatcagggcagaacctagagtaaaggaagaaggctagaaatgcaataaaaaatatgttcatattccttttattgattagttaagaagaatgactttgaagtgctcaaattgccctctacacacacaattttgttacaagagtcatgtctatttgtaccatttaagcattgggacacagcttacttaatcctgggattgtaacagatgtacttattttcacaaactttgaaattcagaaaaataatgatttcattcctttggctttatttcagggagggatctcactttttagatgtgactatgacatcctagtcatgttctagtccattccattctgaaatgactgaaccgaatcctactctgaacacgctgaaaggcaatatcgaatgttgactgtagtgaagataagaattttgcatattctgactggaattattgtgagtgcctgaacaagcattcatgtgcatgtctatgtatgtgtcaggatgagatcagtcttttaagtaaaacaacaaaggaaaggttataaataaatgttaacaaataccttgaaagtaaattgctcattgaagacaggattaagggtttttcggtggacttttgtctcaaatttcttcttcttatcaggtagcagaaacactttcacgtaaggatcagatgtgccccccatgtccaag

SEQ ID NO: 12450 - DNA, 1032 bp, Homo sapiens
gtatggatataccacattttgcttatccattcatcacttgatgaatattttggttgtttctacttttttggctgttatgaaaaatgctactactgttgttgtacattttttttggtgtgtatacatgagtttccatttttcttgggtagaacttagtagaattgttggatagcatggcaactttatttaacattttgaggaactgtcaaactggtttcaaaagtggctacatcattttaccttccattagcaacgtataagaattccaattttttcacatctttgccaacacttgctattgtctgtcttattttagcagagcctgaaactttgagttcctttgtggggtgtcagagcttagaggaattaattggtgcacaatcactgaggtcacaccatggtagcactatcttccactcacacgtgctgagccttaaactgggttcgtctttgtgcaatcttttcacatcccacagactctcgcacatggtatctaggctcagatatccacttttttattaaaaccatgtatgacaatgccttctgaacacttaggctgtcccactgtcctcaaaaaaggaaggatgtaaatctagtcatcagagcaatgcttttcggctggcaaggaaataagggctctgaccaatgtttttaataacaaaaaccgctaatttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttaaccaggatggtctcgatctcctgacctcgtgatccgcccgcctcggcctcccaaagtgctggaattacaggcgtgagccaccgcgcccggccccgctaatatttttttgagagcttctctggtgccaagtattgttctaagtgcttt

SEQ ID NO: 12451 - DNA, 1044 bp, Homo sapiens
agaaaacatgactgaagcctgtacagtaggtatcacaacacattcctgtatagactattacctggggtcctggtcattttagctttaaagaagtgtgatacatacacctacctatgaaccagcagttcaggagaaatgaaagcatatgtccacagaaagctgtacaacagctttattcctaacaatctcaaactggaagtaacccaaaagtccaccaataggaaaatggataaatcttgatatattcacataatagaataccacttagcaataaaaaggagtgaaatattactgtatgaagaatctcataaacatcatcttgagctgaagaagccagacacaaaataacatgattccatggtatatagttcaaaacaggcaaactaatctgtggtaagaaaaatcagaacagaagttacctctaggagcttgcactaagacacattggaaagaggtatgaggaacttctttggggataagaaatgttctgtagcttgattggtgttacactgtgtatagcgttgtcaagactcattgaactgtacacttaacatctgtgcattttattgcatgccaattttatttcaatttaaaaagtcacgatgttagtaggaaaaaggtctggaaaagagcaacttgggggaatctctgagaagctacagtatgaaaacaagctgcaaaaagattggttctcatgtttaaaactttgtttttacatcaggagaattaggcataaacttcttgtcttaagggagagtagactactagaaaatggctgtggaatcagaaaaactggcatttacatcttgagctctcattggctagcatatgtcctaggcctgggttcctcatctctaaaaagtgaaccttagtactgcccttatatcaatagaaatggtaataaggagtgtgattttggagacaagtgttctactttaaagagagactagaatattttcagcgaatatcccaaaacttttgaaacagccccaggaaagacatttccagcacacctgagggctgtttcacatggaaccccagtca

SEQ ID NO: 12452 - DNA, 1049 bp, Homo sapiens
taccagatggatctaagttacaatggcccactcagtgtgtgtgttcttgctggcagaggtgttaagaggagaaaagggaatgaaggcggggtcatgtgggtctattgactttttctgataactcgtggcagaacacttaatgtaagtctgttcttcaaccataatatactggactgaattctgaaagcacggtcatttgttacatcaaatgtgttatctccctgtgtgtgtgcatttgtatttttgtatattgaaaatggaaacaggccaggcgcggtggctcacgcctgtaatcccagcactttgggaggccgaggcaggcagatcacaaggtcaggagtttgagaccatcctgaacaacatggtgaaaccccgtttctactaaaaatacaaaaaattagccaggagtggtggcgtgcacctgtaatcccagatactcaggaggctgaggcaggagaatcgcttgaacacgggaggtggaggtggtagtgagctgagattgcgccactgcactccagcctgggtgacagaggaagactctatctcaaaaaaaaaaaaaaaaaaaagaaaatagaaacaaaaataccataatcttagcctcctaaaataattattctcatttcatggattcccaaattatttttatacatatgcaaatatttttaaaacccactacaaaagcatatatatataatttatatataattttatattttgctttttctatttaacatactaaaacatttttccatataagtatgcctaatggctatctaatattccatgaagtcatagtatcagtaaccattttattatcattgaaaattgagcctattttaatatgtaaaattatgttacagcatgttggcatccatgaatatgtgtatgtatagtatttcagatatgacagctaaaggctcagtttgttagtgtttctatttgccataattctttataatgtaagatttcacatctctggactgacgttttcggtgttaagtaaacttcattaaaataaaagatttataaaatgttgtacctattttttc

SEQ ID NO: 12453 - DNA, 1074 bp, Homo sapiens
atgagaacattaaagcacagggaggttagctgtcttcaagtttgcatggctcatgaatggcagaggcaatccgaacccaggtctgactacaaaaaccttcttattccatgaaccttatctgtagccatactaaatcagtgtaaaaggaggaaatcataggccttacctgaaatgggcaaacctttctctgttttccataaactgtaagtttcacagaaatgattttatataaatttttgaattactcaaagctggcatctataaatagatctgaatttggcatctaaaaggcaattgaaagcttaaaataaattctctatatattttgtgtatgaaattaagtgcttaacagtatttattctttattcagtatccaaattgtttgttttcccacatccaccaagaataagagtatctgcttcttttcttttcagccataacatagctttttcctacctaggaaggtgtgctaatcacattctgaaactgatttaaaaagtaacactgtaaataccaggaactctcattctctgagcttctggtaggctagccagagagttagcgctccttaaccatgagaagctggccaaaagccttgttaaaataagcagatggtttggcctccccctgcaacccccatgcttttcctgggaagatacttgaataggaatcggatattaacagcagagtatcccaaggttaccaggttttcttgtagtagagcaaactcaccaactaccaaagatttttggtagttggccaggaaaaggaaacaaaaaatctgatggctacttataacacagcccaactggcattaaaaagtcaagctttaaaaatccatgcttcaaggaagtattttggattaatatgattatgtcatggtatctcaaaggtagtgaaaaccttttaataagatattttctgctgtgttattccagggtataagtctttatgtatttatttttgtcccgttctttgtaggttatggaatattcacaaaaagcttttttttttgccagtcatggttttttccagcaacgtggctcttcttagctgtttccaaatgtctcagtt

SEQ ID NO: 12454 - DNA, 1045 bp, Homo sapiens
aagaggctaagctggcaaggaacccaaccaaaccacctcagctttatgtttttgttttgttttgttgtgtgtatgtgtgtttgtctatgtcttaaagtacttacaaaattctgagggcagagctacttcacagctgtcttatacttgcagactctaaggcttaattagagttaaaagaactagttgaggcctccaggctcaggtgatagaatgaaagcagattatagagtctctctctttctctttctctcagaactaaaaacaagggataccaacaatgaaaaccactagctccctcctttctagtaataagtcagcaatgaaataaggaaaagactgtaacctaataatatggacattaaaacaaaacaaagcatgcatgcacgtgtgcacacatgtgtgggcgcacagacacacacacatacaatgctggctcacaaaagaacagatcttggagtggtacagtgtagcttctaaccctgaactcccttcctgcccctggaaccttactggtgaattactgaactctcaagacctcactatagtcttcagatctggagagaaactaactaaatgactatccttatttttctcatttttgtctgaagggtagtggattggctattggacagaagtgggctgcttctttctgacagagcatgtatcggtaaagataccacattgcatataaactcattagaaaggggaatcgtctcatttgttcacacagcttacttccagcacctagattagaatgtgccttgcaaaggagaggggctcaataaaaatttgctgaatgattttaaaaaatcctagagtgttccccttcaggatggatatgtattctgattaaagagagggattaaaatgtagttcaaagtatctaacaaatcccagagagagagagagagagagcacgagcaaccaaaagtgcagagcccaggagttctaactcagatgtcacacagcttcagcagagctttcccttccctctctactccctgcaccatttccttaggctgcagttaagtggatggtatccaaa

SEQ ID NO: 12455 - DNA, 1102 bp, Homo sapiens
ctgggatgggactcaagaatttttttttttttttggttgggcacagtggcttacgcctgtaatcccaacactttgcgaggctgaggtgggaagatcacttgaagccaggagtttgaaaccagactgcacaaaaaagtgagactctgtctcataaataaatgagtaaataaaatgaaaaagaatttttacttttaggaaggcccaggtgatgttaatgctgctgggattatactttgagagtcagtaagatgaatgctggcctaggatgaatcattttgagttttgaataagtgaatgaatgaaaatgaattccctaaatcataaaatgagaaatcagatgaaatggcctctgaggtctttttgagtctatgctcctgtgattctaaactacagaataccccattcacatttttttcatataatgaaatctcagtgtttactaagattgctttcatcttttgttactgcattcattttacatgagaggctcatatcattccgtaagtgggaatctcaaggcaggtgtttggacttcagatgttttcttgagagagaaggacctcttaacacgggtcctccatgcttctgcactcaagaaaataaaaaaggaaaaaagaaaagcagcagtgaattccaatcttgcccatactgctttaaaaggttaaaagtgagaggatgagactttctaaaggaaaagtgtggttgactccctacctgaagctttggagagcatttacccaaactgttaacatttcagccttaagaaaatatttacccaattcataattgtccaaaacaatcagctggatatctggccaaaggagtcaaggcttcctggtgagctcaaactttcgtcacggatgaccgggcaggctgatttagccacagggggagggatatttgtcaacacttggagcagagctctccttactctaacaggcctgcatactgttagctgagtaaaggctggtctatggtcgggcgcggtggctcacgcctgtaatcccagcactttgggaggccgaggcgggcggatcacgaggtcaggagatcgagaccatcctggctaataaggtgaaacgccgtctctactaaaaataca

SEQ ID NO: 12456 - DNA, 1022 bp, Homo sapiens
aataagctactcctgtttactttttacaaacttgagaacagttttagatttataaagttattgtgaagatagtacagagggttctcatatgccaccacaccaagtttctcctactaacatcatacattaatactgtgcatttatcacagttaatcgtccaatatttatgcacgattattaaagtccatacttgattcagatttcctaaattttcccctaatgtcctttctcttttccagtgtccagtccaggatactacattatatttagtacctgtgtctccataaaattctcttggctgtgacagtttcttagattttccttgtttttgatgcccttgacagtttttagttctgggcaggtatttttcactttactatggatatttcagatacacagaaaagtacagaaaatcgctagcaatatcctgctaattttttgttatctgtcctgcttcctttttcttttttgttggggtgttttaaagttaaactccaattatcctttcacctgcagatacttcagtatatatctctaatagtaagaatttaaaagaataaccacaatgttatacctaacaaaattaatattaattatttaatatcatctgtttactttgggttccctaagaagcaggcatgcatgagatttattgggggaaaacacttgtgaagaaaattggagagggagctagaggaggttgagaaaagtgtcagaacttgatacaggtctgcctggtgaaggggagaggaggatagttggacaggaagtcttaatccatagttgttttagtccatttgtattgctataaaggaatacctgaggtaattgagaaagaagttcatttggctcatggtctgcaggttgtacaagaagtatggtgctaacatctgcttcaggtgagggcttcaggccgcttccactcacagtagaagaggaaggggagccaatgtgtcacatggcaagagaggatggaagagagtgggaaaagcaggccttaatgcccttttaaacaaccagct

SEQ ID NO: 12457 - DNA, 1001 bp, Homo sapiens
cctatgtaggtttaggttgagactctggattccacaatttttaaaggttaccatctgaggtttctgatcatagtctacttttgaagcagctgctgctgtttctttattccattgaacaccctggaattgacataattttatctatcagcatttctccccttttagtttatttaataattaacccggtctccagggcagttttcatatgaccatgtgtatattcactgctcacgaaaaagtttaatgttagattaccaaatttaatatagttacagaattactgcataagggcttcccttcttggagactcttacccagcatgggaacagtgatctgcccacatgacagggtggtatgccaggcatagttaactgcttttggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcacttaaaaaaattatatcagttattaggctgggtgcagtggctcatgcctgtaatcccagcactttgggaggccaaggcgggtggattaccagagttcgggagtttgagaccagcttgaccaacatggagaaaccccgtctctactaaaaatacaaaattagccaggtgtggtggcgcatgcctgtaatcctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaattattaatacttttaaagactgagctgtttaagaattttttggggaacatttctagcagtgatttttttggcctttaatgatagcg

SEQ ID NO: 12458 - DNA, 1066 bp, Homo sapiens
tctaagctttaacaacagtttcttcttggaattattatttcatagttttatttatttttatttatttatttagttttgagacagagtttcgctcttgttgcctaagctggagtacaatggctcagtatcggctcactgcaacctccacttcccaggttcaagtgtttcttctgcctcagccttccaagtaactgggattacaggcatgcaccaccaagcccggctaattctttttttgtatttttagtagagaaggggtttcaccatgttggtcaggctggtcttgaattcctaacctcaggtgatccacccgcctcggcttcctaaagtgctggaattacaggcgtgagccactgtgcccagcctattatttcataattttaaattaaaaagtttagacaatatgtaatctaatagttttgaagatagttgcccagaaaggcttcgtgagttccacaagagtttggattgaattgctagtagttggcagcagctaagggatatggatggttgattgctctgtaggaggtttagtaagaaagaagccaagttctgggcaaggccttttgagctctgcttcccttttgcccccaaggtggctgaccaagcccagtgccctggattctaaataagatgtctttgaaaaagatgttgcattgtttaaagaaaaaaaaaattaaaaatcagtaatctattttagttccttctttttatccattatcagttaactggcagagccagaagtaaaactgaggaccattgtttttctgtttagagtttctattgggccatctcctttaaactttgtatttttaagaaaaattaattttgaattatttcaaacaagatacccattaaaaaataaggtagttcataacttatagtggtgataagctaaataagttaaatcacaggccgggcacagtggctcacgcttgtaatcccagcactttggtaggctgaggcgggcagatcacttgaggtcaggagttcgagaccagcctgggcaacatggcaaagccccatctgtactaaaaatatgaaaattacccaggcatggtggcat

SEQ ID NO: 12459 - DNA, 1043 bp, Homo sapiens
aattttgggatgaactcttggtgtttttgcaagacaagaaaccagtttggtccccagcttttcaaatatgtgagttagctttttgtctgatggccttattctttattttttaagtgatcttagctttccatgcaaagaaggaatgtcagttggccgggcgcagtggctcatgcctgtaatccctgcactttgggaggccggggcaggtggatcacgaggtcaggagctcaaggccagcctggccaacatggtgaaaccctgtctctactaaaaatacaaaaattagccgggcatggtggcaggcgcctgtaatcccagctactcaggaggctgaggcaggaggatcgcttgaacccaggaggcggaggttgcagtgagccagaaggcttttcaatggcagataagatcaggtgacaaaaatgaaagttggatttttgaggagaaagttaccttagctggttataaagggttctacgatatagtaacaactatcagtaaagtagatggtgatcttggtattgcacatttgaaaaggttacaatcaaataccttacaaatttgataggacacttttattttctatcacaagaaaattcataggtaagaaattcatagatgaggaatcaatttttaaaacgagaagtcactttcgatttaactgtaaatttgctggataaattattggaaatggataccagtcagtgaaggattgaaaacaaattttgaaaagcaaattttctacatttttgacaaaagtttttaaaaatgaatgtccgagcttgttgaaattgcattaaaatcactgctatttctgtcctttgagactgttttctctgattgctattaaaacaaaacacagaaatagtttagatatacattatcccttgttgagtagcattgtcctcggtccaacctagattaacaaatgtagtaactggctttcaagatagcccccagtgaaccctacctcctgatgtttgcactgtgtataatcctctcacacaacataccaagttgatatgtgtgaacaatagaataaggtc

SEQ ID NO: 12460 - DNA, 1036 bp, Homo sapiens
ctgaggtcaggagtttgagaccagcctggtcaacatggggaaaccccatctctactaaaaatacaaaaattagccgggcgtggtggcgggcgcctgtaatcccagctacttgggaggcggaggcaggagaatcacttgactgcaggctgaggttgcagtgagccaaaatagtggcattgcactccagcctgggcaacaggagcgaaactctgtctccaaaaaaaaaaaaaaaaaaaaaaaaaatagcataatgatgccgtttatgtattgacaagtctaagatggaaggttttaaaaattgttaataagttaaacttttttgaaatattgttttaaacatgttcatcaagcaaatacacgattactaacggacatccatatttctggatggtttgtttgtagctgtcagcattatagtttctacctaaaaagtcatggatggatgcagaaagttggacttctttttttttgtgaaaaatgggtcctttaaaatgcttctaatggtcttctataatatggtatggctttagtgataccttcctctgttgattttctttttaccactttgctggtatttcccagtcttatttgtagttgtttctttcctgtatctcttcttcatgtattggtattactcaattttttttgtttttgtttctttttacagggtttcaccatgtcacccaggctgagtgcagtggcgtaatcgctcactgcagcctcaacctcttgggctcaagcaatcctcctaccacagcctcccaagtcccaagtgcttgggactccaggaacatgccaccatgcctgactaattttttatttttttaattttatagagacagagtctcattatgttgtccagactggtcttgaactcctggacctaagcagtcctcctgccttggccccccaaagtgctgagattacaggtgagagccactgtgctcagcctactcagctgttaatcttagactttattctcttttcgttttgtgtatttgtggtagaaatttcattcactccgatgacttcactt

SEQ ID NO: 12461 - DNA, 1056 bp, Homo sapiens
ctcacttatatgtggaatccaaaaaagtcaaactcatagaagtagagagtagaatggtgattaccagaggctaaggtagatggagaaaggagaaacattggccaatgggtgcaaagttacagttagataggaggaataatttctgttttattgcacagtaaggtgattatagttcataataatgtatatttcaaaatagctaagagtattttaaatgttcttaccagaaagaagtgataagggcctggtgcagtggctcatgcctgtaatcccagcactctgggaggccgaagtgggtggaccacttgatgccagaagttcaagactagcctggccaacatgacaaaaccccatctcttctaaaaatacaacaattagctgagcatggtggtgttcacctgtaatcccagctactcaggaggctgaggcacaaaaattacttgaaccttggaggcggatgttgcagtcagctgagatcacaccactgcattccagcctgggtgacagcgagactgtgtctcaaaaaaagaaacaaaaaaaaaaagaagtgatgagtatttgaggtaattctgtataggttgttctttgcattgctataaagagacacctgagattggataatttataagaaaaataggttaaattgtctcacacttctacaggctacacaagcatggcatcaacatgtgctcagcttcttatgaggccctcagggagctactcatggaggaaagcaaagcggaagcaggcacatcacatgataggagcaggagcgagagagagagcgggggcaggtcccatactcttaaccagatctcattggtgctaaaccattcatgagaaatccactcccatgatccagtcacctcccaacaggccccgccttcaacactggagattacatttcaacatgagatttggaggggacatccaaaatatatcagacatatatgctaattactctaatttgatccttccataatatatacatgtattgaaataaaaatatcactttgtgccttatacatatgtctaatcattatttgtcaattaaaa

SEQ ID NO: 12462 - DNA, 1035 bp, Homo sapiens
ttttatttatgtgattatgcatttcctagatactagttctttctgttcaaggccatttactccagcacccaagtggatttcttgattgcaaatttattactataggatgtatttgtgtagaattatttcttcctattgtactggccttattcacacttctgtgctttaatacaatgaaaaattgttttgacattgaagttctgtattgagtcccacaagatattattcccttaaagcacttgtatggtaacttgcaaattgaacatttgaaatatcaaaatgaaagcacgcagtataaaggtctgcctttgaaggataatggcatgcatgtggggtactgttaaaaagaagattaactacattagcagcaccttgattttagcacagggatcagcaaattagtggttgtaggccaagtccggcccactgcctgtctttgtaagtaccttttttttttttttttttttttaataacctttaagctctgttgaacttgagtaaggaaagttttactggaacacagccacacctgttcatatattgtctgtgaccgatagattttggtctacaacaacagagacctatggtccacaaagcctataatatttactatctgtttttacagagaaaacatttgccaactcctggtttagtagatcaaagatcctttgatgtattttagtaagttttgcccaatatactgagatgtttatatggaatatgaatcctcatgtacagtcctttggcaatatacagatgagtctgaaggtccaatatttgagcatgcacccattgggaataaaaaaccaaaaatttaataactagcagttttgttgataacaaggtacagtgtcaatgtagcgtgtagccttcctttgcagctcagcagatattgcaagaattctaacaaaatttgcttaaaatgtgtcataaaatgaaatgctttaaatatactttaattgtgaagtagccaatacattatagatctaacctcattgttttaaatggttgcacactacattatcttatggatat

SEQ ID NO: 12463 - DNA, 1073 bp, Homo sapiens
agcactttagggctggcaaggaaagcctctatatggagcaaggtatttagttgagatccaaactttggaaggagccagttaggtaaaaatcaggggaaggagctggggtaaaaatgttctaggtaggagaatcggaagagattgtggggagaaagaaaacaaaacaaaagttctaggtggagggaacagacattacagaggttttgaggcaggaaacttcaagtattcaacttaaagcaaaagttgggtaggtgagaagagataaagaccaggtcatggtagagtttggagtttaagtgcagttgggagctgcttgttggttgaagcagaggaagtacttgatctaatttttgtttcagaaagatcagtttaggttgtaggtaaagaatgggctctgtgtacgggaaggagagggcagaccactacagcaatacaggagagagtgaccaggtgggaggtaggggccatggagagacgggattgcgtatggaatatgttttagaggtagagctgacagcactttctgtgagaagcagagcaatcaaaatgataattaggttttcctttagagcaattgggtggatgctgatgccattaactaacaatacttttcactgctattcgtgcagtaaaatgatgtcatgcagaagtatagctttttaatatttttatttttagagatagggtcttgctatgttgcccacgctggctttgagctcctgggctcaagtgatcctcttgcctcagcctcccaagtaactaggactacaggtgcacaactgtgcctggctgtgtcctttttgtagaaattatgattgagcctctttataaataatcttaacattttgagtatatgctaggcattgttctaagttcattacatgtataagcttatttaattatcataaaaagttaaatgaactatttgtctttatatccctcgtatcgaggaaactaaacaattaacatggtaaacacatcaacaagctaaagaagaaaaatctcatattaatagatggagaaaaagtatttgacaagatccaatacccattcacagtaaaacttcttggtaa

SEQ ID NO: 12464 - DNA, 1029 bp, Homo sapiens
tttttagaacagctctagatgggtcactgctattattattattatttctattttacaggtgaggaaagcaaagcattgagaagttcagatttctgatttgagaaattagttgctaactttgcacttgcctccattcttgattttttttttttcctctgtttccaacttcataatgcgatcagggtcacttctttctcctgtgcttccagcttcacaatggggtcagtgtcaccttttaaatactagcctgagcaaaacaaatatattaagcttgctgttattattttttttctttccaacttttattttagattcagggggtacatttgcagatttgctgcatgggtaaatttcatgtcgtgggggtttggtgtacagataattttgttacccaggtaatcagcatagtacccataatatccttacccttctcccaccctccactgttaagtaggcccagtgactattgtttccttctttgcgtccatgtgtacttaatatttagctccgtcttataactgaaaacatgcagtatttggttttctgttcctgcattaatgtgcttaggataatggcctctagctccatctatattgctgcaaaggacatgaccttgttcttttttatggctgtgtaggattccatggtgtttatgtaccacattttctttatccaatcaactgttgatggggatctgggttgattacttatctttgctattgtgaatagtgctgcgatgaatatatgcatgcttgtgtcttcatggtagaatgatttattttatttttatttttatatttgagagacagagtcttgctttgtcacccaggttggggtgcagtggcgtgatcctagcttactgcaacctccaccttccaggctcaagtgatcctccccacctcagcctcccgagtagctgcgaacacaagtgcggcaccacgcccagctaaaattttttgtatttttagtagagacagggttttgccatgttgcccaggctggtcttgaactcctgagcccaagcgatcc

SEQ ID NO: 12465 - DNA, 1032 bp, Homo sapiens
tgttggattttaatgccatgccaaagaattcagactttattctgctgttcagtattgttgactgggtacttccttcctctgtccatatctgtttatgcaacaactctcacaggttttggaaagaaaacagttttgtctgcctaatttgaaatcattaaaaggattgtcttgttcggaggcagatattcaagagtagtaaacaacacaaaatactgtgaaaataacatatagtagaataaatcaaaatttccatatgcattaaaaagaaactagaggataggatctaaacaaagttgtaccaagtgatttcttttgatgacaaaaataattatataatgaataaatttgagtgtttgggggtagagggcagatggagtggaggtggggaactccagtgatactaaattgctagagtttgattctagtgtaatcatggagaagtttatagcttaacgttatccctgagtttgtactttgccctgcactttaatataaaaccagtttattgcattctgattctctagttcattctgtaatacagatggtaggaatacaggtgcttaaggatgggaattgcctttgaatttttctccatgtattacttgtttaacttctacaagtgttttctccctccatacttccctccttcctggtagtatcttcgaggaactcaagggcatctccaaaccatgttttaggaatagtattcagaaaatttgaaataaaatagcaaatctaggattgtgcaaaaatcagctatagaatattacttataaatttaacaaattttcttccatttttatttttatacattgggattatattctatgtacattcttataacctgcctttaaacttgacattgtcttattatttcattttaagctttttttaaaaggagaaatgttattacttttttttgttgtttcataaacacttttgtttcataatcattttcattggacagtgattctgactatccagtgatactagtactttatatttttggaatacaattatttgaagccaccc

SEQ ID NO: 12466 - DNA, 1063 bp, Homo sapiens
cctgcagtgagccgtgactgctcaactgcactacagcctgggtgacaaagtgagaccctggctcagaaaaactcaaacaaaacaaaactctagggggactaagagaataggataaataaacataataatatacagtttgaaatacagaactgaaacagatgaaattaacttaaaaagacatctttcagactaagcttatctatggtcatgtaagcaaactacttaatattttagaatttgcaggttacataaagtatcaattgattttctattattttggagttttttccagaatatttttagtagtatttaaaaagaatgtaaatctcagaacagagttaacattcagaagatggtgcttgaggaataggaataaaaagtacgattgtattagctgaaataatcaaagaagttacttttaggtttcaaattcttgaaagacttctccatatcctataatgtaagcaaaagttgatgcaaatcaaatttatgtaatcctaatttttttctgctagtagaagtaatgtgttaaaaaaaaggcagtgtgttcactgtagttctctcatggaaataaatccaaggaaaggtagaaaaacctgttatcttatacatattaatatttgtgtttctattcttatttttttgaatctacttgagaaatggaaccacactattgatttgtgtgtatacttaaccactcatcatgagtatttttatgatgttattctataacttcaaaaataggggtggatgtgtatgtatcttttgttgtatgttttttagagacagggatcttgcttgttccccaggctgcagtactatggtgtgatgactcagcctcaaactcctgggctcaagtgatcctcttgcctcagcctaccaagcagctgagagtacaggcatgagccaccatgtccagttggatgcatgtgttttgtgctgtttgatattaaaatacttaaccattacttcattgggaaaggaccttactgcttatctgccttattatgtggctttttgattagcccataaatagtcttagataaatagccctttcctttcc

SEQ ID NO: 12467 - DNA, 1057 bp, Homo sapiens
gaatggggtagatatagtgtaaacactgagactgtttagtgtaaaacctgggctattagcccagctttcctaaatgtttgagctcactggtaaagtaaattgaaattttaatattatcaggatttgtactgagttgtctgagctgggatgtcatttctcataaaaataataattacataattaaagtagatgacatttatggtgtgcttattaagtgccaggcactgttctaagcacttgacatacattagtgcatttaattctcaccacagccctatgggaaaatggggaagagaaggtatgttacttgcttcaggtcatacatgtagtgagaagtagattagagatagtttgcactcacagtcttgtgcgtaataaaccatcttactacacttcagtgtattacatactgtatacctagtttaagaaatacaaagaatattttagtgttaaattgttagtatatgactatggaatttaaaaatagccctatttatagaacatagatgaagtgagactttaatggaaaattttgagaacaaatgaatatataaacactggcattaaaattcttatttaaaatcattatcaagctagtggcctgtttatactattttctttgtttttttctttctttcttttttttttgaggtggagtcttgctctgttgcccaggctggagtacagtggcatgtggtgtgatctcagctcactgcagcctccacctcccgggttcaagcaattctcctgcgtcagtctcccaagtagctgggactgcaggtgtgcaccaccatgcctggctaatttttgtatttttagtagagatggtgtttcgccatgttggccaggctgctctcaaacttccagcctcaagtgatctacccgcctcagcctcccaaagtgcttggattacaggtgggagctaccgtaccaagcctatctatgctatttattatttctgcattttttttttagcacctatgatgtgtgccagaaaataattatgccatttaatagcaaggttgatataatgttttataagtataaaattattggc

SEQ ID NO: 12468 - DNA, 1657 bp, Homo sapiens
aaatgaccaatctctttatattcaaaagtagactttattttatctaatgtcgagtaagactcttattttcagacatgattcccaaccaagtctgtattagtagattaacatgtagttcatatgtagagatctggttttaatggtggataaacattaagttccttcaaggaagtacttatgaaacatctgtgtgatacatttattgtgactttcattacctcactttactagttatagagtgtatatataatactgttataaaggtatctgacagcagctaaagataccagaattgactagaagatagttataggcaaggaaccaggtcaaaaaccgaaactagctatttgggaggtaggaaactgggtggttactgcatgtgatggctgaagtcgatctatccagagcttctttaatgagataaaatttactaagagttttaagaaaaatatccttttttctaaatttttacattttctattttttggtagtaattcacctgaactgggtaatttggacgtggcatacttcttgccagtaatttttgtgtgtgtttatcagatcagtcaaatgtgtattacatacctgttaaagacactatccttaagcagtggagaaaataagaacacggcagtgtatattctcaaggagcaaggctataatctaggaagaaggataaggcataattacatgaaaaaatttaagtactgagttaacagtttaaaagccatcttaatgaagcatgtaactatttattggaaatagtgtgtgtttaaaagggggagatgattgggctgggagaagctattgaggatgagaatcttgacctgagtcttaaacttttcagtacttgtatatttttacatatgttctcacatatgtacatgtatacataattgtttgtatagtatattaagtaccgacatgcagtggttcttaacttgagcagcacattgatagcatgttaggatctttaaaaaaatgtttgctcatgctaattcaattccgtgccctctttgtcccttcaccccaccctgtaatattgaatgggtctgggatggatcccaggcattaatatttttataagttccccatttgattcaaatgtgagtcagtgataacaactgttggactgcagtctgggtatagaaatgaataggacataagccttgcccacgaggtgctctcaggtaatataaggaaatgtgaaaagtagagtagtaagtatagcttagtgcctgagcagggtacctaacccagggaggaggagtgatagttgaagaaagcttcctagacagttacatacttgtttccagggggtttgtgaagttactgccattgagtagggttgtgtgaatgggttaatggagatgggtgccatagaaaatgtaatctttgaataggtagaggtggcactgaagttttggtttaagtataaaagttaacatatacagtatttaaaacttctgttttaaaatagtggttggctaaagtggtttagctttagtggttggctaaagtgctttatgtactgaagttcacagcaatctcatgtggtagttacactgtttatcactatttccagaggagaaaatgaagacttagagcttaaatgattcaagatcacatagaaagtaactgatagagcaatatttta

SEQ ID NO: 12469 - DNA, 1032 bp, Homo sapiens
gcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagaggtgagccgggcgggggccgcagccggaccgggccggggcgggcagctgcctcccggtgtcttcctcctgggagctacccggggcgcagagtttacctcccctggctcgtacttgtcccttcaccgagttaggcaggcagggggtgatggagttttactctgaacaaatgcttcctgggaagttccccaaactcagagtaggacacgtgcttttcaggcttcctggccaggtctcagatccaggatccttttttaccgtggtagaaagacaacttatggctccaggacttgcccacctggacttggctgacttggccacctggacttggctgtttatgcttgatcagttagaaaaattgattaatggtgacgacattctctagggtctcacgtgcccatgtgaagttaccagtttatttctcctttcttaccaatgtttaataacatctgtaaagaaaatgttgccttagcaatatccaagacagctttatcttacagtgagctcaagatgagtatatccaaatgaatacgtgcactattttatatataaatcagctgtttataagttgtgctcctaaacacacagtgtttttctgagtgatacttaggacaatagggatgatttagtaacccacaattctgttcgctaagacgatctctttttgagtactgtgtctgaaaaacatgtggtagggtttttgtttgttttgggttgtttgcagtttggagcattttcgaaacgttacaggtagcagcatcttccattagagtgactggtaaaacatttttactaagtgtataatcacacctccc

SEQ ID NO: 12470 - DNA, 1033 bp, Homo sapiens
agaacataaaatgagagctctggttaccattctatttctaaacattcattgcactctttattattttaatacaaatcctgttttctctttgctttactcacgaacctgtgttttactccacttgaatattgtgatttaatacctattaaaagagaattactgtggtcacccctgaacttttttgcacttatctcttttataatttcttactttgttgcagagacaagaaagatttgctgatagatcactgttggaaatggaaaaaagggtaagtgtcccacttattaaataattatttttttctttcttgttttaggtaaacaatggtaggttttttgtttttattttgttattatggatgacagttttaattagtttaaatatttattgagttaatgtattttgcagcaacttctttatagaattctatggggtttctctaggtatgaaatgaccttgttaaataaaatttaatttaccacataattcttttaatgaatttaaaaaaactgtcttgccttgattctgaaatgtactatacacattttgatagtgaatttgatatttttgaaatgccgtttatctcttatggcctgtacctaaaacgttttaatcataaatacatttattttaattctttataaacctaaaatactttcgttcttgaaataaagtttctaaatctggaacatcaaattttcaaattctttttaaagttaatttaataattttttaaaattttgagtttaaatatttaacttaagtaggctattttaaacaaaaaaaagattacaagaaaatccttatgccacttgatgtctttctgcaagtttttattgattgtaatacattcacttgtatttctcttcacttattgttgctcaaaggtctaggagtagtcataggaataactgtacaagtttagcctcatcagttgaaaatgtataaatgatccaaaagttaaaggaaaagtgcccaaagattgtttgtagtgtagctgagcagtagctagacttggtagggtttcgaccag

SEQ ID NO: 12471 - DNA, 1034 bp, Homo sapiens
aaatgtatttgattaagtattcagaatcttctcttgtagccctgctttagacaaaagagaaccagtgaagacacttttaaaaaagtgtcatctagctcaacccttaatcctagcacttggggaggctgaggcaggagcatcacttgagtccaggagttgaagaccagcatggacaacatcaagactccatctctaccaaaaaaaaaaaaaatttcttaattatccaggcataactgtatgctcctctatttctagctgctggggaggctgagtcagaaggatcacttgagctcccaggagctcaaggttatagtgagctatggttgtgccactgcactcctcactggatacagtgagaccctgtgtctttaaaaaaaaaaaaaaaaagtgtcacctaattcaaaattatccatcttttcagagaacctccactatatccttgattttgatctccattccatttctcttatcattgttaaccacagccctgtaagaccagtaataaatttctgtctactgatgattctattgaattgaaatgcagagccaatggcatctttcagaaaaggtaacctgaatttcagaaccagataataagagaattctcctttaccagtaagatatgtttttcctgcttaggacaaacccattacttgtcactttggatatactttatttcatcaaatctaagacattactcattttaaaacaccattgtgttacctactactgaaaaaaaggaaaggtgctaccaattaaactataatgcatcatcaattgtaagccattttctggttttggaaatattaaaatgtgggaggaagtgtacaatttaaaatattaatcattatatgaaaccagttttggcttttaaacatggaaattttgactctcttcctcaattaatggaaattagtagtattaaaaaaataggctgggtgcagtggctcattcctgtagtctcccagcactttgggaggctgaggcatgtgaattgcttgagcccaggagttcaagaccagcctgggcaacat

SEQ ID NO: 12472 - DNA, 1008 bp, Homo sapiens
ttttaaagcctaaatcttacagtattagtcatgataatatcagtagtaatgtagaataaacagcagaaaataaagttttttcccaatttccagctatatattttctcatgttgatcattgagatgtttcagttctttaaacttctatgtgtgaggcctgcattgtgtttgtaaaaatgttgaaccaacatttaaaattagagatactcacttcaaacttcagatttttgccatttcttgaaaagttggctgacctggcaacactggatctgaattctcacataccaacaattggctggagctaagtagtagcagctgcctaccttccatccccctagatagtcccctggcccattttacccattgtttttacaattaccttgcaaaatattgtcaagatatattgctatattgtggttcattgcaatccttaacagagggagaaaaaagagaagaggagaaagaaggagaagataaatcacaacctaaatcaatcagagaacgacgacgaccaagagagaaaagaagatctacaggagtttcattttggacacaagatgtgagaacctattaaaatacattatttgatagtattcttgatagtattcttaatgtgtccaaaaatacatactaataatttcttatatgccttagatttcatattccttaaatcatcactgtgttttctgagttgttaaataagaaaaattatttttaaggatagttaactacttagattgttggtactacttaaaaggagtggttctgacctaattatggaatagaaataataatgtctgaagctcagagtgcatgtattgattattttataataggtaaactgcttcttgtaaaaacatcttttaagaatttctaaggagtctatttaatttcattttcataaatatcattataagatctacattacagattacttccatctcaaagcatgctaaatagacacagtgctttgcttatcaaattacaacagtcttgtaaaaattagtgt

SEQ ID NO: 12473 - DNA, 1098 bp, Homo sapiens
ttagactgcttaaaatgtaaatttctctctttgacaactctgggtgagctttttggttcataatttaaggatgtctcaccttgcgttttaaaaaaatccatccctgtagtcatgtgttttcagctgctagaaagtgctttcattgtttagctgttttccttttctcttttttgtgttgctgcttatgatgctatagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcaggtgtgtaaaggtcataacagtactgctgatatatcttgcccagtgatgaaagttgttttttgttttaaaaaagatcttgtgaggttgatggccatctctccagtagactaataaatgaaataccctgtcagctcagaactatgtaaatttatacaactagcaattatttatatttaggctttgcgactcacctctgacagaattaatgtttttttgtttaaagtcagtgagcaagacagttgttttcttaaacattttagtttctaaggtggtttatttcaaaaaaaattttttgatgaagaactgaaaacaccacacacttagggaaaattagatgcaacatgacaaaaacaggttttatcattcttctcattgtttcctcccattattaagaaatttgaaggatgttgaactgttttgttcctgttgatttggagaatttcttctcttggtaaggaaagacttctgtgcataagtgtaagccaaataattttgagtatgttgaatacattcatttaattttatctctgatacatagaaagcacttattcagattttttcaaagagtctgaatttattttgtgtgcttaaatatttttaaaagattgctcacttctttctgttgctgcctactggcatggaatcatagatgtacaaaggagcttactaactatcttttgggatttccttgctttaccgaaggaaactgagacccagagataata

SEQ ID NO: 12474 - DNA, 1023 bp, Homo sapiens
ggattattctttatagaatattattctgacagcagtgtacagatttgaagatgagaggcttattgagaaaaggtttattagaaagtcattgaagttgcccacaatgataagaatatgaactagagaagtgactctgggcttataaaggagaggagatttagagacttgacctctaatttatggatggaggaaaatgacagagaaggtctaacataattgtgaagtttgaaacataggagattgaagagatatacttagtgccattaacagaattagggaactgaagaagagatggtttggaagtaaaggtgttttattttagacatactgagtttcaagttttcagttatagttctagattgtccactctagaatagtgtggtagaattttacctagaatagacaggtaaaattaggactggaaatttaggagactggactggagaataacacatttgagaataagctgactacaattaatatttagcctgaggaagtaaagaccctcctcctaaccccccaggagaagaaagtagaaagagaatatgagagatccaagagcaggctctggaagggctagcacaaggaaagttgtacacacacacacacacaaacacacacagcctgtataaggaacgttacacacacacacacacacacacacacacacgcacacacagagtcagtcaagaaaaggaatggtcagagtaaaaagaaaaagaaggtgaagatagtgtccagtaaaaaaagccaaagaagagagtttaatggaggaggaggtatagttaagtatttcaggaagggtttatttatatatcaagtaaaattaaaaggtgcttttagacatataaagcagtacttaaatccaagttcatgttgggcagagtggaggtatatcagccattacagtgtaacaaatgcccatttcaaaattgatagatagtactgcctcgtttttctcaactctaaaataacagtaatagtagtatttcattgggtaattataaggttgaaacaggataa

SEQ ID NO: 12475 - DNA, 1033 bp, Homo sapiens
aatgataattgcatctaaagagaggaggatcctgtataaattatatgttgtgtacctacattttaactttgatctgtcacataaggtcaggtgtggaattttccacttgtggcatcatgttggtgctcaaaaatttttggatttgggagtatttttggggattcagattagtgatgctcaacctgtaatataaaaatgtaggtttctccttgattgttatttttggtagaattagttaaaaatgactttctgaggtaaacagcatggaaacaggaaattgtttttaaaaaggagtgagtttaatatatacacctatgtacctgtaaaaattgaaattaaaaaaatttttttttgaagtttgaaaggccaatatccatttaaaaaatctctttgaaaactggtaacttgtctatgaggtaaatgtttgttgaactgaatctcatttaattttaaaataaaaatatcactttttttcaatttgaggtgtcaaagatttcaagactctagcataaaattgctagaaaaattggaccaatttattgtggggattagatgaaatactgtatgtataaaataatatataaaacgcagtactaatgaaagggcttaagaagaaatgtcatattttcaggttaagcatcggtactgatattattagtaacacttgaggcttagaggaaatggtgttgtttgttagaaacacttactatagatttgatactgaaatctgctttggaattctacatctctcttaaaataattggagatatatgaagtagttgacactctttaagttgaaccaagctgttagggaataagatctcaaatctttaacaagacttatctggatctgctgacttttgtagtctcttctcttgttaatctgtattctagctacacttcccttcagacccttaaatatcctgagcccattcatatctccagctcttatattttccctttgcatagaacagtctttccatcccttatcctcaccttctcttaactcctattcgttctttaagttttgtaa

SEQ ID NO: 12476 - DNA, 1028 bp, Homo sapiens
atactaagcaggaaagtaatagctatagtaaaacatgaatagaattagtgaagaaaggtattttaataacatagcagctggaagaaagattaaccaagccatgcatgaattgattacaatataaagtgttaaaatagattttcagacacgaatttcactattttaggttttagaaatgtttttgtatttatatttgaatttacctttgtgtggttttggtattcttttccgagtgaacatgcttcagtgtgttttgaataattgaacaacagttcttttcccctcttggtctccactttacttctacaccacacacaccttcactgagaatagatcaccttttggcctttgtaagcaccagtcacctagtgctgttgcctttcagagttgaatatggagcaagtgaaatctgcagatgctttcacgtatattaagcagccaattgcttaataaaacattatattgtagggtgttataggttcaaagaaatagagagcaagtgaaaaatgtagagggaagaacttgtaccactggaatgagctactttatgctgtttatataagagtcttttcctcttcagagcttgttaaatgataataatattctgcagcaaggttttcgtcataaggatgaaatgagagggatatgtgaaagtacctagcacagcctttcccattatagggaaaagggaggtaatatttgagtaaccactccattcaaaatgttttgttaggtagtggggcacatacagaaagtgtctgcctttgagtttccagtctgttcggggatacagaatgaatggatctgaaatgactttagtcatttagaacatttttttctgtttaattaagcaccacatataagtgccatcattttattccggtcaagcagaattgggagaaaaaagggatacactcctttttttttttggagacagagtcttactctgtcacccaggctggagtgcagtggtatgatctcagctcaccacaacctccacctcccgggttcaagcgattctcctgctt

SEQ ID NO: 12477 - DNA, 1031 bp, Homo sapiens
tattattcatggtaaacaaatcacatcagtagcaaacacagggtgggaactcaatcttatgttatagcttactcttaagaagaatatgtgaagccaggaacatggttaaaggtacagaccagaaaatttctgacatgtgataaatatttcagtgacttttcagatttatttcttgttagccgctgtgtctatttggtgctacaaaaactgaaagaaacaaaatccctgatgtaagggcttataataaatacacagtttggagatgaactaaggatattttacatttacgggaaaggattggacaatagtatcattttctcaccatttgcatgtacatcatgtctttccaattgttttcattatttttctgaaagagctgcaaaattgtgcagtggttcaacctgaccaaagtggtattatgctgctgggaagtaaaagtattagacaccaaactggaagtattgttttcattatcaaatgactttaagttcttttaaagcatggatgtaaaagaatttttagatactgaagacacctcaatattgggatgctaagtttcttgggtttctccattcttgaccacacagtggtgtcattctattgagggcttagattctgtaaaggaaaagacaaattttttttttttttgctttctagtctcaaactcaacatagaacacttctgtgaccaaatgtaaaggtttccccacccccccaccccatcaattttccaagcaggtaccaaatggatgtcctataattcaattcaattctgaaactatttacttgaagatggtgtagattccacagattgagggctcagtctcacaacacttagcctacttaagatgccaattgcaagtagtaggttgtcacctgtcctttgactggctggagactgagattctcacaagcccttctttgggttcagctgggacagctcacaaaactgaggaaaacacctacttagtttactggtttattataaaatgaatcataaagggaatttttacccagttcaaattatatggt

SEQ ID NO: 12478 - DNA, 1053 bp, Homo sapiens
cataaaaattaccacaaatatagtagcttaaaataacacaaatttattgtttcctataatgctgtagaattcaatgctcttactatcaaaattccaatgtcatttttcacagaagtaggaaaaaaaaatcccaaaatttgcatggaaccacaaaagacatcaaatagccaaatcaactttgagcataaagaaccagactgaaggcctcacactacctgacctcagggtctattacaaagctatggtaatcaaaacaacatgctgttgacataaagacagacacatagaccaatggaacaagctagagaacccagaaataaatccacatatttacagttaattgatttttgacaaaggtatcaaaaacatgcaatggataaaggacaatctcttcaatcaatggtgttgggaaaactggatatccaaagcagaagaatgaaattggacccttatctcaccccataacaaaaccaacttaaaatgattggaaacttaactgtaagacttgaaactgtgaaactactagacgaaaatgaaagaaacgctccacaacattggtttgggcaaagatttattggataccttcccaaaatcacaggcaacaaaagtaaaaatagacatacaggattctacccaactaaacagcttcttcacagcaaaggaaacaacagattgaagaaataacccatggattagaagaaaatatttgcaaaccatacatctgataaaggactaatatccaaaatatgtatggaacttaaacaactcaatagcaagaaaacaaataacccaatcaaaaatggggaaatgacttaatagacatttctcaaaagaagcctaaggtatagctaacagatgcatgaaaaatgctcattgtcactaataatcagggtaatgcaaattaaaaccacagtgaggtttcacctcacacctgttagaatggctgttatcaaaaaaagacaaagccagatgtggtagcaagcacctgtagtcccggctacacaggaggaggagggtgaggcaggaggattgcctgagtccaggaatttgagt

SEQ ID NO: 12479 - DNA, 1035 bp, Homo sapiens
cttttcattttttttaacagtgtttttcaaagagtttcttttttttttaactattattttaggctatctttttggtttgtaggccctcatattaacaaatttgcactaatttctgatggacaaaattataagtttcagaattggaaggaacagaagaaaagagaccctaaagatagcatagttctatataacatttacttgagaaatatagcaatcaggaacttttttggctgaaagtagcagaaagtccagctgtagtggcttaaacaagaatgcttttcttcgttataacaaattcagagataggcaggtgttttgcatgcacttagaagttccatgtaatcagaactgacatctgtacacttccttggtccttctctctgaagttgaaggttgccactacagctgataatatccacacacaagacaagaagtagaagacagggaaaagacagcacttgcaccacgagagtaacgctttcccagcagcttctcacctgcttccgattgaattgtcattggacagaactgggtcatatggtcagacaatactgggagaaggggattgaaactggggattgtgtgagatgagtctgtctagtgtctgcctcagcagaaagttttaaataacatcaaaatacaaaaggcaataaacctctactataaaagtagaagagagaacaaccaaaatctagctttaaattcaaagttttttcaaacttgctgctggctaagcaactaaattctaaaggcacttttccaattgcatcttgtgtatatatatataatagtaataatagaaataatagcagctattagaataaaagcataataagaataatgggttatggtttgtgaagtcacatactttatcttctttgattgcctctttgaatataggcttttacataatagacaactaaggtacacagatagtaggttacttgaagtcatgtagaaaagagatccagaatgagaaactcacaataaaggcttgtcatcccttacctagctttctgtaccaattagggtttt

SEQ ID NO: 12480 - DNA, 1032 bp, Homo sapiens
gcagttacattaagtctctggaaaggaaagttgtagacagtgcaaaattagtagccactcaagatagaaaacctttacaactgagaaatagggtgaaaaaccagatacagacatccttctctaaatgtgagcacctgaacatatttgcggatcatgagcaagaggcagttctctcaaggttagttgatgaagagaagaatattcaaaagaaacttaatgcaaagatagcattttcagatgacatttccacaatcaaagatctactaaaggaggtggcagaaaagagtgtcatgtcagaaatgaaagtgctgctgggcatcaagagtatctgcaacaggcatgaacgcctgaaaacttcagctctctattcactcctgtgcagtttatccagttgctctgggttccagaatgatgtagtttatcctgttgttctgggttctgaagactttgattcctgccagcattactgagaggctgaagtggtccattcaccaccctgaattaactcttgagggctgtaaagactccctcttcaggaaaggaaagtgatctctatcagaacagacagatgctggacaacggagctacagaatggtaactctgttgcttgaagcactattttagtcatccttctgctaaaggaaaaggccagagtagttggcatctatctggactatgagtttggcaacattttgtgttgcaatttgaatgacttgtctcacatccattctttcattgatgtcaatttttctgaaatactaagctttatttcagtattgaacatgattctaaacttcttgcagtctgtgcggtaacagatgcaataattattattggcacacactggggtgccaaaactctaccaaaggggtaatataccaatatctatcaacactggaaatgcatatacttttgactcagtaatctacttcaatgaatttatcataaagagatgttctcacacttacaaaacacagatattcaaggttatttcttgctgtacagattgtaagaaaaaaaagcacctcatca

SEQ ID NO: 12481 - DNA, 1035 bp, Homo sapiens
cataccatgtgcattgagatcctaggagaagccccactctattaggaattagggaagtttccagagccttgcaactggcaagttttttctccttaagttaaatataccatatctttcttttaactttcctcgtatgtcatggtttccaatcctttaaaacatctggctagctttctctccatgatctccaaaattcatgagaaattcttcttggaagtatctgactctataattttatattttgtatgataggtttccatgcaacactgttagggtaagtcatgttcagttacccagttgttgagccagagttgagagcattcaagtgttgccttctcttaaactaaaaagaagactatttgcaaaaaaagaaaaaaaaaaaaaccattggcgtaatgtggttgagttatgcttttagtagttatatagacatttaaatctctgacaatacctatactatttttggacatctatttcttagaatcctcaaaaatacatgttattccatgaaatgattcccaacagtttttaaattaagtatatgtctattctgaggtctcctgaggtgtgataaaaagaagtcagagggtgccaatggccgtggttttctgcccacacttctgcagatctttgccaagcctctcctgtggtgctcagatggagtgcagtgccttctgcctgaagatgaatccgcccccagccaactaagcaatccaaccaggcagtttgagctggttagaagtgtgatagaacatgttcatgggtccacagaactccccacactacagaatcttctcaagtcagatagaaatgctatatgtttgtgtgaccagaaaacatatgcatcttaaactgtcaacatgagttcccacaaagcgttcacttgagctgcctagaattctgttcatttgtctcatgaactacaccacacaaccttttatgtatatgtatatatacacacataaatatatatatatatatatttatttatttatttattagatactttagtttaaagtgctacatgccaatgcc

SEQ ID NO: 12482 - DNA, 1051 bp, Homo sapiens
cttcagtgttgtcccaaatcccatgatcatttagtttttgataacaaatataaagttgggtattttcaatagcatactgagtaaatttttaaaatttgaacacatttaacttgaaccagttcttctttgggtttgccaattagtctgcatttgaggaacgcagcaagttgttggcagattaaagcagagatgagggtcagatgagtaggacacatcgattgtcatgtctcattagtaacttctaaattgacagtttcctttcatatcgcagtgatagaagtacaaagcattatttaccatttattttatgttgttggtacacatgcactgtcgttgtattagatttttaaactgaacattatttggtaaaatttttagacacctcaaaaaactagtaataagtcagtagccagtgttatttatttaccaggacatcactgttactatcgcttgtcgccttgattgcagtgttccaccaacactggttttgtctgaccttccacatgtaggcttactccctcactttagcatctctgccctttctgtcctcctgtctggatgctccttctttggatctttacatggctgacatttccagtctcagtccaaaggtcattttccagacctttcccagattggcttccatgacgatcttaatcaaaagaccactataggttattccagtgtctctatagcatcaatattatcccggaaacctagaaaagcacctttaaagtcacctgctctcctggcagctagcttgtatttggttgaaagccatagataaccaaatagtgaagcatatattttttctcacagacaagaatcatgggtttggacagttcagggctagtacaacagctcagtgaggacattaggcctgtgtcctttccttcttcctactccaccatccttagcacatggcagttatcttcgtgatcacaaaatgggagttttacctccaaggcacttcaaggcattatatctgtcaaaagaaaggggaaagaggaagggtgcaaagatgaaaatgttgaaggcttatgccagcagt

SEQ ID NO: 12483 - DNA, 1049 bp, Homo sapiens
gcacccaccaccacgcctggctaattttttgtatttttggtagagacggggtttcaccgtgttagtcaggatggtctcgatctcctgacctcatgatccacccgcctcggcctcccaaagtgctgggactacaggcgtgagccaccacgccgggccgcctctacctttcttaatgttccacctgtgttatgttcaagagacaaacttattcatcaatgaatagaacggcacatatctgaaaagggttaaatgctgttcttccctggagagcttttacatatagagagccaagaataatccttggttttggttgaatgtgtgttgttcccattgtttcctgtactactggttgatttctaaagctttaaaaacctgaattactcagataatggcttcaaattttaaatccttttctttgagctaaaattagagtatttatctattcctaacagaaatttgacttcaaagtaaaaaagtaaaataaaatatgcataatatttacattggtgtagactactgcatttgtaacatggtgagctcattaaaacactttggactgagaagaaggtattgcttttaaatttaaagcagtgttattttttatcaataaaatgactgcaatgagatacaattatccaggaaactattaaacatattactagttggctatataaatattttgtatgccagtacaaattcttgtactttgtaatattactttattaactagtaaggtttatattatttttaatataattttaagttacagttgccattgccaaaatgacttggtgatgtattatttgcttcagttaggatgttttacaatattgaggaattaagaaaagctctagtaaggtgttcttaaaaatgcaaggcaggttttgtttagagtactcgtcaaccatgttggccaaatgaatattgtaagctctttttgaaaataacaaatattatagacattgagttttaaaacacagttttcatgtcatcatataaattgtcttctgttttctaatgatttttaatttttcagaggaaaataattt

SEQ ID NO: 12484 - DNA, 1072 bp, Homo sapiens
atattttatttaacctgatatagaaacaataatctcattttaacacatgatcacttaaaatttatgaattacatgtatttttctaccacgttttcaaaacctggtgtgtattttacacttacaatacatcatctgaattaggcacatttcaagagcttaatagtcacatgtagggagtgaataaaatattggtatagataaatagatatttctgaagttcacatagccatatgagcccactgatgcctagacaagaatgagacagactctcactggatttagataatcatccatagagtaaaataattagtaagctggtttggctaaggtcacccttaccagctagtttatcaagtatgtggaaagataaacattagatgagtgaagcagctaggtcaattctgtgaaaaaatgtcctccctcagaagtgttttaattgggctgaaaatatgcacttgctgggacttttctcctggttaagcgcactggcctgaatgtgttgcttaaaaatagctttacttacaatggccttacgtcccatttgtacttggcatttttgagtaggatgtagttccagttatctatcaaatgctttgaaaaaagatactagattttgcaatactccgagtatttctaagttcttcatgctttttattttatagttatgagaaaataaaatgtctagatttaactcacaaaatattcctagatttttctttgcttttatttcaagttttattatttaaaaatgtgatttttttctattaaaattttgggtatatgaataaatttaaatcataatttaaatgttcttatattgctcagaagaataaaagcctgattcatctagccacctggtggttgaaaatctttccttgtttattgaatatgtctgcctcatcaatctctatgtccctatatggaccattcaagaattttataacttttaagtgactcattcattttcatttacatttcaagaaaacatttttattattatttgaagactatgaataataatttattgatatacagtaaggcaaatatacagatgagagaaataaaatgaaaa

SEQ ID NO: 12485 - DNA, 1053 bp, Homo sapiens
gtcatgtcatttgcatacagattatttacttcttcctttccaattgtttgctttttattttctttccctgtctaattgctatggctaggacttcagtactatgtcaaaaagaagtagtaaaagtgggcatccttttcttgtgctggatcttagaaggaaagctttcagtttttctccacggattaagatgttagctatgtacttttcccgcatgatctttattgtgctgaggtaattttcttctataccaattttgttgagaatatttttcataaatagatgttgaactttttcatttgccttttctgtatctgttgagataattctgtttctaaaaaattttgctgatgtgttgtatcatattgattgatttgtgtatgttaaactatccttgcattccagagataaatctctcttggtcatgatatgtgatctatttaatgttctgttgcattgggtttgctagtattatattgaggatttttgcatgtttgttcatcagaaatattggcctgtaattttattctcttgtagtatctctgattttggaattaggggatcctgaccttttaagtgttactgcttcttctattttttggaagagcttaagatgagttggtatcaattcctctttcagtgtttggtagaattcatctgtgaaggcattggttcatggacatatttgggttggtttattactgattcaatccccttatttgttatttttctgttcggattatctatttctttttgattcagtattggcagattgtatgtttattggaatttacccattccttcttggctctgcagtttgctgggttataattgttcatagtagtctcttatgatcctttatattttttaggcattcgttgtaatgtctcctctttcatgtctgattttattaaatttattaattttgggaaccaggggcagaaagctatggcttgaatacatctcccaaaagttcataggtttgaaacttaatcccagtgcaacagttttgggaggtagagcctaatgagtggtgatatgatttggctgtgtccc

SEQ ID NO: 12486 - DNA, 1025 bp, Homo sapiens
gttttatttggtaggattaagttcaatcacatatgttaaaaatcacaaaatggcattgactgaaagaagttttgtttcccacataaagactgctggatacaggaagttcaagttcagttgcaagtgaggctggtgcagccatgtgtctggactgcttttcagtcttcccttcctcactccatctggctaacatctctttatccttcaaatctcagatccaaagtcattttctcaagacatctatgataggtactgctacctgcctccaaatatccattcttttcttctgctttattgaaggacaccccattcttaatcaggcacatttcacatgaccacaccagcttcccttcaattgtaagggaacttaaaactgaagggaagctggtgtggtcacgtgaaatgggatggctatggttggctgtatgactaagtgttcacctgctaatgtaagggaacaggttgcataaagctttccttctacttgctaactggaatgcaaacctgattgctggggctcaaccagccatctttgtttataaagtggaagcacatgcttaaaatggcagaaacaaaagagaaggagtatggacctttgtcaacttgcagcttctgtgcatgaccttggaacacctatattcagtagtcttttttataaaagagtagtaaacttctttctcatttctgtcactcttatttcgtgatacttacatatgcaactgaatctcatcatagctaatataacagcctttcctgaccaaatagatatgatcatgttcctctgttttataggtttataaccccatattttttctttcatacaggttatctcagtatataattatacatttatatatattgttttttctctttttgaatggaactttccagagagcagagcccatatatctttctgttcacctttatatcaccgatgtctatcatagtgctgatgacaaaataaatgtttcataaatacctgttaaatatggtgtgatcacattgccaatatttataatctaaga

SEQ ID NO: 12487 - DNA, 1618 bp, Homo sapiens
gaatactccatcagctaagagccttgttctgagaacaggctagtttctgttttagcatgttttactggaaaaagcaatggccaatttgttttaataaatcttaaacatcctatatttatttttaaatattcttctaggttatttgcatgacaagaaggaaaatatgtattttctctgatctttactgtatttattgatagaaggcagagaatgctgaagaaattgaaaagggtgaggttaagagctagcacataaaccttgtagtgactaatgcttcattttcttagaaaaaaaaaaggaaaagagaagatgggtaaagagacgtaataaaacttgatagaaagcattttgaaacaatttacatcaaatggctttatcctaatcactgtaccaaaagtaaatggcacaggaatgacgttgcatgcttcaggagagtgggaaatattggaaataatgtctttttgggggataatagatgttagcagcaatgagagtcaaggtgcaattggaagcatagatgtgtagctgtcttttaagtagatttctgtgattatctttctaaacagaattgaaatggaaatacgtattggcagatgccacgaaatattaaggaggcaaggaattcaaggtttcaatgagtaatgttgaactgactgaatatgggttattctttaggtaatgaacataggaagtgatatttttattgaaaatatatttcacttctcaaaaaaatagaaaaactccccggaaaattgtactttgcttaatgttattatagtaccatgttacagacataaattccaagaaaatgtattttattcaatgatgattcccaggacatttcatcatatgtgacactccaaaaatatatgtgaagtgaatagatgttatttggtaatacaaatttgaagatttttttttaccttgtaaaatattgtaactgaaataaagttaatatattttgcactattaagtaatccccaaatttaacttttacatatatctaataagaaagaataagtagcagtatgaaacatgcattgaaggacgtgtgagcacatcaaccattgtagataatgatgagagggacagtcatagtgttttttataagctaaacgaaaggtaggagaatttgtgcttttgtagagaagggtcaaatacactcacaggcctagaaaattagccttatttttaatattgcgttaatctaattttattaatatagccagttagtatattacattttcaaaaaatatagagaaatatttaatatgaaatgctgccaatataatttactaagtgaaaaatagatcttaagaagaaaggatgaagaaaatcacaggcattatgtagtctgaggaaaagaacatggaagagaaactcaattccatctattcaaaagcaagactctttgatttgaatacattattattgttcaccatgtctggtgagaaacctgtgggaatacataaaagtgaatgtaaacaagatgtttcaattggatataaatatgaatcaataagtattggagtaaaataatcattaaaaatggaatcttagtcaaatctcgatattggggattttctagatgaggcggactacaaaatgcaaggagcag

SEQ ID NO: 12488 - DNA, 1046 bp, Homo sapiens
gatcttgaaatcaacctggatttaggttgggccctaaatctaatgactggtgcaggagaatgccatctgaaatggagacagagattggagtgatacctctacaatctatggaatgccaaggattgctaacaaccaccagaatctgggagggaggcatggaagagatcctcttttggagcttttagaaggaaacaaatctactgacaacttggttttggatgtctgggatccatttgtggtaatttgctacagcaccactaagatactaagacaaggaacaaaggatctaactgtgacagaaatgtagtgagctaaaggcaaagtggcataaaatggtattggagtgagaggcaacagctaatcatgctaggtcctgtaggagtctggattttattccaagtactatggaaaatgatggaagtggaagtactatggaattacatgacaagatttatgttttaaaaatattatgctggttgctcttaaaattaagtgaaatagaacaaggactgaaccaaaaagaatctggtaaagggctaggctaatacaggagttcaggtaagtggtgggagtttggtttagggtcatagcagtagggaagtgaattgggttgagatatattatgaagttagaattggggacttgctgatgggttggattcgtatattgaggaaaattaaagatggctcctaagtctggggaactactggatagatgctcatgacatttaccaaaacagagaacataagaaagatttgggtggggttgggagtgggaagaaaagggcaatgttctttagtttggcgtaggtgaattcttcatatggattgagatgtaaatttcagggataacagtatgtaaataatatataatgatatgggaatagtgagaccatctacaaagagcaagtagaaagatgggaggaaagaaatctaagaccaaaccaacaatgaagcaaattagaggaaaaatgtgcagtaaaggacactaaataactagctgtcaggaagaaaatgtatgaatcttatattacagaaggaaagacg

SEQ ID NO: 12489 - DNA, 1026 bp, Homo sapiens
tccctttcccctctctgggtctccagaagattggcggcagcattaaccttcccaggggagctatgtctctgtgttaaggagcactcatctggaaggaaaataacttgttctagcttttcttctgtaactagacagtcttttcaagtgcttacagtcagggaaacattaatcagcaaaacgtgaaatttatgcatttttttcacttaacattaattataaccactacaggcactttaaaaatggatctgattgtatattcataataaattaaagttgagattctgcagaattattacttacaattaaaatctatgttgattccagaataccacataataggaatatgccctaaagattttatgatcggctattaaattatttttcaaagaggtattttaatctattaaagtacatttagaagatttataagtattataggaagaggagttaaaattatatatatttaatatttaatattttaccaaaagagttcaccaaagttctctgaaagtaactaaatcatttatataataaattctctggatattcttatattttactcatagacataatttatattttgattgaagcatggtgagaacttttatagaaaatcctatttttaaaaatttttctttcctttatcacagattacaatggctaatctacatgaatgactatttttcttctattgacaactccttctgcaaaattatttttatttattttcttgagttatagatttagggggtacaaatgcagctttgttacatggacatattgtgcatggcgaagtctggagaaatcttccgcatacacctattcagaaacactagatttcacctaatttaaatcaccattctctaacaggtcaagaatttaaataaaaactgattacaaccaacatcatcattctaacttttaaacaaaagcatgtaagaaattgcattaaatataagtagaaaaatggtcaattcaagataaaattcaagaatgtttttgaaaccatgtatttacaaaaaaatt

SEQ ID NO: 12490 - DNA, 1052 bp, Homo sapiens
atggaatgaatctaagtgcccatcaatagatgactgggtaaacaaaaatgtggtatatatacatatcatgggatactgcttagtcataaaaaaaggatgaaatcatgtcttttgcagcaacaaggatagaactggaggccattgtcttaaattaggtgaaataactcaaaaaagaaagtcgaatgttctcaattataattgggagctaaataatgcatacatgtggacataagagagtgaaataataaacactggagactcagaaaggtgagagagtgggagggggttgagggatgaaaagttacctaatgggtacaatgtgcattatttgggttgtggttacactaaaagcacagacttcaccatgaaacaatgtattcatgtaagaaaactgcatttgtaccccctaaatttataaaaatgataaataaataaatagaaggctcaaaattacataagcaatttaataacatcttgtcattgcttataattatagagcttttacattatcagtcaggcataacacaatgttatttggaaactttatgtagaacgattaacaatcactattaacaatgtcaaatatggccttttaaaagaagatatcctataaatcctctaacattgtttcttaagattattcacatttagagatagagcattgtaaccaagccaaaagatgattgggaatattctcttatgaaacagtcacctttccctgtttcacttttcttatatttgtagatagcttgattatttgaaatgagtgaagtaataatattttgaaatatcccaaaatgtacttcaatctcaaacattttagctgataatttagataaaattaacagataataccatttacaatttattttatttacagtcatgaaggaaaaatgtatcttaattttaccctctgatttatgctttcagatataaagcaacttaaaggggaattatcccattataatatgcagagttttctcagtgagcttgctttgtagacagaaattctagagtgtctttatattctctaatttgcattacaatagttg

SEQ ID NO: 12491 - DNA, 1055 bp, Homo sapiens
gctgaggaaatgaatggaattccaagtagttggattagccttgacaaaaaggacatcttcagagaggtgagaagtagttaaagatagaacagttcaaaatggtatctagatccaaggtatggtgattcatgactaggtaggtaaaatggaatagagaggaggggctcagaaaacttcgagattaaagttcatatatacacataattttcttaacatccttaaacaacaagtttaattcttttttcagtctggcatttctatcattcatatactggtttcattacttttaaaagtttttttttttaacattttaggatttttcatagctttctatattttttcctagttgaaatatttctctaagaatccccatttgtgccttttatttaatatatactcttaaaagctacaactgtgtttttaatacctttttggacattttactaataaagtcctgtttcctcatcccccaattaaaagctcctttacaattccaaagaaaaataaaaagaaaacatcaaatcaaaaagcacaagaagaatatgaacagatacaagccaaacgtgctgctaagaaacaagtaagttctactttgaaaatatttagtatagtttttcttatttatcctaaatatatatactatacctgttgtgcttcttggtgctgggcacacagtattctctctgtaaatatttgttgaatgaatgagtagtctgagcaaaggtagaggattgcatcttattccaagtccttgcttgtattatgtcaagcaatactagtaggtcaaaaataggattttgaacacattgtttataggtcaatattgtgaacatctgggacaaagtttcactgagtttggtccaggaacttgcacttgttaacaagcacctcaaaagatttttatgtatgataaaacttgagaaccactgacctaagaaaaatatagatgattttcataacattacattgaagaaagtaaaagcaaaggggaggtgttagaataaaatacttttttactataaagaggtgttcttgcctgtttaaaaaaaaaaaac

SEQ ID NO: 12492 - DNA, 1066 bp, Homo sapiens
ttacataaccttcctaagaatcagttaatagtggcaacaacttcgtgggttgttgtgagtactaaatgagttaaaccatataaaatgcttaccggtgtgtatgccgctatagctcatctatgttatcggttactgagcatttttagagtgtggtaggcaccgtggtaagtggtacacttcttattattctgatctttctgaagaagctgaaactcagagaggacacgccatttgccattgtttgcactattttaaaattactaaatggcagaatcagaatctgaaactctctgtagaattcgtgttcttagtcatgtttgacattgctctcaataaaggcaatttgattgtaatggcaaaaagagataaaatgccaatttaaacgctattattactgaaatcaaaaggaactgtttattaagatctgggccacacttggctgatctgaattgtttcatttaagttttgattatatacagtgataattatctaagacataaagcacaactacatgaaatatctgttcaatatttaatatctgttcaatgtcagaactttggatctgaaagagtatcttatagacaatataggtgaatttcttcaattttcaaagaaaaatcttttagcagacttttgaatgaatgaagaatacatatgtgaatatgcaaagtacaaatagttcaactctgcgaagtttataattgttttctgcttcgaccattagattaacagcagaaaacacaaaacatggagtgttagtgaagcaactattaacttttattggtaattgacctgttttgctatggaaagaaaaaaagacataatgggaaatgattgaggataattaatttttcttcatattctcatttcatatttcctttgatattcttaaaatatttaaaaaccaccatgtaagtagaaaatccccatgtacttaaaatctccatgtaaaggactgatcaactttcttactcataattatttgtttcctaaaaatagatgtttatgcttaagaacatattatttcccgatttaaataaactttggatgcataaatatcattgta

SEQ ID NO: 12493 - DNA, 1049 bp, Homo sapiens
gcaggcactctagggtaagactttgcaggccagagggtggaatcagcacttcactccaacgacattagaaattcctggagtgttttaagcagggtatgacataaaccaaggggcagccagcaattcagttaggagaatattatggatagtccagaaccatttctagatgtttggctttactaatgggatggagggtggggccattttctgaaatagagatgggtgggaatagctttgagggaaattcagaagtttccctctggacctgaaatattttagagacctattaggcctccagaggaagatgtcaaggaggcagtgaatgtctgagtagcacacttccttttctattataaatatttgctgaactgtttaacagtgaaaattgctgaagcggaaagtaaaatctttacacgtttgattgtttgggttctggaagatacagcataggaacaatactgcattgaaagctttacagaatcacaatgaaaatttggttaaaagaaaaagaaataggactttattttgctacttagaacaacaacaaaaaagtaggaattcattaggtagttagtgcctgttcatttctgtcttaaatatttcttgttttatgaactataaggaatcaacactattgaagctacaccatagctgatggattttttcaaaggagatagtgtgttttaaatgtaaattgtatctcaaataaaatcttaaggctgaatcacgactcataaaccattcttaaaaaatggctttagaagttattaatagttttattaatcctgtcatgaaacagtgactgtcaaagtacagaaactaacatataaaatcttatctataaaaaaatggtcattgtatctcacttatttttatttttatttctttgcagatcatatattttagttctctgtttccatatgtggtacttatttgcttcctcatcagagcattccttttaaatggttcaattgatggcattcgccacatgtttacccctaaggtatgtaccatatttctatttaaggcttatgatcatgaaagcatta

SEQ ID NO: 12494 - DNA, 1050 bp, Homo sapiens
tattcaattagtcctaatgtttcagttctctaattaccaattagttaaattatggaaattggggaaagtggtaaaatgagtaattcattcattttgtttgtttgatatcatttgtttctctctgctgtaggtgttctaaggaatagctgcataagacattttgaaataatgtaatgtgaagtgtttcttaaagctctgaacatcattaagtagttaataataattccaacaaggaattcagagtaatgtaaaagactaaatatcattccttctaaggcaaattgaaaattagaatggttgtggtttaaaaagacattaagtgaattctaggtagcttgtttgttattatttttaaaggacgctctaggaaagtaattgctattcactattttgctttcgtattactttttttttttttttttcattatcacagccattgttctaaagctctccacatctcttggctggatcatagcaagaatttactgttggctcttctctctgccgtttaactgtccagctgtgctattttccttttcaaagtataactgatttcaggctaacttattaccactcatcatcatatactagcaggaatggcaatagtagtagtagtagcagcagcaatagtagaagtagtcataataacaataataataaatgatgataaagatgtttctgacaagaattagggtaagaacagtaattgaagccaattatttattacaaatgtattttgctttgggtactgtgataactactttttatactttatcccatttaattataaaaaccactcttgagaagtaatttttattttcagaaccattttacagatttaaaataaacaggtttgaggaattagtttaacttatccaaagtttcgtggctattaagttctagtatttggagtcaaatgcaagtctgtctaaatctagagcccatgttctttaactgcaacactataatgtctcaccccgtcctagtcccaccaattagtcaactcttttagggcagaagtctgtctaattcatctttgcttcctgttac

SEQ ID NO: 12495 - DNA, 1035 bp, Homo sapiens
aaaattcttatacttacgggaatattaagctctgaaatgctaaagacagttacatgttttatactctgtagaaagggtttctatcataaaaataaaaaagaataattctgtatttaaattttttcatcattaaatatgatcacatttcaacttataattttacaggtacctacagaatactggacatacggattcagaatccataaggctttatcaccttgaatcaaggatttatttgatatcatcctcggtctttacttcctatcaagtaacattgttttgaaaaatagagttaacacatttgccataagggagtttttttttttttttttaaatacttcgcatactctccaatgcccaaaaatagcaaggtggtaaaaagagaattagatgatgatgttactgagtctgtcaaagaccttctttccaatgaagacgcagctgatgatgcttttaagacaagtgaactaattgttgatggccaggaagagaaagatacagatgttgaagaaggatctgaagtcgaagatgaaagaccagcttggaacagtaaactacaatacatcctggcccaagttggattttctgtaggtttaggaaatgtgtggcgatttccatacctatgtcagaagaatgggggcggtaagtaatctttttaagtgataaattactgtagtaaattgcaattgggtttctcaaatagctcctattattgctgtttctcattatttttgaaactttcaatttcattgtaaagctagagaaacccacttctttgtgggaagtgagcccagatatgttttcagattacgtttccacaggagcagatgggcttgctgtgaatgctcagggattgcttaagggtaacacattctcaacttctttctccggaagcttattaaacaactctgaataactgagtgaaacttttcttgcatcgtttgtgcttgtaaattattccctttgaagaataacctaaagcttctgatatatgacaatactggtgaaggaaaacagagaattttctctccgtga

SEQ ID NO: 12496 - DNA, 1025 bp, Homo sapiens
tttaaacctttcggttcattcattcaacagacaagtttaaacattggtaatatgggggtgagtaagataaacaatgtcattctcaaggcaataacttattttctcccagacttacatgttattgtgaatattttaatgttaattacaattcttcccctatcttcctacaaccaccccagacagaccaagaagtgggacagggtaagaaaaatagtaagaaaagagagcttagataattttatttataatatcattaaggattcattatagttttttgctcatatgagaaaaggagcttttaatgcatgcaaatacccacttcaactccctttttaataagtattttattttataaagtttggctagagttgttatacgatatctgtagtatatatttatttatattcaaagtgtttatgatataatattacatttaaaatttgtttacattagatactgattttttaaaatagaaaatatgaccttcaggtagtttgatcagaatatttgagtgtaaactttgccaaaggataacttatgtaaattggtgaggattattcacttggtgtgtaaaaaacatgcagtagtagccaaaggtattaccttttattttgatttttgtgtgtgtattttttgtccaaagaatataaatgtatagaagagatatagtattttccgtaaaaatttgggggagattcatggttcacactatttaaaattttttttctttgtaaaatgttgagtgtttttactataatagtatctctaagcttggatacactccttacttttctgtctgtatggaaaaagcaaaaggaataagaaaccaaagtttattgtgggaactgaggttaagagaggcataactatcagcatttacacaattaataagttatagtgctaggacacaactccaaatttgtcagactaaaatccatgctcttatccatatatcacttgctactatgccaacacattttatcttcagataatttaataaatgtaaatcttttttctggataatt

SEQ ID NO: 12497 - DNA, 1032 bp, Homo sapiens
ttttttttttacaaaatacagatggtgggttgtatttggtccatgagcaatattttatgggcatggatacatgccaatacaatcttttttacaaaatacagatggtgggttgtatttggcccatgagcaatattttgttgactcctgctctattgtacagttgtagacaggaggctcttaccaaataatgatgaggacaagtattacaactcttcggtgcagatgaagtgcagtgagtgatagcttgttccttagttgattgtctatcacaagaatggatgctgctaagttggcagagattgtgctgttacttgatactgattccactactgtccatatgacctatcgagcactgatactttatcactctatctctcttcctggacatttctcttcatttcttcttctattctcagatgtaacaattgtaatacatttttggcaattgccaacctctcttttgattttcttttttgtctatgtttatggactacatttatggactaagtttttaggcgggcttttagaatttataaaaatggttatccttcaagaaagttactcttaaaaatgtgaaattgatctggcttctaaattattgttgctatacttagttttaataaatctcttcagaaactaaatttatctatttacttttggctgtatgaaaactgtgcacaagaagtcaattcttatgttcagtgggtgcatggtcttaaagtaaaaatacaaacaaactggtcatggtggctcacgcttgtaatcctagcactttgggaggccgaggtgggtggatcacgaggtcaggagttcaagaccagcctgaccaagaaggtgaaacctcgtctctactaaaaatacaaaaattagccgggcatggggacgggtgcctgtaatcccagctacccaagaggctgaggcagagaattgcttgaactcgggaggcagaggttgtggtgagccgagatcatgccactgcactccagcctgggggacagagtgagactccatctcaaaaaaaaaaaaaaaaaa

SEQ ID NO: 12498 - DNA, 1055 bp, Homo sapiens
tatgttaattctttattactacatacatatgcatgataggatatattagtatattcttatgcagctgtgcagagtagattttgaaatggtttctcagcagatagtattaataaaaatctacaggcatagttggatgcatgaacaacattcaaggttacatagcaggaatcattagatttatttctactttgcttatcataccactcttctggctgtctttactaaacaatttttgatgtatttatctgcttaaatattaactttgaccagtaatgatcatctctttttctgtgaacaacaagccctaaaaataaactgggatatagggcaatttcaaatgcagagtatcacttgacacagggcagagctgtaagttgtgttcagccttgaaggtcactttatttccttgtgattaatgtgctaaggtatcttttcacataagatgaattgacttttatttttaaatagaatgcatactttgggaactttttcacctatcagattggcaaagatcaaagagattatttgttatacagaagacagtagaagaaagcgggcactctcatgcattgctggtggtagtgcaaatggacacaatttttatcaagggctatttggtaatatttatcaaaattataaaagctcataccttttgatcaagctgttccagttctaggaatttattctacagatatggagatgcaagatatacaaaataatttgttggaacattgtagtagcaaattatcagtgatgatctaaatatatggtataccataccaaggaatatcatacagtagttttttaaatgaagctattacattgagatcaagagttttgaagaatttattagagtgaaaaactaagaggtagaattatgcacatagtaatagttgtgtaaaaagaagcagattgggggctggtggggagaaaacacatattagcttgaatatatatagagtgtttaagtgtgtatacacacatatatatatgcttgaatatacagaaaatatttattgaagattttggttacttattgggaggtacagatggta

SEQ ID NO: 12499 - DNA, 1166 bp, Homo sapiens
ttctcactgagacaaaagtcagcggctggtaactggtgtccattctttcgcttgagtgggttggagaaagacggcatggctggaggaatttgttttgttttgctttggagcgggcttcctcagttgcatcctgcatcgggcgggcacagccccgggctctgggaagacgccgctcggcagccgcagtggccgctgcatcaatgggttttggggcagggaggtgcggagcccagcctgcgctcctggctacccctccgcgccccgccgccgcccacagcctacccttctcctctgcagccggtaggcggccgtaacacgggcgggccgagcacgtgggcgcctccgtcacaccctcacacatacacacacgcgcgcgcgcacacacacatacgcatgtacacgcgcacccgcacccgcgcgcctgtatcccgtgctgtttccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtaatggcaagcgcctacgctaagggcacaactgggggtgaggtggggctcgccattagccacccaggagcctgggcaccagcaccgggaacgaattgatggatggatgccgggaaggactcgctgcgtcctggggtgggaggagggagggcagctcaaaagccctgggagggagaagctgggctgggcgggcaaccgtctaactctgcatctctgtacaatcagggtggggggcgacaggctgcacatgtaaggggaagcacatgggttgaaacgtgccgccatcctttcttcccgtcgtggaaattgcccacagcatccccagagacctactcgtttccaagccaagtcggggttggttgaagggtggggtccaacacgggaaagtccaagaggaaagttgggagggttggggcagagagagacgcgaggtgaattggaagctaaacctcgtgcaggtgggcgatggggcggggagagcagagagctttattcctcattc

SEQ ID NO: 12500 - DNA, 1035 bp, Homo sapiens
aatgatatgaaaacaaaaacaattatgactaagaaaacaaaattatgggtggctgttaacagctcagctgtggggtccccactgcctgtgccatgtgctgcttttactctcagagtgctacttcctgttgggcagtgaaagtaccgaaattacaccttttatgttcaagcaatggtttgtgtagcaggtattctgcagaatttatagactgcacaacaaatgtcctctgtgtctatgggaagctagtcacttttgactgtacagtgaaaccttctgttgcctgtgttgattaggagttaaaatcccaaagtaactttctcatcaacatgacttgattttgatggaagcctccagaaacagaatatgaatgtttcaattctaccagctgcatgaggtcctgtcctcaacggcattatgctgccaaatacatgataaacacattcatgacttgggtaactacttttttcaaaatgctgcactgaaattgggctggaggctataagtggtctattgctctggctctaagcatcacccttggtggctttggagcagaccatttccacctcaaccagtggcaagaaggccttggcaagctcttcagcttcagtggcctggaaatatagacactaatagacatcttgctaattggagttggctacattggaccagcagatggctcttgatacatttagcttgtgattatgtgctttgaagaggagtaatgtttagtaaaagcccttttgcctgtaggagttgatgtggtgtgagtgatgtatttgtatatttttaatgtgcagcacttgtactttgattgtcttgatgaagtaaaaaagagaaatgaaacattgaaaaaattagaagaagaaacagaatattctaaatattggaagaaacacacctacacaatatttatagtatatacagtaataatctcactttaatacagcagtttcttgatgctttacagaaacctcaaagtatatttcattcatgacattggccaaccatcataactcatatgaaagaaagttaaaa

SEQ ID NO: 12501 - DNA, 1030 bp, Homo sapiens
aatgatttaaactcagtgagtgacctcagcatgtcagttattaattgatatgaacacatttgccttttggggatgtgactttgggattggtgctagcttgaacttgggttcattgtttataatacctgcatttgtgctttaaaaaaggatctagaaatttcacatatggtgacatgtcaaatatgtcacagtaggtatggtattggtaccctatggttggaaggcactagtgtgaggctgattagtctatccaacaggtacctcttctttgagacctttctgtatccttctctctcctataagcctgagtcctttggccatagctaaatgatttcattcttttcaaatcatctaggttgagccaatcaggctttgtcttactaattttatatgttgaaaatagatatcaagactgagtgattatctgctaagtctccttaatgccatttttttttctggggtggggaggggaaattgtatattgtatttaaaataccacctgttaaattttcctgagcgactctcttctctttgcctaagaaatgtgtttgctgatttggttctgcattttgtaaaatactcgtgttcttacaataaaagttgtttgatggagaaagataaaataaaatagagaaatattagagagaatctttaagataatttaattatgtaaattaagttggcatatggattcaaatttttcaatctgcagttaattgctgatttcaagtcaaagtaaagatgtcacatatatgtttaagtgatatttggtcatcagtgactatccacaattagaatggggcagaattagatcatgtttgaaactatgctcttttttgtttgttatcattgtttgtttttaaagaacatatgcttatgtgtatatctacagagaacctgaaagactgtgctcccaagacttgctaaatgctgattactcacaaaagtctcattcagaataatgagagaattttaaaatacaagtactaaactgttctcaataaactttgggaattgcctacaatgtatc

SEQ ID NO: 12502 - DNA, 1050 bp, Homo sapiens
tataatttaatcattgcagaaactaaaagagaaagaatctgctttaaggttagcagaacaaaatatactgtcaagagacaaagtaatcaatgaactgaggcttcgattgcctgccactgcagaaagagaaaagctcatagctgagctaggcagaaaagagatggaaccaaaatctcaccacacattgaaaattgctcatcaaaccattgcaaacatgcaagcaaggttaaatcaaaaagaagaagtattaaagaagtatcaacgtcttctagaaaaagccagagaggtattttattatattatgagttatgctgttatccattagtttttttaagcaaatgctaaatattattttaccctaaagtggtatttcttttcttgctttcaaatgattctatttaagaattgttacttgcatgtgattggattacacctctgtcagtaaaactggaagtttgtgtacatgtatctttctattatacactgactaaaccacgagtagctatcatggtgaaatcatatgattttgaaaaatattttaattgagtttataggtgaggattgaggcaatagggtggaatgaaatatatcacaccggtaatcagtagaaatcagatttgttagaacttcgtgggggaaagctaacatttaattttttctagaagtaagttaaaagatgatagatacatgtcattctaatgttaagaataaattatgaactgaggctgggcttgtcaacttgaacattgtctgaggggacatgcataccagtctagatacatacatatatggagatactgtttcttcctcatctcaaaggaattttagaagattgaagagaaaatatataaggtcttcaaaatgtgaatttgttttaatcacaatttaagatatagtttcgattttctgtaaaacaggagcaaagagaaattgtgaagaaacatgaggaagaccttcatattcttcatcacagattagaactacaggctgatagttcactaaataaattcaaacaaacggcttgggtaagattctaagaactttgttcca

SEQ ID NO: 12503 - DNA, 1044 bp, Homo sapiens
tatacaacagtaaatcctactatccagattcctaaatagagattaattaacttaatttttctccaaagtgcttgtaaccttctgacgtattacatacttactggtttattattgactgtctttccttcgccagaatgcaagttccgtggtgacacggacttggttttgtttactgccatgtttgtatttcctagaatgatgcttggcacataatatatgtcatcaaatatctttcgtatagctgaacggatggatggatggatggatggatggatggatagactgaaatccttacttcacatctgcctttgtgatcttacacaagttacttcacctctctgagtttgtatttttttccataaaaggaaaataattacagtttcttcaatgtgttgtgaggattagataagaaaatatatataaaatgcctgttatgtgcctgatgtcttcgtgtatgtgtctgacacaaattgtcctttttttagtttcatgaagaaagacaaatggcctgggatcaaagagaagttgacctggaacgccaactagacatttttgaccgtcagcaaaatgaaatactaaatgcggcacaaaaggtatgaatgattaatcttgtttgttactctgtagcatagtctagagtgttaactcacagaaatatttcctgtatcagatgtaattttaattgatgttatattgtatatttaaaatataagaggggtttaatctatgttttatcatacagctgtaaaaattaatagttactctcaatgctgcaactgcttttttaaaaaacatactatttcttaatagtttgaagaagctacaggatcaatccctgaccctagtttgccccttccaaatcaacttgagatcgctctaaggaaaattaaggagaacattcgaataattctagaaacacgggcaacttgcaaatcactagaagaggtaattagaagaatttgcattttgattagtgtattatttggtatgtttggggggctttctaaataatatttctttatgagggcaatgcatagaatgatg

SEQ ID NO: 12504 - DNA, 1070 bp, Homo sapiens
ctttaacatcagttatacacattgtactttttaaaatctaaaatgcagtacattgatatgaactcattgacttgtctaatttattaaatttttctttagaatgaaatcatagcacaggaattcttgatcaaagaagcagagtgtagaaatgcagatatagagcttgaacatcacagaagccaggcagaacaggtagtgtaaaggcagaacattaaaagagatgattgtggtactaaagacaaaaaccgttatatctttttgcctcttaccatggatgttgggagagggagaaagtgggattaagatcaccatctgctttactgtttagattttagtttatttttatgattgctgctatgtcttcatagctcgttttttttgttttgttttgttatacttaattgatcaaacttttcttaacttgaaaattatagacttgtgatattttgttgaaaaaaatcaattttattctctctgcttttttcagaatgaatttctttcaagagaactaattgaaaaagaaagagatttagaaaggagtaggacagtgatagccaaatttcagaataaatgtaagttacaattatcttttacttttctgttcttatttttcctatacttaaaatcatgggcctaaaagggcgttaacacattctctgttttctaatctgctttactcctaattacctctgtactgtatatacttcagtctgtcactatccagttgatttgccttgctgttttcattgtgagagaatgttactaatatgaattttttgtgagaatatataactcctttttcttgtgtgttcttcaatcaaaatgaagttagaacaccaaatttaaaatactttaatataaagcatagtttaagttaaggcagaagtatgccttatatacgtgtgtatatgcacgtgatataaataggtctgtcatttaactcaactattcacgttggatttatagttgaatttttttgtatgtttatttacatttggatttttccaatgatgtctttggtatatgtgaaatatttgtcatctgtatagcatagtgtaaattgtgaaaaa

SEQ ID NO: 12505 - DNA, 1026 bp, Homo sapiens
ttacagtttaaatatctggaaaattctttcacagaaagttacctcattcttcagtgatactggctaagtgaattataaccagttgcttgatggtatatgacatttttgcagcttatttgaatgtttttaagtttttaattatattgctttctattgtaggccttgaaccaaagacaatgattgatttaactgaatttagaaatagcaaacacttaaaacagcagcagtacagagctgaaaaccagattcttttgaaagaggcaagtgtggtagtcagttgattattttcttggctgaactatagagaaatactaataatttatactttgcagattgaaagtctagaggaagaacgacttgatctgaaaaaaaaaattcgtcaaatggctcaagaaagaggaaaaagaagtgcaacttcaggtatactcagttattctaaacctttaaaaagaattattgataagtgagttgtctggatatgaaattatttgtgtcttagctgtttttgctgttctattgtggatctgctacaaatttaataaatgacaataataacctgaaggagataagtgagtgtcagtgggttcagtcctgaatctgaaatagacaaaaacaaaacaaaacaaaataacaaaaaccaagcaaacaaaaaagaaaaaaaccttagaattatggaatttttgaaaagttttatagtatagtattttaatttctagacagcaccaatatgttgttattaataataataaaacttagtagtttttatgttaatatatgttactcaacattttccctttccttaaggactatgcattgaaaagcttttcttgtaagttattattattattattattattaatatttgagatggagtctgtcttgttctattgcccaggctggagtgcactggtgcgatcttgctcattgcaacctccgcctcccgggttctagtgattcttgtgcttcagcctcctgagtagttgagactacaggcgtgagccaccacgcctgacttatttttgtatt

SEQ ID NO: 12506 - DNA, 1023 bp, Homo sapiens
cccagcactttgggaggccgaggcaggcagatcacttgaggtcaggagttcaagaccagcctggccagtatggtgaaaccccatctctacaaaaacaaaacaaaacaaacaaaaattaactggtcatggtactgtatgcctgcagtcccagctacttgggaggctgaggcaggagaatgacttgaacccagaaggcagaggttgcagtgagctgagatcgcaccactggactctagccttagcaacaaaactagagtttgtctcaaaaaaaaaaaaaaaaaaaaaccggaacaagatcatgtcctttgcagggacatgggatggaggtggaagccattatcctcagcaaactcacacaggaacagaaaaccaaacactgcatgttctcacttataagtgggagctgaacaatgagaacacatggacacatggtggggaacaacacacactgggacccgtcaaggggtcggggtgggagaacatcaggaagaatagctaatggatgctgggcttaatatctaggttatgggttgatctgtgcagcaagccaccattgtacacatttacctaagtaacaaacctgcacatcttacacatgtaccccagaacttaaaagttgatgggaaaaagaaaaacaataaccacccacatacccttcatatagattcaccagttcttaatgttgtgccaactttgctttatctttttgtcagtatttttacacacacatgtatttctctgtctcttgtttgttcaatcacattttttgctgagtcatttaagagctaattgcagatatgatactttgcacttaaatatttcagcttgtctgtttgaaaaagaaagatgttctcctacaatgaacacaatataattgtcatgctcaggaattttaatattgattcaacaccattatctagtccataatgagatttcttctaatggcccaataatatccttcagtctccccacctccaatatccaaagttctgtcaaggatcacatactacatttggttcttta

SEQ ID NO: 12507 - DNA, 1035 bp, Homo sapiens
gacaactataattgtcacaatctggaagtgttcttatattttgcttgaaggttataaaatataaaacagttgcttttctgtttacttaggtggaagtaaatgagctaaaaagtgaaaagcaagaaaatgtgatacaccttttcagaattactcagtcactaatgaaggtttgtatgtagtaggttttaactataggtttggctattagtggaactataaaaatctgttcttatataaggtaatctttgtgaaaatacctggtaatatctacatcaccactaaaaaatgcaatatatttaaatgtgaattaagtattttagtgtataaaacattgctagtttctacttaaagtttctaaaagggtgtgtaggggaaatagaatgagtatgttgaaaagtaacataaggaaatatatcttgaggtccaaatgacaaatgcagacaatgactgctatagggatttgttaagaggggaaatgatttaagagatgtcagaagacttcacaaaggatcaatactgaggagtagtgttagataagtggaaggcaatgcagtggtaagatagtaagggaattctagagctgttggttaccataaataaatactgagaacaggaaatatgtttattctttatatttgaggaaacaaggtgcagcaagtttgtagcagactgtagagaaaacaaatcttgggtaagtactttgagataggttgttgagggccttaaaggtgtattttatgctatcagcaattgagaaggcagtaaaggttttcgaaacacaattgataggtacaaaaatacaccttaagaaggcaaaactgagtatattatgtaggacaaactgaaggaaattggagctttgtagacatcacattatagcggagtttaaacctgaaattatggattagaataatagcaattggaacagaaaaaaagtagtggaaagacattacaaagggagatgttgcattactggatataagacttgaggacttgaggtaaaaaggagaatcaaaaatgtttcatgctattaaa

SEQ ID NO: 12508 - DNA, 1050 bp, Homo sapiens
aaaaaaggaaagaaaattgtaaaaggttataagaggtttatggagatcttatcttatggtcaaattgattaaaattagatttatttacaagccctcattacaattagctttagcattattaatacacaatacagaggtaaattttttctcttatgaacaatgtttttgtgtaatattagtaagagataataaaatattttcgattaacttttgagtaaacttccaaaaaataaaagagcagagagagaaacagatttaattggccttatgctgtctttattaggttttttctcggggggaaactcagtctactctctatcaaagagtaatggtttttgtttttttgaaatctttgcgttatcattctggctaagtggattactattttatggtgacctgtaatgcgattttatgacattaagtgtttgaaacacttagataaaacttgaaacacttagataaaagttttgacatttgccaaactttccaatatcaaaattcaaaattctgaattccgtcttcttttaaatctcagactaactttttggacgctggggtcccttgggtccaaaactgcttaattttctttgggttatatttatataaatatataaatttccatatgtttgttagtatgtattctgaaattctatgagactcctaaaattctgatatatcatagtatatgtcatcaatagtaattatgagtgttatattaaactgttgtatgccacagaaataattaaattttcttgtcaattatatctttaaccatggctgtcctaagacttctgtcttccaaattattgttttactctgattcctcttaaaaagcagtttataatcagctgaagtccaaaacttgcttctttaggggagttcataaaaatgactcttgaatgcaggtttctgacaacttctgaagattgcgccattggactagagagaaaacttccaggactctcattgaagaggtgatgtattcaggagaattgctgatccaatattaagtaaaataggagttaattacatggactgaactaatatgga

SEQ ID NO: 12509 - DNA, 1035 bp, Homo sapiens
ttagccgggcatggtgacaggcttctgtagtcccagctactcgggaggctgaggcaggagaatggcgtgaacccgggaggcagagcttgcagtgagccgagatagcgccactgcactccagcctgggtgacagagcgagactctgtctcaaaaaaaaaaaaaaaaaaaaaaattgttcaatgtcattaaaccatatgactctgttgttaaagaaaacatctcctaaggcaacacattcaaaaattaagaaaaacagggatgatttttagatgtcattttcaacaattctttcatagacatttaagatatattttatttcctaacacaaataatgtgtttcattatttgtttgataatcagtttaatctttggcaacctccatttctgtaatttatgacatctggttaaaaaaaatccccaagcagccagggagcttagtcacagatgtcagcatgaagtggtagtgaaagcaaagcgttctgacttcaaagggttaggaaagacttgtaacaatgtaataaaaagaatagatgccacagacatcataagtgtcagaaagagccagaaactcagaaatgaaaatgtggagataaatcaacatatgctgggtttcagttttccaagttccctccatcttcagcaaccatccagacactaagatgtgttctcattctttatatctgtgacccaaattaactttatctccaacaaccccctactcatcccttcctcccactctactcaaaacttcctttcaatcagtcagaaaagacttttacaacttgagagttttatgagttgggttgtactttgtattaatattgttctcttccaaatttatccaggagtttagtataaaaaatgttatcaggcattttttaggtcagcctccattggtgttggccccattcacaggctctttttacaaaatagaccccggtacatacaggatggcaaaggcaaatggtgattgctctctcctctgcatccctagcagttcctggaaaaggattctggttggtcaaggttaggttt

SEQ ID NO: 12510 - DNA, 1047 bp, Homo sapiens
aaagcattaggaatactcagacaacttcctctgaattcttttcacctctagctataaaattttgaacaacattttatcatattttcactagatgtatgtaaaaactaattattattgactgttctttgcaaaatttctaaagcaatggactgtatatttggtaatactacttgcctctattatcttgatagccacaaatcttgtttctactctcttgtgttcaaattccctccaaagacagtctaaccaccaggtttgtgtatggatacagtgcaagcagacaagctcagaaacagccaccactgagaggtgttatgtgaaggagatattttattgcagtgacagaaaataaggtgtgagagtaacacaggtttgggtagaatgttggccccatgctttgtgcccttgcacaaaccttacaactacttagaacttcaatcattctatccatcaataggaaagcaatatataacttagagtggcctatgaggattaaatagaattatgattgtggagcccctggagcagtgtctgggatagtttcttcatatatagtggtggtggtgtctgtagcagcttcctttaagattctgcgagggtctatagggaatgtcaaggtgtaagtaagtcccactgctcaaaaggctcctggactagcagaggagataatcaccataaaaggaagatgcaggaagatgtttacgtctctaatactcagaaattgttccatggagttgttcataacagagccgaaactcaactgataacctgttgtctcatggacttcggtttttctagactgaatcaagagacagctgcagcttccagagataaccagggccacctcaatagctatggtacctcagggaccttccagatgtttccatatctctgcctgtgtttggtaacaagcagctccagtgtcacaggcagcagctcactgtggcaacaaggcactatggtggataccaattactttccaatacatcgtaattaatctgttgctagtaacagttaaagttaagtaaatgattaacttttctgctg

SEQ ID NO: 12511 - DNA, 1025 bp, Homo sapiens
ggtagaatgtcaggaggtatgaaagtcacagggtgaaatatttattgagtgtctattaagtgccagacattattataagagtggaggtacagcagtaaaagagatagagaagctccctgccctcatggagcttacattttaatgggaggacatagataataaacaaaaagtaagattgtttcagataatgtgttaccaaggagatcatagaaaatgactgatcactgcatctaagaaaatatttatgaagttcttttctgctatataagtgaagcatacattgcaaatttgttactcattctgtggtcatatatgatttcggctattgagatttttaaaaaggcagaaggcagatacaccataatctctcttttcttccttcctttctaggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcagcctgtagttatcctggtctctgcaagtagatttcagcttggatagtgagggtaacaatttttctcaaagggatctggaaaaaatgtttaaaactcagtagtgtcagccactgtacagtgtagaaagcagtgggaactgtgattggatttggcaacatgtcagctttatagttgccgattagtgatatgggtctgatttcgatctcttcctgatgtaaaccatgctcacccatatcccactatacaaatgcaaatggttgcctggttccattta

SEQ ID NO: 12512 - DNA, 1049 bp, Homo sapiens
aaggcctcccacacagctttgttggaagccccttccttagatgctatccttctgcctgagaaaggttttaggtagcaaattccagaatatctcactctttagtaagctgctttttgcttttgagtctggtctttcctttggtctgagtggtgaatttcaagacttaggtttggtctttgtatagaacaagaagaacatggtgtttggctaccttgattacagggcatctggctgacccaacgtagataatggagttctccatagcatcttcctagcttgttagagttttccattggattttaaggacaaaatcttaattaatttatttgttctctctgtgtacattgattatggcctcttaaggaggttacctagtaaatctattgtaattacataccagcaatcccaatagataatgggggccacagcagattggccttcaaggagaaccaaaacagccaaatgatttatttacaaacagtattattaaaattcctcaaatggtgcgaattgtttgtaaccctgaatccatttcatatagagagcacttttatagatagtagttaaatcccaaacgagtccacgtaatcttacataatccttaaaatagctctgttattgtaatgatagtactttaattataccaaatcccattttattactcagatttattttggtgagaaaattcacattgggctccaacttgagatggtaaaacatatctcccatggggctataggatgtggggtgggccaggaggaggaatcctaaggaggatattcatggttatgtgaatggaagaccctatttctgacaactccctacgtggggatcaccagcaccttattgttcatccctcactgtctcctcccccaacacacacacacacacacacacacacacgtgagcacacatccatacatcccatcattagagtctccttggaaacataccatttataggatgagggaatttcctgctctcagttcacatatggtagaggaatgggctgttcctgtcctcaccatagtagataaaatctatttctg

SEQ ID NO: 12513 - DNA, 1030 bp, Homo sapiens
caggtgtagtggtgcgtgcctgtaatcccagaggctgacacatgcgaggattccttaagcccaggaggtggaggttggagtgagccaggattgtgctactgcactccagcctgggtgacagagtgagactctgtaccaaaaaaagaaaaaaaaagcagcaatgattctaatattttatttagggtggtatgaagaaggttgatggtgaagattcacaagtggaaaatacccagaacaagtgcccagagggtgtagagtgtgaaaatatgtagtggagctaagagacaagggaggctcttctctccagggacctgagttctagtctagacttaacatgtgatggctgtgtgaccttagtcaaggcacttgaccccttctagcctcagtttcttcatctgttaaatagaggtaatatgtcagcgggatctgaggataaattgtaataatgcagcccaagcccatagtgagcacagtgcctagcacatagtaaatatttgatacgtgttagacactgttactattttatgattatgtgaacttagggaagaggaaccatactaagtgcctcagttcagagctgaaatgagtgtcaggtggcattactggaagtaggatggtagtaagcaccatgagatcagttactatcttagctcccatgtgactacttatgcccatgcctaaattcatttatcaataaattgttctcagattctagaagctattgacaagaccaagcagaatcatacagaaaatgttatggtaaacttgtgcgagatgacctagtctagcaaacatgcacatgatcttagctttctataaggaagataaagtttttagagacaaggtgaaggaaaaaataagtctacaaagcaagatagacccttgaagatgtaatggtgcaaaactactttttaatatatgttatcttaatacccaatggtctaagtcagttgttggctaaattattcatctgggaattttaatggtgacataagagaaggttgcggacagcaaagttggtacagtgtgt

SEQ ID NO: 12514 - DNA, 1081 bp, Homo sapiens
tcagaggactgaccttagcacatttgtcattctgctgtttgaaagatacattatcacagtataggagaatggctggtgctttctacttccaggtggtccaaagtgggaactaaacaaaatgaggggataataaagggattaggcaacattcatgaaaaattcagaggaaattattagcataatgtttttactatttggatgacattaattgtatgtagaaaagcactgaactacaaaatagggcttacataattcttccaatatctttgtaacaaattatatatatatatatatatatataataatgtatataatatatatataatgtacatatttatatttattcttagcccctgcccagaaaagtgtttttaaaactttacttcctgtttgtaatgtactgaagccacagtactctatgctttaataatactttaaaaataatgtacctttttttaaaatatgaaactagggtctttaagaaaaaaatgtatttaggcatttattaggcttgcttgatttatttcatatatagatacacatatgactgtagctaattttaatttaaaattataagtagcttctaataatactagcaaatccttatataatgctcacaatgtcaggacctgttctaagccgtttgcatttatttatttatatttttcaataatgagacttttaaatccaagactgatttgaccatttattgtttgcacttctgtacaaatgtcacacataatgattcaacttgaagagatgaaatttactgtactatgtgtcaagtgtttggcatttaaatgtgtagccattttaaatagcttctatcattatattataaaatcaaaccatcctgataatagatcatgccaaaatggcacttagtagaaaacagttccaagattaattaattcacagcacttttccgctgagaggtagttattatttttttaaaccccatttcacagataggaaaactaagacaaggtctttctcctgccaatcccaggtgtttattgcaaaagagactcagctggcattaaccacagcgcattagtgtggcttatttaatacctcaaag

SEQ ID NO: 12515 - DNA, 1024 bp, Homo sapiens
ctaagcccagaggtttagcaacttgcctaatgtaccagaagctggaagcagagtcaggatttgaactgagtcccatccaactccagtttgatgcaattcaacaaatacccaccaagcacctcctcatggacatggggacatggccataatcaccttcactggctattgttcaggatctcctttaaaagcatgattttagtggcagctttttggtctgttattgggaaaacgtcacaaagatcccattcattggtgtaaaacctttggcatcacttagcgacagacactgtctgtgatgctggataagatgcacagaggctccagttggaaaatccagaatcctcctgacttctgctgttctctgtctttctttctctttagcaactcatatgctcatgtttacctgtggccatttttgttgacctgttcatgaaggatgataacctgtgaaatgatgcaccagcaggagagagacgggcccagggtccgcaccctgtgctgtttgctttgtgaaattccagactgtttaatctgctctatctcatcctaataactccagattccacttttcttaatgactttcccctccttaagtgcttacagagttatctttgaagaaggagaaaaagaatagatgaatcatttgcaggaaacggggggagagacatgtggttggaatggcagatggctgagcatgtgggcacatagctgtctctgttgttccttccaccaccctgtgggaacgagtcctttggaagtgtacattcattccaaggtgggggctgtgcccactttcaggtactaacacgtaaatccacatccgctcggagtcatcttagacatccaaactccaggctcaaacccagactggactatttattatctccttgaagttttggcattagaccttctaaagataaagtgataaactactttcaattagtgacaacagaatttcttgtgctgtctcctttctcctgcaggatatgaagtatgtgaatattcttcatgtgccacagtgcaa

SEQ ID NO: 12516 - DNA, 1120 bp, Homo sapiens
tatgcagacgtatttaacccaagaatcagatgggttgtctgcttctgtattcatttgttttctgggaacacatccgtgttgaggagcacagtttgggaatctacactaagttattatcaggtatttacaccttcatgtgtgaaatagcaagacagaaaagatggtgggcgcaggacttgaaatgtgagagaaaaacaaggacaggaaacagaatttcctccttcccaggcccaacccagagctcctggaactgggagcagttgattcaaggttggtttgccatgctggctatgtaccacaataatccctggagcttctgggagctcacccagattcgaattcagcaagtctgtaggatcccagatgaatgatatacatatgcataggtaagatataaataaataggccagacatggtgggtcatttttataatcctagagctttgggaggctgaagcaggagaatcacttgaggccaggagtttatgaccagcctaggcagcacagtgagaccctatctcttaaaaaaatttgtttttaattagccaggtgtgggggaacgcacctgtagtcccagctacttgggaggttgagacaggaggattgcttgagctcaggagttcaaggctacagtgagctatgatcgcagcactgcactccagcctgggttacagagcaagattctgtctcaaaaaataattatttgtttatatcttataatatgtatgtgtatgtctatctatagatatactgtatttgcaatttgttttatggagatagcatattcattttaatagtaatggtaaataagtaacctaatgacaattgcttcatgatgcacttcaacagttcttattttaacttttttattttgaaaaaaatttcaaatttacagaaaagatgaagtaataacacaaggaattgccatacaccttttacccaggttccccagttgttaacattttgctgctttatcattagctatctgtcttacctattttctgaaacaattgaaaattggagacatgatactccagttccactaggaatgtcagtgtgaatttcctaaaagacaaggccaaaggccaggcacggtgacttacgcctgtaatcccagcact

SEQ ID NO: 12517 - DNA, 1030 bp, Homo sapiens
gcagtgctataggtacggtttgccatggattggattgtgacagaatgagtagtgatgacatttcagtggcatctggctggcatgtggaatttcgcaccccctccccttctccactaagtgtgtagcttatggcaccacttagaacgctgtgtggcctcttccctggttttggtgctttagaagatcaggcataagaggtctgatcttccactgctttttttctcaaacacatcagtttgggttttttctttttcttttcttttctccaactgcttgataatgccttgccctatggttgggcccagaagcacagcaagttctggggctcatttttgagccaacttcttggtagaagggtgggcatcccagttcttaaaaggatttcctatgcagagattgtcattgtcatcctcaccaccagaggaccaggcattgattattttatcctcctttttgcagactgtttcaatcttggagcagcgactgactttgacagaggataagctgaaagactgccttgaaaatcagcaaaagcttttcagtgctgtccaacagaaaagctgaataaaaaattcattttcatttgttgggcagaggcccaataaatgaacaaatgtacatacactcaggaaggtagtacaagatactccatacaacacaaccatgtgctatttatcatggcatttcttaaaagggtgagcaacagaacaaaaggcagaaaaggcatacctaaggactaatttaaacacatatcaatgtgaaggactaatttaaattactatcatttatgattgcagtaataaagtgataagcattcaagcaactctgtattttccccatattattttaaatgtccattttcatttataggccaaatcctgccaggaaagtaaccagatctctggatttcactgttaagtcatttcagattgaccatattcagacagtcatggggtgaaataattcacttacctccaaaatagcatcctatatgccaataatgagttattgatctgactagttgtatgtc

SEQ ID NO: 12518 - DNA, 1090 bp, Homo sapiens
catgggctaaggaatgtggacagcctctagaagctggaaaggcaaggaatggattctctcctagagccttcagaaggaatgcagcttactgacaccttgtttttagccccgttaatcctgttttggacttgcaatctccaaaactataagataataaatctatgttgttttaaaccactaagtttgtggtaatttgttacagcagcagtaggaaatgaacacagtcctgtatctctggcacctggaattttgcctggcacataggtgctaaataaaataattttgcttgaacaattggcatatattcattatcttagatcttatgtagagattattgaagtttccaatccctactctaaattttatcattgaaaataaatgatatagtctttctttgaaaaatatttgcttttatttttgtccaaggcaaaaggctttttttgttgttattctagtctatttcaggcagacgttttatacatacgtgtgtgtgtgcatgtgcgtgtgtgtgtgtgtgtgtgtgtagtgatttaaaaatctcagaacatcaggaataaaaagggctttaaaaggcattcaattgaatttcctgatttgatgtttgtatatctttcacaatatctctgacaaatgaccttcccaagtctattttagaaccttcaataatgggaaacactttggcttagatattttctgccttttatctgttttcttctctacttacagaattaaaccaagagtagaaatgttagttgtaaaccaaaactaacttattttaaccaactgattgaatgtatatctaaagttcaagtcactgattatctttacatgtgaaatgcctacttttgcactcacatttgttagaaaaatccatctgttattcagccagaagctatcaagtatgcctttaggggataaaaatctaccagtgatttgaagttagataatatatgcttacattgcttcctcactgtacctctgagaaggcatttaagattgtaatttttaatagaaaatggcattagtttaactttggggggtaatatttctcttcaaatactatcaaattgctaatatttaattttttgtg

SEQ ID NO: 12519 - DNA, 1033 bp, Homo sapiens
atgaaaatcttttatcccttttaaaactacatctgaaaatatcttatttttttctttggggtttgttgaacagtgtgaaagataactatagatctttgccttattcacttagcatgttgtgtaaaagattcttgttgaatttgttatggaacagataatgaggatggatcccttactctgaatgcccttcaaagtgtaatggcacagttcacaaaagaagtaatggctacttgttttcccttttgagtttgcaggaaattttatgcagaaagttggtgttatgttcatttggagtatcattaattaagatccatctggtgcagtgcacttttagatcagcatacagcattaggaagtagatcctcctttgaggaattaatggtttgtgttttcttaatcatataagaagtgaaacatagaaggaaatttttatacagattccatttgtcctagctgtatactacccattaatggcttcaaaattaataggtttctctagagattataataaagattaaagacaaagacagacagtagacttgtagcctcagctgtcttttccgaggtgactgaattaatcatttggatatttcagttgatagctacatggtatatttttcaagtcttctgataaaaatgcaatttccaatttgctctcaagaagaaaaagcaaagtcctctataaaatcttatccccaaagctgaaggttctttctttgagaaaaagatgtatgttttctcctgagggacaaacaagtcttaattcagcaaatttagtttggaggacaaaatttcacatgacattttttgattatatcctagtcatacttttaagtcaatcagacttgatcagatgagtatgttcctacaaggatacataatccactgttcagaagacagaaaattgtcattttttccttcaggatcaacagcctatgttttcaagaatgttaagaattgaaaatgaattctttgttgtggtcctgtgacagccccatctgggtgagtctgcagttcctttttctgtttccct

SEQ ID NO: 12520 - DNA, 1050 bp, Homo sapiens
tggctgcctgtaatcccagctacttgagaaactaaagcaggagaattgcttgaaccctagaggcataggttgcagtgagccaagatcgtgccactgcactccagcccaggcgacagtgcaagactccatctcaaaaaaaaaaaaagaagaagatttacctcttgccatgtgctacaaatatgttttccttttttctcatttctccttgaatttagtttctgatttttgataggtttagctgcattaccttttttaaaactattttttgttgttgtttggattctatgcaaagaaattccctcatcaatccccaaacatcttagctactcttcttgaggttttatttttaatgataaaaccttaaaatccatatgtattaatttaggtatgaggtacagatttatagttaacaaagtaccctcaatttgtattgtttcactgatttgaataaccttctttaaacattaaattcatatgaacttgtgtctctttggagactttctcttctgtcttattgctctgttcttgatctatttgttcttgatccattatctgtttgttcttgatccattatcatacctttttaatcattgtagatttagaatatttctttaaaatattatataatgtacagttttttccttcaaaactttcctggatgttcttgcctattacttatccatatgaattttaaaattattctgtttcaaaaaaccatcccattggaatgtcgattgccattgcactagatttataaaataatttgagaattgccaacttgccaatttgagttgcttgtctaggaatgtagtattatatttagggaattgtttccccttttttctttcatttatttattgtttaattgacataaaattgtatgtatttcttatgtataacatgatgttttaaagtatatatacatgtggaatggttaaatgtaactaatttacaaatgtgttacctcagtgtttcagtaaatcaatttaggagcattctcatttacatgcctgtggttcccataaaaatagccaccatttttcacatact

SEQ ID NO: 12521 - DNA, 1116 bp, Homo sapiens
ctattaaaatttgggataccacaaataagcaatgtgttaataacttctcagattccgttgggtaagtacactttctttgtgcatttatgtgggttagttttctaaggagacgtttgattataacaatttaaataaataaatgagtaaagaaattgaaatatggccgggtgcagtggctcacgcctgtaatgccagcacttcgggaggctgaggcaggcggatcacctgaggtcaggagtttgagaccagcctgaccaacatagtgaaaccctgtctccactaaaaatacaaaaattacctgggcatggtgatatgtgcctgtaattccagctactcgggaggctgaggtggaagaatcacttgaacccaggaggcggaggttgcggtgagctgacattgcgccactgcactccagcctgggtgacaagagtgagattccgtctcaaaaaaaaaaaaaaaagaaattgaaatattaggtcatcttattctttcctcctagatttgcaaattttgtggactttaaccctagtggtacatgcatagcttcagcaggttctgatcaaactgtgaaagtctgggatgtaagagtgaacaaattactacagcattaccaaggtaacaattttcctaacaaaaaattcagttaccgaatggactccttttggaaggactgattctccttgttggtgtggtttggctgtcttacttggggtcatgggctgccttggaacaggctagagaatagtataattagctcccatcaacagcagggtctcagaagctcaaggacagcaggaagtgaagagaccttaaaaatgatgtgagggctggtttaaagaaaaaaaaagaagttgctatgagattttcaaattctggttatcagcattgtgtgagaagtcaggatagaaatgactgaattctgaatcacagggagttacgtgagcacaaataggtgttataactggtagaaaacaactacctactatgcctatgtattgatattgaactaaaagagaagtgaattttcttggtttatattggatttatattaaatcgaaatgattattaaacatagtagcttttccagtgtttactatgtagcagacactgtgccaa

SEQ ID NO: 12522 - DNA, 1054 bp, Homo sapiens
caaattccaagttgacacagtacaacactgacatcaataaccaaatacattttattatcatggtattagggtttggtaggacagttctttcctaagaaagaaggttaaggaagtaaagagggaaattcaatgttggttttcatagttttttttttttttttttttttttttgagacagggccttgctctgtctggagcaggctggagtgcagtggcgcaatcgtggctcagtacagcctctatctcccacctcagcctcccccacccccacagagtagctgggaatacaggtgcaggtcaccatgcccagctaatttttttgttattttttgtagagacggggtttcgagacgttgcccagctggtctcagacttctgggctgaagtgatctgctgccttgggggtcgtaatatgttatataatatgtattaactccctcctattttcttctgactccatgcctttctggctttgatcccactttcttgaggaagaaaacacatggacaaattctgatgttaggaatattttaagtatatatcttcaatattatttatccaggaccaaagtaagtcctgatgcaggaaatgagtgagtttcacagctttctgagcccctactcgacccaggaagccccgctggaacctcctctctcttgggcccagggccagctttgtgggcatacctcctgtacagttgcacagggccccatgcttagtttaatgctatgaaattcttaattattttcctataagagcttcacatttacgttttgcactaggccctgcaaattatgtagcaggtcctgatcaggcctgattttactaaacctcatttgacacacttgtcaccctcttggaatgctccttctcttcctggacaccacaatgtccttgttcctctcctacttcgtttgtggctccttcctttgctcttccttatctgaacgttaagtgtcctcaacctcttctttatctgtactgatttcctcagtgatcccatctagtttacagtctttagtactttctctaagttactactaacagagaaaac

SEQ ID NO: 12523 - DNA, 1515 bp, Homo sapiens
ttatttttgtttttaattaagggagtagtggggtagatgtgagttcattgtggcattcagcttatatttgcttggctttttcatggtcggtgacaccctaattcctagcatgataaatagtaaccctttgtgcttgattttgtttaacttatttgagttgttttcaaaatacattctttttaatttaaaaaatcagctaagcttgtgtatggttaagtttttgttttgttttgtgtttgatttgttcttttagggaaaaaatcctataaaatggctattaaatttttagccaatgacaatgagattttcttaatattactttgaattctttacctcttaattcttagagtatgtggttttgttgttctgtagtgtcttactaaaatattcatttttttacagtgtattgcaagttccactgcattacatgcaaatatgattcactcatacctagctgtttgtggattcaaactcataaatgaaccatttttaagttgttaatagtgtactgacatatttctgtattttctgatatttacagattcgagtggtgaatgcatttcgtagttctttatatgaagggttagaaaaaccggaatcaagaagttcgattcacaactttatgacacatcctgagtttaggatagaagattcagagcctcatatcccccttattgatgacactgatgccgaagatgatgctcctacaaaacgtaactccagtcctccaccctctcccaacaaaaataacaatgctgttgacagtggaattcaccttacaatagaaatgaacaagtctgctacctcttcatccccaggaagcccactacatagtttggaaacatcactctgattgtaagctgaatgttaacacactagctgcattgtaaagaaacaaattgaaactgggtcttttcacatattgtgatggacaagctagtattcttgtctttggacttcaacagaagacacacttgtacgaatgtagatttatttttttaaaaaaaaaaaagcaaagctttctgccagactgagggtgctttttggggggtgggagaaatgaactgacagataaacagtaactcagcgtaagtgacctgtggatcatcagtagtacccaagcatggtcctgaacagtgtattagcagagctttagtttatctcagtcctggatgggagagagagggaggagtaaaactgggcaagacaaagagccctggatcgttgaattgatagtttaatttctgctgttggctgttaataatttggattatttatgtttataaatgatacagatctgtttacaaggtttgtagatactttttttgttcctgttcatagatgggaagcttccttataactgatgcagagaaaaattagtccttcaaatactgctgtattttcaggaaaaaaaaaaaaaggggtgtttctattgaaactgtactaaatttttgcctacaatttaccttgttaaatattgtagataaattgctaatactaatagccaaatagata

SEQ ID NO: 12524 - DNA, 1032 bp, Homo sapiens
ataagagagctgaaagaagaggtacaggtgactcttaggtttctgctagacaggtaaaggaaacatggtttcacttttagacacctgaatcgatacccactttacaggtggaactatgactctcctcttacagtgaggtaggggcaggatgtggattctaaagtcattagaatatgatggaattagatggaaattgaaggtatgggaataggtaaggtaacacttaaaagatatggattgtgagccacccttaaccctaaacaaaagaataccaacattttactcatgtaatctgggtagtaaaaccagaagggtagaaagccaaccagaaaagaattgcctaatggttgcctggggaaatggtgctttaaaaagccttctgtaaataaatactgcaaacaaattagtagatgacaactgaaaacgaagcctgagctaagtctggcagtggaattggaaagagattattgaaaatagtgcaagaaatgttgagtattggaaatgaaatcaatcattattaagtcattgtatcattgtcatcatttgggggactataaattaatgcagtcgtgtgcagtgaaatatttttccttctaaaaataccaaattaactttgtaatttttttttttaatgtaaaccaggtgccagatgcaattaaaaagtgtcagagggctggaattactgtgcggatggtcactggtgataatattaatactgctcgggccattgctaccaaatgtggtattttacatcctggggaagattttctgtgcctagaaggtaaagattttaacagaagaatacgaaatgaaaaaggagaggtaaagatttattattattttgtttttggttgacagatgtttaatatattaggaatttaactcaacaaacacatattgaatatgcactgtgttaggcaccatgcatgaaataaatgcagtctataccttaggaagcaaaatactagtgttctaagggataaaagagagaagtaataaattggtactaaagggagtaagcatttcttgcta

SEQ ID NO: 12525 - DNA, 1049 bp, Homo sapiens
ttgcaaaaaccgttggagacatatattcagtattatttgtgtacggatgtaggtacctgaattgattcactaggttatgttatgcagcaataaaatgattgaaaccccagaaagctctggtactgtgtttagcttattttaataggtcaaatatgctaaaaaaaaaaaaatttcagtattacattggtactttatacattgtatttatagaaagctgggagttttctaattttaaaacaatttataatcattttaatgtaatgaggtgattggttttatatgcagcttaactagttttttttttttggtcactgtagaaaatgatgaaagataataacttagtaaggcatctggatgcttgtgaaaccatgggaaatgctacagctatttgttcagataaaacaggaactttgacaatgaacagaatgacagtcgttcaagcttacataaatgaaaaacattataaaaaggttcctgaaccagaagctattccaccaaatattttgtcctatcttgtaacaggaatttctgtgaattgtgcttatacatcaaaaatattggtaaggtttttgaaataatttatgaaaattaatttttaaatctataatgatcagactatatgtaagtcttcagaccaccattactgtatgtaaactgaactgttaagtttttaaaaggcatatatttatttatataatggtttttaaatttgtgttatgagtgaggtctgctgatcaacataaacattgtttgcttacatttttctcctatattttgaatttcctgtgttcagaaactctccagccttataaccagagcatgtatttaattttaaattcttgttaagctcatttttgagaaagatcaaactgtcttactataggaggtcagctctcaacttacagaaaatttttaagccgatttcaacttaaaataacatgttttatatatggttgccatgtgttctgtttggtttctcagtagttcctacctaaaaggtggtccttagacctttttagaactaatgcagtaaagtaattctagacttg

SEQ ID NO: 12526 - DNA, 1027 bp, Homo sapiens
acacagaattaagaggaggatgaggactgataaaaagcctgagatcattaatagatgatggctaatagaagcattaatagaagatggctcttcatagagagccatcttagtagtgtgtggacagaagaatggattcagtttgtcagggtcaaggtgagagtgggccattaggaggaagcattgtgaatagatctttttaaaaagtgggataaaaggagggggagaaaaagaatagcctgatgggttatcaaaatccaggagagacatgttttttgttttttttgtttttgtttgtttgttttttgtggcagggaggtgggtggagaaaaatggtcttttatgtagtagaatgtatctgaatattggctagtctgaggaaaccaagagaaaggggatggaagtggtggtagcttgcagtggcaatcaaggaagcaaggtcttggagcagacttgaggaccctggaaagagctggagtaatttaagaaggtcttggaattgaaagaggaacatgacaggaagttagagatatgtccgtggatcatatatgactgagaaaaaattctgatggaactaagaactcagtttttaaacttttaccaacattgctcagccagatggtatgtctattcaggggtagctaattaaccagatgggtggtaggaggataaagagcaagtgagacataagagcaaaactggagtcgctgaccattgagaagtaagcatttttagggaggcaagtgttgatcagaaaggatcttgactacctttgaacttgaaggtcagaatgtttacacaagactcagtagaagtgaagagaaataaagtgagataagttgttcactggagagcaaattttgaaaatagaacaattccaagggatgataagtttaccttgtggccctccgcttgaatagcaggtagagaatacagatcaaagtcttagaatgaaggtcaagagtgtgtgaaaccagagagtttgaaggatcaccaacatgttgtgatggagtgggctacagttcaacac

SEQ ID NO: 12527 - DNA, 1047 bp, Homo sapiens
taaacaaaaattagggattcaaattcccatagactcaacatggaaaaaggggtggactttcctgttttgtgggctaagaatgctgggaagtggaaagaatgattatttgagtcggaaatatggctcttaagtttatctgtttgcaaatctgtctccctagatagactcagttctttgttgggacctagcatagtatgtgacatgtattataagtcttaacaaactgagtaataatcctgagtgatcactttctggttaattatgtttgacttttacaaattatctaggataaattatgtggtacattgacagaagatttttgtgtaaagtatttaataaaggtttgtctttataatgacaagttttagcttatggcaaatatcttataacccaattctggtgaataaataagtgtttttgacatggagaagagtttgagtatcatactaataacagtcacagacttcaaaccattgctttccttaaagaaaatggagttggcttatagactttaatatttgaggtcataaggataaagaatctgattttcttttttagttagaagaggactgattgtatcagaagcatgttgcatgtaacagttggtatcatttaatccatataatagccctctaaataggatgatgatttttttttccctgtagacagagaaatgaatcagtttacatgcccaaatgctgaatggcagaaaggcatgtgggcccagctgtctaactctagtccactgctctttctgctgtacacagttgagcctctcacatgttactagaagtttgaaataatgtcaaaaactagatcgtttttcctttttggaattaaaatgttcttggatgattcttaaagtgcttgcctaatttacccaaagattgatggaaaatgtacaagaggctagggatttggtttattcttattgattctaaatattgactgcaaaaaagccagatttaaatccagttctccttaggttgtgggaatattgtgccactcacttaaagtgacaagcagtgaagatttgatattatcctg

SEQ ID NO: 12528 - DNA, 1055 bp, Homo sapiens
cacaagggagaagagaaacccacaccaaaattttagaaggcgttgacttagtagacttaaaaagctgatctctaagtaatagaaaagcccagaaacaagtcagtttatagaattccctgagagctcaaagctgggaaaacatgggacccatggtgaagaggggacaggggggcaaaacgggagaactggttgaaattttaggaatttgatacccagatatctttccctctgtctgtactctgtgatctcttttccttcatccttgcagaaggctggaagcttgctttctggagaaggctatgcacactgggaatacagttgaaaaccagggtaccacactcaaaaccgagtgtttacctatttatgttaagatcaccagtcttcttccctcacccagctttcagaattctggccagaatagaagtgtcttatctaacctgaccagctcaaggtaaaagacctcaagaatcggacattggctgtgtctgtgtctccaaagaaaatgtcccagtcagctcaccctactgtgaaacccatattgaatccagaacttctatttagtttgtgtcctttttttctcataaacaaatttgttatagtcttactaagatataattggcatagaataaactttacacttaaagtgaaaaacttgagttctgaggcatgtatatatttccacagtcgccaccacagtcaggtaatcattcccctaaattttttgtgcctccttatcttccttcccttcccctaccccagctcctcctttcctcaggcagccccgatctgctttctgtcgctatagaataatttgacttttctggaattttatgtacatggaatcatacagtatgtgttcttttttggtctgacattcactcaccataattgagtttcatccatgttgtgtatattagtagttcttgttattgctgatgaggattcactgtatagatacaccacaatttgtccgttcgcctgttgatggacattttggttccagtaacatacagtctcttcctattatcgagttgtaatttctttatatgttcttg

SEQ ID NO: 12529 - DNA, 1053 bp, Homo sapiens
taattttctcactgggaatgactcatttgagggggaacaatggcctggcatatcaatgtgttggctggtgcttatggcctcttctctgaagaatataatgtttatccttgtacatgttatagaccgtttgtgtccttctgaaatttatatgttgaagccctaattcccagtgtaatgatatttggatatgcaagcctttaggtaattagatttaggagccttgagggtggagctctcatggtggaattagtgtccttataagtagaggaaaaaaacatcagagtgctcgctctctccttctctctcccctgtgccctgcctccagacctctgactatgtgaagatacggtgggaagatgactgaccgcaagacaggaagagagccctcaccgaggaaccaaattggccagtatcttgattttggatttctcaacctcaagaaccatgagaaatgaatgtctgctgttcaagccacccagtcaatggtattttgttatggcagccccagctgaccaagagagcgcatatgaatttaatgagcattgagaaaagctaatgtttttcattttttcccttagaagcatctatcgatcttcatttgaaattatgtgtcagaaactgcaataatagaagtaaagagaatgggctaggtaatgtaagaatagggctaaggttatgtaagtgagggagagtttcgagagaggaatttcagtagcctttaaaattttaaataaaatacgctctataaaccaaatgcattagttaaggagctgtgggcatcagtttctccttataaagattgcatataccttttagttaacatcttggacaagtcaggaatgattcctttcctccagggtgtcctgtggaatgtctaccttgtctccctcaacatagaggaactatcgaccattttccattaaatagcctagaattaggtgtgtttcagaatcacgtgtatatatgtacatggtggttggatgtgggtggattcggaaggacttgttaagatgcccatgcctgaattcctcccagatccactaaatcagaatt

SEQ ID NO: 12530 - DNA, 1052 bp, Homo sapiens
gagtgtaggtatgttttttatataatgatgttttccctttgggtagataccaaatagtgaaattgctggattgaatgaaagtactaattttacttatttgagaaattgctataatgtttttcatgaaggttgtactcatttacattcccaccaatagtatgtaagcattccctgaaagtgtaactttttaagagttttattctgccctttgaattatctcttttccctccgagttatattatttatttatttatttatttatttatgtctttgcttttcatcttggtggcgtactttaatacctggtaatctttggttgactcttcacaataagaatgatactgtaaatagctgatcaaatgctctgtgtatgaggctgagtcttattgactgctgagttttctagtaactaactcattaattgggggcccccaaggctgatatggcataggtatcattcattcagagaggtaccaggactctcagaacgcactggtcataaacaaatcattcaagaagactgtgtgtacagactgaattcaaactcaacagtagttctgtctcttagacaggatggtttcctcagagaggacttctctagtctcctgtcttgggtgaaataggaataataatcccaccgtcaaatttggagggttctgggaggccatttttttttttatgtgtccatggatctgttgcctaggctggaatgcagtggtatgaacatggctcactgcagcctcaaccttttgggctcaagcaatactgccacctcagcctcccaagtagctgagactacagatacacaccatcatacttggccgtttttttttttttaattttaatttttagtagagatggggtctcactatgttgcccagactcatctctaactcctgggctcaagacatcttcccgtctcagcctcccaaagtgttgagattacaggcctgagccaccatgcccggctagcgggagttctttccataggatttcatttaatctattagctgtgcttcctgttcctggagctcagagcttctcagatttaa

SEQ ID NO: 12531 - DNA, 1031 bp, Homo sapiens
tgctgtagattttggtctacaagaattcatgaattatatttttagatttcataatatgcctctttttcctgcttaatgatattgatcttgaattcttatctgattttgattttgacatttctgctttctgtttgcatatatttacgtggtgtaattttccatgtgcctttattttaaaacttcctttgtcatttggttttaggcatgtttcttgaatatagtaataagctggtgtatccattaggataatttgggttgcaaataatgcacaagggtttaaaaaatgaagtgagatatgtttgcttttataaagttctaggacagatctagtccaggcatggtttgtgtgttgtgacttgatttctctctattatttcagctttcatttcctggtgtgttgtgcagcttctctcgtggcagcaaaatggccacagaggtttgattccaggcctttcatgtgtttacaccttacagtccagcagaagaaagagctcctcttctgaaaaccttgaaagctcttgaatcttatgtctaatcccccaacaaatcactatgatggcatgccataccacactgagtctgggtctgtgctacttatccttgaaccaatcactttggtgaggggatcggtattatgataaatggttagtttatgtaaattaaggctgaagcctaaaattgaagcttgagattcattcccactcaagttaatgtgctattattcgaaggaacagagtaagtactataaatattggaaagaagttagcacatttctcactgctggaaaaccatacaattccatatcttcaaaagccaaatggatcaactcataaagtatatcagaaataatcagaaataagtaagattatttttacaagattaataatggaaaaaattcaatcatttttatataaaaataaccaattagaaaatataattaaaggaactatttcatttattagatataaaatatactgaaataaatttattaagaaacatgcactatttatatgaaaatacatgcagtttca

SEQ ID NO: 12532 - DNA, 1912 bp, Homo sapiens
gttgcacaatagcacattaattatattaaatattctctttgtgaagttatgcacagaactgtaacactttcctctgcctttttctcttatatgtgggttcatggttcagttgcattgttatgttatgaatttactacttgggtgttctaaatacagtttatcttaaaatatgtagtaatatgaattcaaaaatggtttttgttttaacaatattaattaaattttcttgggtggattttataaaaacctctgtaaaatcaatttgtttacttatagttatctggggttgtattgcaaagaatagggttaatttttctttttgtctttttctgtctctttcttaaactcccacgcattgtccatttagaatcttagaaagcttcttaccctcgctgtcagttggaggatgaataataaacattgtataatgttcttattctcggtttcttgtaagtgggaagtcttttgagatcagccttcatatcatacccttattttgtctctctagcatcttcaggaacctgagtttgctttttacatagatctgattttttcctttatttggtttaacattttcaagcatagatcagcttcatgtatttgttttataattttgcatcttaaagctagtaactaatattgctgtggtcttattggtgaaaacaaaatataaaatgataagaagacattaaatattttactttctatttcttaccctattgggaagaatttttaaaagttgtaaaattgacttaaagttaaaatggttctgaatttggtgttccatgtcaactgttcccagttttaattttaactttgcaaaaataatgttgtgaaattccctttaagtaactaacacctagaaatagagtatcaccaaaaacaaatgtatttaggaatcccagttacaataaaaactgaaacagcatggctaagcatcttaaggataattaagaaattagcttatttgtatgctgaacaatggaatcgaactttaatttagcatagtcttattaatttggaaaattgtaaaacatctcaagagagaagttattaatattggtttattaatctttctagagaagaagtgtagttatacattcattcagtgcaatcattttataacagtagttaatatttcatttataatagttcttaatatacatttgctttcaaatattctgaaatgaaattatattcatgctatacctacagtgtatgtaaactaaagagatcactacatatttgtttaattatttaaaaaaaaatttaagtaaaccctgttgtcattagctattaagaacattgattaagtccctggacttggataaacatatatccttgaacatatataatgaagaaatacagtggctctttattaaaaataatagttggataatataaactgaactatttatgcatttttatatacttataaatccttccaaatagttttaattctatccttttacatataaataacttaataagtgtgctggaaaaacacagatattcacagcaccactgttttttttttttttttgagataataaattccatgagaaatctgggtttgaatatttgtttactttgtctcctaattgaacaccactccaggccttctgtctgtctcccctttacccccaaaatactcacaaaaaaattttaagacaacaagtaaccatatataggtgtttgaatgattttctcatttttatctaatttcatttcataagtcccgagtaatttacctaccataggctactatactgataatataaatgaaaccgaacattttttgctactaactctccccaatttaatgtgttttcgaaataaaaatttaaatttttttccttttaattaaaaagtcatctttgaagtccttattggctgtacattttacatgttt

SEQ ID NO: 12533 - DNA, 1024 bp, Homo sapiens
agaaaactaattgtctattatttgctttgtaaaatactaatttcttaaaaaaaggttagattctttcttgagagcactcataatgtcctttatgtctgtaagcatactttcattttggtttataattaattatctctttatgttcctctgtcctctagaatgtgacttccttaaatcagggaatgtgtataattcatctttatgttatatccccagaacgtaactcagtgtgtgataactaaatgatgaccagtaaatgttaagtgaggaaagggaaaatagagagtacagtttgtttttttttctccacataatcaaaacgtatacatttttgtcacctggatttaaatgattgttgagcaagacatactataatcttgtatctttttaaccaattctttaaaatactgaactttaagaatttcataagtgggtaaaacctatatttgatctattgtgataaattgcataaattttagccaaattttgaaatatttactatgaaggatgatttatttttggccctactttttcaacaggagataacaaatcttaaagatgctaaacagcttctaattcagcagaaattagaacttcaaggaaaagcggactccctgaaggcagctgttgaacaggagaagagaaatcagcagatactaaaagaccaggtgaaaaaggaagaagaggagctgaagaaagaatttattgagaaagaagctaagttggtcagtgagttaatcgggggaagtgtgttttgcagtagagctttaaatcaatccagtgagaggactgttctacttataagatctgattgaaatgctttcctaacattttagtttttgattaaggaaggagatctgatttatttacatagctgacatgtggttggaaatattttaccctgtaaccataattctgtttttataagtgaacattgaaatgaaataaaattaaaaaattttttttgttttttaagtgtcagaagctaaacaaccccacaactacgtagatctggtaaatggtg

SEQ ID NO: 12534 - DNA, 1042 bp, Homo sapiens
catactatttattaatatttttagcatgtcaagggacatcatagaacctaccaaatgtatatgtatgcataatgaagcatttaattatatctcttttaagattgttttctttcacactgccttatgactttaaccatatatatgttctctgagtgtatctgatatggtccctacttatttggtattctttcatatcaactagccaatattgaagatgtgatcaacattcagcaaatactttaaatatttatttagtaaatagattatttttggaggctttggaattgcttccattttactaaatattttatattataaatgttttctataagcaagagagttaatattttagaattctttctcttttacctgtcttactgaagggtataatatgctatctttttatagtttattgctttctacaatgtttatattaactatgtttctgttgaatttactaaaaacatggcatataataatttgggaaaattgtttttgtaagtctgtagaagagaagctttctctagcacaggaggacttgatttcaaacagaaatcaaattggaaatcaaaataaattgattcaagaactgaagactgccaaggctacattggagcaggattcagcaaagaaagaacagcaattgcaggagcgatgtaaagcactacaagacattcagaaagaaaaggtattgcatgtttctgacctaaatctacaatcttagagttacagttgtcttagagatcatccagtcaaacctcttatttagtacaggcatcatccttattttcaacagctctctcagagggacctctagtttctgacacttttgatcattgggattttaatgctaggaagtacttcttaatggcctccttgttatttctacccttttttcttactgctctttagttttacaaacaagtcaatttttcacaccatagacccttggttattgcagaaaagataatatagttcctcaactatttctcatataacgtattatcctttagatgtgtgaatgagataataaaagatctag

SEQ ID NO: 12535 - DNA, 1022 bp, Homo sapiens
cagtcactaatgacttcaacagcaattttattgaaggtagtatattttgaaagtcaaatacctatttttcatactatgcatatgtatatgttttaactatgtcataatttgtgcatatctcctgaatcttcttgaagactaaagacaagtttagagtttagaggagctttaaaactttgtgagattttctttttctgccttgatattaattaagatgacctgtagaaatttcctaagttattcttgaatttccaagagtagaaactatatattaatacttcaacaaagtaatggcttcttactttctttcatgtacaagtttcccttagttccaccttaaattacgtcagctgaggcatctagcactgcatgctccctcagaatgtagttgttactctttctcccgagacctgatagtacttcccagtgaaatgcctttttaaaaaaaaaaaaaaattaattacttttgtattttatgttctttaaattgagacttgttagattttgtaattctttgactttataagtaatttaccctattgaggtagaaatttggggcataagtacagttcatcttattgtttggaattttcttctagttgtctggattttactttatatttgtaattggtttttggaatgcatactgttttaaataactattgtatgtttcagacagagcttgagaataaactacagcagcagttaacacaggcagcccaggaacttgcagcagagaaagagaaaatatcagtattacaaaacaactatgaaaaaagtcaggaaactttcaaacagcttcaatctgatttctatgggagggaatctgaacttctagccaccaggcaagatcttaaggtatagtaaactatactgtaccataaagtctcagtaagttttatagacatttattaaatgatctatttgaatccaaatgggcaaggaaatgttagtatttgtggaatagtgtgctgttttctattaaattgttattttgtattagcatgctttaaaaaattgtt

SEQ ID NO: 12536 - DNA, 1034 bp, Homo sapiens
gagtgtccctttaactatacaaatgaggcttttaagctgtttctcagtttaaagttccataatacaccttttgatctctacttccacggtacttccttgtgtgcatgatcaggacagcatcaaggtacattattatgcacatgtatgagggcacttcactgcttttactgttttaagggctttaatgcaaaagttgcaacaattgtagccttgtagtaattggtacttagtcattgcctataaaaagggcaaacagaggggctggctatatgaatagccacatttccccccccgccccccatcagaagcctttctaaaataaggcaaactagtggagcaattacttaatttcccccaaactttctttatatgctacatgattttggaatatacatatattacattagttgaagcatgctgtataaaaaagatcatgagtgattatcatatgttaaaatatttcatgagtttttggttcctcagatagatgaaatgccgtatgtaaataaagctgacttctgcaaaaatatatttgtagtctatgctatatattcatcagtatagatttactatgtgttgtttaaagggaagatttctttagttttcacctttaaatcaatgtaaatgtatataccttgatgtaactattatttctgtgaaaattaagtattttgatattgagaaaaaattatttgaatttttccttcagcttgtaattatccatacaatgtaaatcttagatttcttatgttcattgatcctctcttcaaccagctaaaagaatgcaccccccatttttactgttttctcaaaatatgttaattttaaatacatgtttttacatatatattttcttttttgcttttctttctttctttctttttttctgagacagagtcttgctctgtcgccaggctggagtgcagtggcgcgatctcagctcactgcagcctccacctcccaggttcaagtgattcttctgcctcagcctcctgagtagctgtgactacaggtgcatgccaccatgcccagct

SEQ ID NO: 12537 - DNA, 1046 bp, Homo sapiens
aaagtttgcatagtatattgttactcaaaataatttgttggtagaatggtagtttcagtttttaactcaagtggaagaatataaatatgtcacataacctaaaaaatccagtagattttattttttttttatgtcaacatttgcttggcaattcttaagttgtattagtagattttagttaagtggaccaatagtgaaatcacaagttagtatgtaatgatttaattcttgactagaacattgtcactgttttatattttaatattgactaaaatgtataataggagacagtactgctccaaagattgtttgagtaattggagtaattaaaaatattagaaaaggaaataaattgttaaattgatattttagaccttgacagaaaacttgctgaaaaaagaacaagactatactaagttagaggagaaacataatgaagaatctgtgagtaaaaagaatattcaggcaacccttcatcaaaaagacctagattgtcaacagcttcagtcaagattgtctgcatctgaaacctcactgcatagaatacatgtagaactaagtgaaaaaggagaagctactcaaaagctcaaagaagaattatctgaggtagagaccaagtaccagcatctaaaggcggagtttaagcagctacaacaacagagagaagaaaaggagcagcatgggttacaactccaaagtgaaattaatcaagtaagagctgttaattttatttattgtaattctccctctggtttcttcttcgtgtacttgatggttatttgatcataatatagttcatgttgaaaaaatattgtcattttaaaagattaactcttaacttttatatcctgtagtgttgtcagatctcatttcttttaatttcagtttcccttaaaaaaattataatatccatcttacagctttgtggggaaatgtttatgaattgatactataaattgcttaggatggtacctggggcgtgtaggtactcactagattttagctattataattaatttgaattgttgaccattctttcatttgaa

SEQ ID NO: 12538 - DNA, 1105 bp, Homo sapiens
gcgacagagcgagactccatctcaaaaaaaaaaaaaaaaaaaaaaaaaaaaaggagtgaaactatctcaagggtgtatatagaaaggtgggattagttggttactttctaagtaagtctgtggggaagaagactctaactcattatatgccttaatttttgtagcatattttaaaaggtatgttccatccaagttctcagtgtatgtgaacatggttgcatttatgaaattcagtaacttagaattctctttacaaaagatgatttatagctggccaggcgcggtggctcaggcctataatcccagcactttgggaggccgaggtgggcggatcatgaggtcaggagatcgagaccatcctggctaacatggtgaaaccccgtctctactaaaaatacaagaaaattagctgggcatggtggcgggagcctgtaatcccagctgctggggaggctgaggcaggagaatggcgtgaaccccgagaggcggagcttggagttagctgagatcgcgccactgcactccagtctgggcgacagagtgagactgtctcaaaaaagaaaaagaaaaaaaaaagatgatttatagattaatgaataatttgcttacaaattctaaaacaaatgttttcctaaacaaaacaaatgtagaattatgtcaagaaaaatttggaattacaaagaaatgtttataaaaagataatttttctaacatagttgaatcagaagtattatttttgttctgtgattttcttggctctatgtctttttttctgtttttgttgcttagtcaaagcacacatcttgtagctaattttgctgtaaacttaatggttgctcttcttacttttaagtctgtctgtcatcctctcttataagtactctttttttttttttttttttttttagtgacagggtcttgcccttgttgcccaggctggagtgcagtggcgtgatcttagttcactgcagccttaaactcttgggcccaagcatgcctcctgctttagcctctcgggtagctaggtctataggtgcataccgccatgcctggctaatttgtttttcttttggtagagatagagtcttgctatattgcccaggct

SEQ ID NO: 12539 - DNA, 1075 bp, Homo sapiens
ataaatcttatgcattagtacaagaatttctctatgttagatactcgaagtgaaattcctgtcctgtagggcagacacgtgctcagatttactagatgacctccagctattttccaaagtaattataccagtttaccattgcccctttccccatcaactcttggtgttgattgatgtttaaaatataatctttcatagctgtgcttttccctagtaaacctctagatccttgcgccccttttatatcctgtcaaactacacgtagaaaacttctacataatttagttttgcctttgtccctctgtttgatttttaatttctttgaacccagagcttaccttctatctcttggaagctgaccaggatatgtagagtagcagtttgcaagcagtgagtgttgatgatcagtgttattatgtgtttctcaaacattaagctattaataaaggacatgatttgatattgatagctgaaatgtacagtcaaatactctagcacacattttgtgtgtgttgtgtgtatgtatattcacacgtgcacattattgaaagaagtcctgtggctattttatgattaatacatagaatcaagattattttattgtgttagaattggaacatttcttattagggaataataagaccttctactaatcttaataatgccttacataaatttaacactttgcagttttgttttgtttttcccaaagggtttctctgtttgggatttggtcaccagtcagtgcaagcccacagttgcatctgccttttcttattatcctcactatctacttctctcacccctccttaccccatgtctttggtaaaccataattattgacagtggtgattttcaagtgctttgaatttggaatctctttacttggtcatttgaaggctattacatgaaatgtcctgggcagcttttgtgggtcacaggtagtatcaacgtggataggtaacattgtaatatataatggatggaaaagataattgcttttgtgttaatgtcaaggttttcaggtttaaaccagtgttttataattactagccttgaaaacttaaaaacataa

SEQ ID NO: 12540 - DNA, 1080 bp, Homo sapiens
tctacatcctcaccaacacttactttctttttcttttttgagagtagccatcttaatgggtatagggtggtggtatctcattgtggctttgatttgcatgcccctaatgactacgttgttgaacattttttaatgtgcttgctggccatatgcaacaaaactgggtttcattgttgttattgagttgtaggagttctttatatattctggatattaaccccttatcagatatgtgatttgcaaatattttatcccattctgtaggaatgttaaattttgatgtagtctaatttatctactttcatttttgttaaggtctatttggtgtcatatccaaaaaatcattgctaaacctagtgtcatgaagcttttcttttgttttcttataagagttttctaatttttaggtcttatgtttaggtttttgatccattttgatttaattttgtatatagtataaggtaagggtctaattttattcttttatacatggatatccatttttcccagcaacatttgtagaaaagactgtcctttccccgttgaataatcttggcacccttgtcagaaattatttgaccattgtcttagtctgtttgggctcctataataagatactataaactgggtagcttataaacaatagaaatttattttttactattttggaggctgagaagttcaaaatcaaggcactagcagatttggtgtctggtgaaacattgctttctggttcatagatggtgccttctcactgtgtcccacatggtgaaaagaacaagagacctcactggggcctcttttgtaattccattcatgagaactcaaccctgaggacctaattacctctgaaatgccccatctcctaataccatctccttgagggttagagtttcagtatatgaattttggggggacacagacattcagaccatagcaacaatatatgcaaaggtttatttctggctctctattctattccattggactctatgtccatctttatgctagtaccacactgttttgattactgtagctttgtaataagttttaaaatcaggaagataagccttcaacttt

SEQ ID NO: 12541 - DNA, 1042 bp, Homo sapiens
aattttatgttttaaggcaatcttagagctttgaagacatgctcatttttgttttgctaatcatgcatagcttcaaccattttaaaatgattatttacttatagttgtagcatattaaaacaataattttaattctaatgcaccagcaggatgtttgcttgaaatatctttccttattttgtaaagttttttagtaaaaattcagtattgaattcaataacatttcagaaaaccaaggaagtgcaaactttttataggatctaatatattgtttccttggaaataaatatctattatctctttggaggtataattactcattcctttagtgagtctttttgggtcttccaagtgtcagggactactttaggtgtggggattaaaatactgaataagacagaatgcttgctcccataaggcttaatcctttgtggaaatcaaacaacagactgtacaagtacactgaatcatgatagaaagctaggtaataataagggctgcgaggaagaaaaataaagtgcatatgggcggtagtggaagtgggaatactttagaacagttttagagttgtcggggaagatctcatggaggatatgtgtgagaagaatgaaataagcaagagtcagagttaagcagtgggagctaggattcccaggagaaggttaaagtccaaggcacatacaatcttggcctattagagaagaaggtcagtatgaatagagatctttgaacttcacccatagtgatatctgaagagggattgtatttactttttgtcttttgtaattattgtctgtctttaatctttattttttccccaaatataaacataatatgtgattattgtaaaagattaatgattcataatgtgcaatagaaaaggggaagcctttccagaattcactctcctcactcctcttcttcataactaaagttggcctctggatgtataagtcttcccaaatctttccttattgtccccttgagtaaattttaaagtttcaagtgctggaatttatctatataaaaattttagttttca

SEQ ID NO: 12542 - DNA, 1044 bp, Homo sapiens
ggtatggcatacctcagtgtgatcattagctttctggcacacttaggtatctggagcccaaacctgaaagtggagccaatagtcaaaaagccacagttgtgaagattaaatcgtgtaatagggatgtagcttctccgaggaacactttttcatttgctttctagttattagcagaagttgagacacaaaagagaaatgacaggctaaacattatatgggtacatgtactgttgcactaaaggcatatctactagtgttgtacaacagtgggtaggagatctaagaatgccaacagatggttttgaagaaaaggagaataacagcagctagactaacatcctgactgggagcattcattcattcagaagacaatgttgagtaccatatctctggagcctaatggcattactgtattctgatgtccagaggcacatcctcaatactaccgtttgctcatttcaggagtttcataggagattattgcatttatcacctgttgtgcccctgcccttcattctggctctgtgatcagaacacacctagaagccttctgtttcctaaatgtaacatgactattcatagtgtttcctgcacctttgtttatgctcctccatttgcttagaatgcttttctctctgccaggtaaactcctatttattctttcgtactgaattccagtgactgtgtctctctctctctctcacacacacatacactatgcagctgcaatgaggatggagatgagacacatatataatatgtatgtgtatatgtatttttgtaaagtattaactgctgccacaggtggagttggatacttctcctgtgttcctgtaattctttatatataattgtattatatagcattgtatggtaatatttgtctacatatcagtatccccaataaacagtgagccttgattctgccacataatgtgcacaaataataaatgaggatgtacattttttggcatcagcattcaaggagcagtttttttatttatttatttttagtttttacgtgctcagagtacttattgctta

SEQ ID NO: 12543 - DNA, 1073 bp, Homo sapiens
atgtatttttgggggaccttttcatttggtcatgagggatatcagtctgtaattttcttttttgaaatgtttgtatcaggttttggtatctgggttttcctggcctcataaattagggaggtataccttgaatgtttgctagaattcactagtaaaaccatctgggcttggagctttctttttgggaagtgtattgattattactcagattctctgtttctttttgagtcagttttggtgaattgtgtttttaaggaatctgttgtttcatctaatgtgttgaatttattggcataaatgtctatagcatctgtagtgatatcccatgattttggtaagagataaaatattttatccttttctttctttcctaattattcctattagtttatccatttattaatttttaaggtagccaacttttgactttgttaattttctctgtgttttgctttcctcttttattggtttctgcttttatatttaatttcctccatctacttactttggatttagtttgctcatcttttttctagattcttaaggtggaagcttaggactttaatatgcattttaaatttaatatttgtcctaaatttattgtttaagctaaattcttgccctccagtctttcctaccccaacattcaacttgctattcttttagctgtctcagaaagctgaaaattgtagaaaatctcagatattgaagctcaggatttcagagtaaacttgattcttccttttcctcatccaccatattcagtacatgataagtcctattcattttagcccccagatatatcttcagtccgttcccccaccttttttgttttttgtttttgttttttccaaaggtagctgtatggaaatttaatttttaattttcttgtagcgaggggtcttgctatgttgccccagctggtctcaagctcctggcttcaagcaatcctcccaccttggcctcctgaagtgttaggattacaagtgtgagccactgtgcctggtcttatcttcttctttctgtttctgctggtcacctagatgatcataagggtgtattatccttatcat

SEQ ID NO: 12544 - DNA, 1017 bp, Homo sapiens
actattctttaagtggaaggtcataaaggtcttcatttttgtctttatgttgagtaggatgaggaggaggaggaggaagaaatggagttggtcttgctgtctcagaggaggcagaggtggaagaaaatccacgtgtaagtggacccacactgttcaaacttgcggtgttcgagggtcagctgtaataacatatataatatatgtaatacataatgtaataagtgatattttatatcatttcattgttttcatcaggacagttcagactgtttagtacaccatattgctagaagtaaatgtctttgtttattgtttatcctattccaagctggcttccatcctcagtttttccactgaaactactcactaatggcctgtcttttactaattctcatctgtacttctttgtcctcatcttactttacttcttagacgcatttagtccagtcgactcttgctgtctaataacgcagtctttcttgtgcttctctgatacctctcttctggtgtttttcctacctcttcaactgacctccagatgttgtagtatctcagtactgcatcgcctttctttccctttcttccttttcctttccttccctccgttccttctttccctcccctcctcctctccatctcactctgttgcccaggctgattgtggtggtgtgatcactgctcgatctcccgggctcaagtgatcttcctaccactgcctcccgagtagagtaggtagctggggaccataggcacacatcaccatggccctgataatttttgttctttttttttcatagagatggggtcttgccatgttgcccaggccagtcttgaattcctgggctcaaacagtccacccgcctcggcttcccaaagtgctgggattacaggcatgatctactacactgagcccgttttctaaaaagccagtcagatttagcagtgggaggactacctcatccctgatcatgtgcctagagagagcaggcttttcttgttagcatagtctggtgtttc

SEQ ID NO: 12545 - DNA, 1043 bp, Homo sapiens
tgacaagccggactaattaaagagcctctgcacagtgaaagaaactatcgacagagttaagagatagcctgcagaatgggagaaaatatttgcaaactgtgcagccaagtttgcagatatcaaaggtctaatatccagaatctgtaagaaacttaaacaattgaacaagcaaaaagccccattaaaaaatggtcaaaagacacgaacagacacttctcagaagacatacaaatggccaagaaacgtgacaaaatggtccatatctctaatcatcagagaaatgcaaatcaaaaccgcaatgagataccatctcacaccagttagaatggctgttattaaaatattaaaaaacaaatgttggtgaggctgcagagaaaagagaatgcttatacattgctggtgggaatgtaaattagttcagccactgtggaaagcagtttcgagatttaaagaacttaaaacaggactaccattcaacccagtaatccattactgagtatatatctgaacaaaacaaactgttctaccaaaaagacatgcgcatttgtatgttcattacagcactattcacaatagcaaataaatggaatcggactatgtgcccatcaatggtggattggataaaaaaaagaaatggtacatatataccacagaataccacacaggcataaaaataacaaaatcatattctttgtaggaatactgatgcagctagaggctattatcccaagcaaattaacacaggaacagaaaaccagatactgcttgttctcacttataaatgggagctaaacattgggtactcatggacataaagatggcaacaacagaaactggagactactagaatgagaagggaagggggtgggcagtggttgaaaatccgactgttgggtactatacttagtacctgggtgacaagatcatttgtaccccaaagctcagcatcatgcaatatacccaggtaacaaacctgcacatacaccctctgaatctaaaataaaagtggaaaaaaaaaaaaagatgccaggtacggtgactca

SEQ ID NO: 12546 - DNA, 1034 bp, Homo sapiens
attggtcttttttgcaccacttgaatcactgtagttttagtttgtgtagaaaagagactattgccggctgggcgctgtggctcatgcctgtaatcacagcactttgggaggccaaggtggggggatcacttgaggtcaggagttcgagaacagcctggccaacatggtgaaaccccgtttccactaaaaatacaaaaaaaatttagctgcacatggtggcatgtgcctgtagtcccagctactcaaaaaaaaattagctggacatggtggcatgtgcctgtagtcccagctactcaggagtctgaggcaggagaattgcttgaacccaggaggtggagattgcaatgagccaagatcgtgccactatgctccagcctggatgacagagtgagaccagcctggatgacagagcaagactcttgtttcaaaaaaaaaaagaaaagagaaagcattgtcaaaggaatcagaagatctgcattttagttctgcatcttctgattttttttgctttaacttggatcttgagaactttctgattttttttcttcttccttgaacttgcatcttgaggactttctgatttttgctgacagtacaatggtggactgagcgttatggctcacacctgtaaccccagcactttgggaggcggaggtgggcagatcgtttgagctcaggagtttgagaccatcttgggcaacatggtgaaacttcgtctctaccaaaaatacaacaaattagctgggtgtggtggtgtgcacctgtggtcccagctacttgggtagctgagataggaggatcgcttgagcctgggaggtggaggttgcagtgagccaagattgtaccactgcactccagcctgggtgacagagcaagaccccaactcaaaaaacaaccaaaacaaaagagtacaatggtgaacaagtcacttcctgctttaaatctgttttcttctctacagagataacatccatcttacctgtcttaagagatgtcattttgattaaatatgatgttttgtgaaggtgacttga

SEQ ID NO: 12547 - DNA, 1032 bp, Homo sapiens
tttaactgaagttcttgataaatgaggatattattgactaagctggagaacatagtgaggaaagtaaactttttcctaggatggtaaagtgttgagatgaatgaagagtttggtttggttacaatgctttgagaaatccattgcttgatttcttagtaaacaactacaaatgtggatgtagaggtatagagtgctatattaggtctcttttatcgtccaggtgagagatgattgcaacatgaattaaggtagtggccaaggagatggagaaagggggatagattcaaaatttaagtgggcagttgaattaacttggtgattggatgtgaaggttaaggaatagagacaagtaagagtgatgccttggatttaggcaaaatgagtgtgtgatggttctataatctgagatggagaatgtagatgggtgaaagctttgagcaaagataaatgaatttggttttgaataagctgactttgtggtgctctcaaggcattcaattagatatatttggcaggacaggaaaatatgaattggaaactcagcaaaggtctggattaaagttagtgttttattattttcagcaatggtgttaatgaaaattaagggagtaaatgaatttacctaaagagtatgtgataagctaagaggtcaagtatgaaaactccctgggaacccctcaattactttacatgaattttttttcatgaaatagtatttgttatttgcaaagataacttctcgctttatctatatgttacgtttttagctcttaatagtagaaaagggttagtgagagccctttgtctatccatttagtataaggcttgcataatgtatttaaagcattgttcttaaggtctgcatatagtaaatggcttttcaaactttttgtgaaaatctttctaatttgtttttatggtgggatgcagatgaaatagagtaacaaaatcagtgttgaaagttacattttatttaattttttttttattttgagacagagtctagctctgtcacccaggctggagtgcagt

SEQ ID NO: 12548 - DNA, 1022 bp, Homo sapiens
atgataactgatccatgttcacaataatggcaatccattcatgagggtggaactcccatgacctagtcaccttttaaaggcctcacttctcaataccattacatttgcaattaaatttcaacatgagttttggtggggacattcaagcgataacagctatcttttctcattttattgcctttgttccattgtcaaagattagttgactaactcatggatttttatattatgaactcacggatttacatatgtttagcatgtttcagtcaattacagtcaatgtgttttgctgatgtgaaaatgatctcagctttagctactgggagtaccttcaaggtgacgtttgtcattttgacaggaccttatttgtgttcaaaaagcttccttgctttttggcacaataatatgtttcagatttatcttgtaaattccctctcccatgtctggaatcagccatttctctagaaaattctggttcctttgagtggggagtgatggttagagaccatagtataagcacgtagggtgcgctttgcttttgggttgtctttgcttttaagcttttgaatgataagaattattgttaagaaacagggctgggcgcggtggctcatgcctgtaatcccagcactttgggaggccgaggcaggcagatcacaagtcaggagttcaagaccatcctggctaacacggcgaaaccccatctttactaattagctgggtgtggtggtgcacgcctgtaatcctagctactcaggaggctgaggcaggagaattgctagaacttgggaggcggaggttgcagtgaactgagattgtaccactgcactccagcttgggtgagagagccagactctgtctcaggaaaaaaatgaaacaaaaacccaaatgataattcaaatttaagatataaaatggttttttacttatttgattctgtatttatatcattttttcttatactgaatatcttggttcttaacattagcaaatgttttttgctaaaatatacataaatagct

SEQ ID NO: 12549 - DNA, 1076 bp, Homo sapiens
ttctcctttggaccacagtggagggtggtgtggtgagccccggcctagcctgggcccaggcgtgggactgacactggcacagtcagccgagaaggaagatgttactcactgttggaaactttttttttaattaaaaatatgttttctgtgcaagccccactaccttattttagctatccaagaataaatccgcagtaagcttgatcaagtggtatatacacttagtttctgcctgtgctgtctctgaaatctggaaaaccttgaggatagaaagattagagcattagaaaactgtaggtgtatcatttaagaatcagttactagaataacataattcacatctcttttcctgtaagagttattgtacctgtcaacttaaatttgttttttttttttggtatagcttttttcttttctttttgaggctgatagggtgtaacaaaatgtaaatgattgaaaagtaggtgccgagcctattagttctttaccgagggagtaggataactagttcaaaggacaaaagaaattagtgaatttgtaggattcagccgaggaatgtgcggaagagagttgagtcatccagtagataggaagggagtgctcttgcttctgcctagctttctcctgaaagaatgaagtcatgtgaaacttggtcagttattagagggagaaatagttaacttctttatctgacaacctgtgttgacatttaattgtattttgcagtgttttgtgaattttgaaatcccggtaagcgatgattttggcagtaacaagggcatgtcctttactttccccatcacttccttagttcagcagtaaagacatctgtgcatgatttactttcaggctttaggagatttttcttttatcagacctggaggaactgattacctcatgtttcagattgtgtttctgtcatagttctgcaagtgaaaattagtttgcctgtggtttgctttgaagtttacaaataaaagtgtttactggtttaagggtagctcagctgtagttatagattggttttcagaaatatgggatgctttctagtaatcttggtttaaagttaaacatcg

SEQ ID NO: 12550 - DNA, 1027 bp, Homo sapiens
ctcacacctgtaattccagtactttgggaggccgaggcgggcagatcacgaggtcaatagatcaagaccatcctggccaacatggtgaaaccctgtctctgctaaaaacacaaaaattagctgggtgtggtggcaagcacttgtagtcccagatgcttgggaggctgaggcaggagaatcacttgaatccgggaggtggaggttgcagtgagccgagatcgtgccattgaactccagcctggcgacagagtgagactccatctaaaaaaaaaaaaatcagctgggtgtgatggtgagtctgtagtctcaagtatttgcaaagctgaggcaggagaattgcttgagcccaggcatttgaggttgcactgaactatgttcatgccactgtacttcagcctggccaatagagtgagaccttgcctaaaaaaaaaaaaaaaagcaaatcaactcgcttgtttaattgtttatggtctatgtccccctatctggatgtaaacatatgagggcagaattgtgttggctaactcttagtaggtgctctgtaggtacattttgaatggatgaatatgctgttaggtgcataggcacctgccttgctagagttcacagactttgtggagaagacaggtagtaagtaccttcgtgtaacaaatataataaatcaaacagcgcatgtggaaatattgtgacttcgctgggcatggtggctcacacctgtaatcccagcactttgggaggccgaggagggcagatcacttgaggtctggagttggagaccagcctgaccaacatggtgaaactctgtcgctactaaaaatacaacattagccaggcatggtggcacttgcctgtaatctcatctacttaggaggctggggcaggagaatcacttgaacctgggaggcggaggttgcagtgagccaagattgcaccattgcactccagcctgggcaacaagagtgaaacaccatctcaaaaaaaaagaaatatggtgacttataccaaagaagtgtaatttagactatgg

SEQ ID NO: 12551 - DNA, 1042 bp, Homo sapiens
tattgctcatggttatagctagtatcacatagtgatttacaaaccatgaaattccagatttaaatctgttgcactacaaaaatgtctaaatgatgtctgctaaatttgtgagttatagaagtacagaaataagtcattttcatttcaaatgcagtgaatttctaatttcatggtatcatatttttttcctttgcagttttggtaagactcccccattactttgctaagacttgctttctcaaccagtgggatgaaacgagtgccagtgtgttgactgagccttcttaggacttaaggggctctgggagaggccaaggcagcagttgaaaactgcagcttcacctggcctttgggcctgttttccctggcccacacagtgtggctggttaaaacattctgaatttgatgccaacatttttaaaaattgggagatttgcatgaaaatccagaattcgggtaacttttgaatgatctgaagatctggcaacagtagacctgacccacctttgtgcacgggacttaactgagaggatctgagtagcagacaccctaagagcatgtcattgtcttctcaccagttactctccagttggctagagtcccctccgagcacacctgctagtccttcccccttgtaagcctttgactttgtaatccctgggctaaaggaaacacattattcaacaaaagtgtttcatgtttgcccactagttgttggggatgattaggtggtgagtgaatggcatggggctttcctttggggaccatatactctaatggggaagggggacagacaaatagttgtaactctgtcatggaaaagagaagtaacttggacagacttttggattcaggccagatgaacatctccaggcagagggaacagcagcatctgcaaagtcctgggagagaagaaaagaatctgaacattaagtggcttcctgaaaatcgactgcccaggccgggcacagtggctcatgcctgtaatcccagcactttaggaggccaaggcaggaggatcacttgagtccaggagtttgtg

SEQ ID NO: 12552 - DNA, 1057 bp, Homo sapiens
cgcgggtgcagaatgaatgaaccgggagggtcaggccgggcggggccctgcgccccgggaagtggctctgggaggcccgcgcgtcctgccgcggtcagcacatgctcgcccctggttgccgcggctgcctgggtcccgggacgtgggggccccgcgccccgctgcccttgcttccgcgatctctctcttctgaatacgtttccgctcgtttatctctgcgaagtgattttactctggttggcaaactctttcagagctgttccgaggaaatagttttaacacaaggctgggggagggccgcagttatgggggattctctttctctctcctcttctctcctctcctctctttttcgtagatatgaggcctcgctatagtgcccaggcggcttccaaaactcctggcttcagagatcttcctaccttggcctctgtgggggatctcgtgaaatcttttgcccctcaattttgtgcgttttaattattaattggctgtttatgaatactgtgttttgacaagtatgtatggaaccatgacattttcgattctttgattttgtaaagtcttaaggaaatatcgacaagtcttcagacgtgagatattccttgtcatcacaacaactaaaccttaaatttttgtgtcggtttttatgaaggaaattagttgcacatttatgtgactaaatgcgccagttaaagtgactcaattgcagcatcattttgcttgatataacctggtgaacgtgtatgttaatcttgctcattcttgtgaaatctgtggggagatgcatactaagtggaagacctgttaggcttcgaggatgatgtactgtatactgcttcatccaattgcatttaaatatatctgagatgagggagatgtcactgacctaagggtgctgatgtagagaaataagacgtttttgtatggtagaaattcttagaaatgagagaagtagaacagattgtcagggagcactggagtctaataatgtgaatcttcatagtccgaaatttgttgtgtgtggatttatctaggattctgtccaaggagtttt

SEQ ID NO: 12553 - DNA, 1179 bp, Homo sapiens
agcctcgaccccacaggctctcccacctcagtctcccaggtagctgggaccacaggcatgccccatcatgcccagctaacttctttattatttgtagagttgaactcttgctatgttgtctaggctggtgtcaaactcctgggctcaagcaatcctcctggctcagcctcccaaagtgctgggattacaggcatgagccatcacacccagtcaattaagttctgaaagagtaattatctggattgtttttgttctacttgtctattttttacaagcccaaaagctcttctgtcccttgcctttggacatgtaatcacactcaaacaccaatagatacaagtccccaaaggttgtcatttcaacttccccaatccagaaaatttcactccagctccctaagattctagactcttacagaagtccaccggcagcctaggagttggggttgctgtccaggggagatcatgcttgccagtcacagcatgggcaacagagagatttatagtgaggggtaaaaagagaaatagaaggaaaccataagtgtccctttcatctcctgaccgttataccaaataggagtgacaagtagagtgtgatcacaaatagtttcatggatatgcttctttccacgactctgcagatctagtggagtagaattcatggagaaagtcctcaatgtcaaaggatgagcaggcagggaagggatgtggtagagaaaacttgatggaaaattagacagtgatactgtggaaagggccagaggagacaagggtgtgtgggctcaaccttggtggtgattctgttactgagatcttgtgtaatctcatagttattaagaatcatgtggacagacgcagtggctcacgcctgtaatcccagcactttgggaggctgaggcgggtggattacctgaagtcaggagttcgagaccagcctggccaacatggtgaaaccctgtctctactaaaaatacgaaaattaaccaggtgtggttgcacacgcctgtagtcccagctacttaggaagctgaggcaggagaatcacttgaactcgggaggcgaggtttcagtgagctgagatcgtgccactgcactccagcctgggtgacagagcaagactctgtctcaaaatactactactactactactaaaaaatcactttcctattcaatgtaccaa

SEQ ID NO: 12554 - DNA, 1033 bp, Homo sapiens
ctcggcctcccaacgtgctgggattacaggcgtgagccaccgcgcccggccgtcttttctatttttattacatatctctgctttccttctccaccacatcagtcattccaccaggggagcccatgtttacaaccttgtttgaattcttctatatttttgcccatgctcaaataatcatatagagacatatatacataaacatatacaggggcattttttgatcaatataagatcatgctaggaacacttttatgcatcttgctgtttttactcaacaaaacctcacagaaatccctccaggacaactggaattgctctgattatttctttttaatgctgatcccatagtgagtatgaggatgtactatcttttaattgttttgtggaaagaaataaagcttctgtgaacagaggttcttattatatggaggtttttctctgcctacaaagtgactagaatgttactaggcatatgataggcaggtagcaaatagcctttgaatagagctaataggtggaactgaacacaaccctagactgccgtctccataggtcagggtcaggtttatttaaacaaagacctgagattttcaggtaagccaaaggtggcaatagggtaggaaatattttgaaataatgtgatcaagagatagaatcagatggcttatcaacactattaaaataattagtccgaagttggtttcaaaggatagctttagtcaaattacgaacttcttatcttctttgagagtggtggtgagctggagagagtgaggcagtggctgtgtgggaagtctctgggaagattagggtaaaccacagtgggacttagggcgaggaagaaaacaccagtggtcgtttgggtggtaagcagttttgaaatgtaccagaccagatataaacagtgattaatttgtaatagtgagcccctagctaggtacggaagttgtataagcagcacttttaatttaatgaacaagctacttcctcccactacatttagctgaagtattatccttaaatttttataaat

SEQ ID NO: 12555 - DNA, 1027 bp, Homo sapiens
tttgttttgagcactggcagtatccctttacaatgcagaggtgcagtgtagcacaagtgctacatagctgtagttttcaaacaaaaccacttatatcattgtgcttaagtggagactgtagttacaatactgacattcgcttactggccttgtattctctgtaaacaaggaggctgtttgcaacaaccacttcaactctatttacagaagggttcccacggtatacacacaggcacaagggttggtatgctttctaaaagctgtgcatgtgccttggtctcttaaaaagacagtgcccaaagtggaacctatgtgcaaacaacaaattaacgacacagagtagctcaagcagccattttgctcccaagtcgtctgaagaactttgccagattaagccaggccccagagtgcttacatccacttgcatttcttcttttcatcaaataagacttttacatgcaagagttgtttctgagcttcttccagccctcgttctctttctagtttatttagaatctgttgacaattagaacagttattttagatattgtggttttagcgttacaattctgttttttgcatacctgatgctgtgagtggtaaaatctgtatgaaacagatgccaacattttcttccatcatttacatactcactttgcaagttgttttgctaagtccttatcacaggatcaacaataccttggcttaaaatagaagctcgcaagaaataccaactatttgcttacaaatatggggccaggcttcctaggccctgctttatgcattatgtcacagccattccaagcacagcaagcattcctgggcagccaacatgcaggcaagtatttctccttaaatgcagcaggcagggacatcctggtcagagacagatccttcccttccctcccatctgggcagtgtagtccctcctcgtgcttcccttctctcccctgacccctggaacgagggatgcttatcatgtttaagaactcattgcctctaccctaccttagagcttcacttcatc

SEQ ID NO: 12556 - DNA, 1043 bp, Homo sapiens
tctgggaatataggtggcttaacatgcaaaattgttcagtgtaattcaacaccctaacagaacaaagaaggaaaactattgtgatctctagtgtgaaacataatttgacaacattcagtacccattcatgataaaaacttttgccaaactgggaacagaagggaattttcaatcttataaatggtatctataaaaattctgcagctaacatcatacttactgattaaaaatattgactgcttccccttacttacccaaggtcaggaacagatgtctactatcaccattttgtttaatattttatcggaggttctagttagtgtaataaggcaagaaaaagaaatggagggggaggctggtcaagatggccaactagaagcagctggtgtgtgccactttcatggagagaaatagaaggagtaagtaaatacagcaccttcaactgaagcatccaggtacacgcattgggattcatcaagaaaacaacttgacccagaaagaatggagaagagcaatcaggacagtcatccacttgggagtgacacagagccagaggagcctcctcttcccagggaagtggtgagtgagtgagtgaccccagcgacccacgcttctcccttggatctttgcaacccacaggtcaggagatccccttgtgagcccactccaccagggtctgcagcctgttacacagaattatgtggagtctcagcaatgcagccgctcagatacacgtagagccctgggagctttagatacccaggtttcccatcaaaagcaactgcaactccagccaagcaggacgttagacccctgtacatacccctaggaaagaggctgtatacaggggatagagcagtgacagtctgcaggccccactaccatggcaccttgcaggataagacccactggcttggaactctagccagccactggtagcagtgttacacctctctgagatggagctcccagagggaggggtgggctgccatctttgctgttttgtagccttagctattgccttcattgcagccaccctatgg

SEQ ID NO: 12557 - DNA, 1063 bp, Homo sapiens
tgtccaaaaattcaattctgaaactatctacctggagttagagtcagatcccacaagttaaacggctcagtcccacaagactgccccaactgcagacaccagttgcaagtctgagtcacctatattctgactgactaacttaggggttcccatgaccccctcctccagtttgataatttgctagaatggctcacaaaattcaggaaaacactatatttaccagtttattgtaaaggataaaagtcaggaatagccaaatgggagaaatgcattgggcaaggtgttgggggtcggggattgtggtgcagagcctccatgccctctctgtgtgagccaccctcccagcaagtcaatgtggtcaccagcccggaagctctcaaaatctcattgttgaagagtttccagccccctccccttcttacgggtcaggggagtgaacctgaaagcattcaccatctaatcacttggtctttctggtgaccagcccccatccttaggctatctagggacctcaactctaagttacctcattaacatcaactcaggtatgattgaaggggacttgctaagaattatacaaaaaccactcctatcacttatacaattccataggtcttagcagctttgtaccaggatctgggtacaaagaccaaatatatttcttcttataccacagtcacattctgggtgcccatgaatttttgggagacattattcaacctaaaataagaactcataaagcctatgaattcttcctttatgatgcctctcaaattttcccccaccccatatttcttttcattcctattactaacatccttggtcagactgtcttccctacgaggtttatctgtattcatttatccaatttactcaacatatctgttaagcatctattatgtatcaggtacttactcattcactggaatacagaagtaaacaaagaccctgcaccatggagtttacattgtagtttgttaggagacatagaataaagaaagaaatactatcaggtggaggtgagtactaagaggaaaattgacaggagtaggctgggtgcggt

SEQ ID NO: 12558 - DNA, 1050 bp, Homo sapiens
cttgttttgtgggccaaattttaataaattaaacattttattttaatgggcgaattaagtacattcacatgcagtgagcccttgcctgcaaagatgtgcaggcgggaatgggagagatcacttgctgggatttggtattttttccttcattttacttagttactttgaggttttgggcattttctgtctgccagttatgctaagggtatggttttgtgtggctttatttgttctctttgctttttctgtattgtttttgcagaatatatggataacacagagctagacatctgctgttatcctcaacacttggaaatgctttatgtctgcttttcaaattctaatatcttagtgacgtctctaattatataaagtttgagtggcttttaaaaatcatgttcattaagtggtaggctatgttttgagacagagttcttgatctgcattacttaggaaagaattacttcaggcagaggtatacttattacttacttaggttttataactttatttaaattgttagtggctgtgattctaaaagcatgaatctgtaatagattttaagaaccaatcttgtctgtccttttgcttttagatgggtacattttttaggacatattcaagacaggtcgtttttaaatctctctttgacagtctccagaaagtaggggtagaccctccccaggcatcctactctaatgttttatcctatgataatcccacagtttggccagttagaatcttttctgttagaatttaagcctgtttctcctgctttgggtttctgttgccatagtgataaaatgttcagcattctgtcattacttgaacacaataatgaacttgacccttaggttttgttttgttttgttttttagttttttgctatataaaacagctttcattcctttagcttttcttaaatgtgaataattttctattctgttagtcacattgataatttttctttgattcctctggagtttcacttacaatgtgtaaatgacctcaacttattttaaaataaagacatagtaaccaacataaaat

SEQ ID NO: 12559 - DNA, 1052 bp, Homo sapiens
ttctgttgatcagtgccggctgcgggcattgcagttttcaatgcatctcatcgatttgctgagcatacttatcaaatgtaatggtttccctgggattcagaaagctgtagtagatcagaccggcagcagaccaccaaacagtgaccatgagcctttttggcacaagtttggcttcgggaagtgctctggagcttcttctccatccagccactgaggtggtcattgccggtagtcgtatgaaatccactttttgtcgcatgtcacaatctgcttgagaaatagtttgttgttgcatagaataagagaagactacacttcaaaatgacgatattttaaattttcactcagttcatgagacacccacttatctagctttttcacctttccgaattgcttcaaatgccaaatgaccataaaatggttgacattgagttctttggcagcttcttgtgtagttgtagaggatcagctccaatgattgctctcaactggtcattgtcaacttctgacggctggccactatgctcctccttttgaaaagtagacctcttttttttaaattttttttctgtttcaatgcttatttcccctttgttattttttgttctatacgtgtgctttctttctttcttggtcaagtcagccactgctttgtgtatatatatatattttttttgtggtaaaatatacataaaatttaccattttaactattttaaaacatacagttcagtacattcatttaaattaggattttggtttatttattagatcgactggtttcccattttctaactcattaatttctgcttttatcttctggttctttgcccttaaaaagtttctatagttttattgttatcatttaatgtacctaaaataaaattcatccattttgtatacagttgtacaatcctcaccataataaaaatatggaatagtttcatcaccccaaaagtttctttatgtctctttatagttgacctcctttcctgagtcccaacattaggcaacccgtgacttatccatgctctgagtgtatcagtagcccat

SEQ ID NO: 12560 - DNA, 1057 bp, Homo sapiens
tttgaggtgtcatgttttctttttcatgtttcttttttttttttttttgagacaaagtctcacactgtcacccaggttggagtgcagtggcacaatcttggctcactgcaacctctgcctcccaggtttaagcgattttcctgccacagcctcccaagtagctgggattgcaggcacccaccaccaagcccaggtaattttttgtatttttagtagagacggggtttcagtatgttggccaggctgttctcaaactcctgacctcgtgatctgcctgccttggcctcccaaagtgctggaattacaggcgtgaaccaccacgcccaacttttttcatgtttcttgtgtccctatgttatgggtgcatctggtagaatagttgtctctttctattttatggagtagcttttgtaaagaaggactttttcctgtatatttgtcctgcagtattgtttgggtagttgctttggctttgtttctatattagtacagtaatgtagtctccatatgatctttggctgtaattcgtgtcagcagtgtctgcaagtacctcagtggtctctgctgtgagtttttgtagaatgaatctcatgtctttggtgttgataggggcctctaggtggaacagttctcaggccttgggtgttgggtgctcattgggtatggtggctttgccagttgtggggtggaattgccagtggtggctgttgccatatgggcccatcattggtccctacaggtatgtggggtgcatttctgcttcaccagttatgggaatgggattgctggcagtggctggcagctagttcttaaaccctagggactgcatgcaccagtgcccttggtcttggaggtggcctccctgctgtgctagattgcttgttcctttaggtctactatatcagctcaggttctggagttttggctttactgctctgtgtagctgaggttgtggtgttggacccttttatttgattgtggcatgattacagtgggacccttcagatatggaaataccaggtctgttgaaccccatggcagcatgtatttcagcatt

SEQ ID NO: 12561 - DNA, 1049 bp, Homo sapiens
tttccctcatcttttctcatctatcctgccccatgtgagattaatctcattagtttctggtttagacttcctacattttttgtttgtttgtttttgttcctcacaaataccagatgtcattgtatttttccttctttcttatcagtgcaccctggaaactgcttcagattagttcatagggattagcctcattcttttttatggctgcatagcactccactatgtgtatctatcagtgtttagtgaaatagtctcctatgttcatttaatttccaatattttgtctttttttttttttttttttcaaacacagtcttgctctgttgcccaggctggagggcagtggggcgatcttggctcactgcagcctccgcctctgcctctgggattcaagtgattctcctgcctcctgagtagctgagattacaggtgtatgtcaccacaactggctaaattttgtatttttagtaggggtggggtttcaccatgttggccaggctgctgtcaaacttctggcttcgggtgatctgcccacctcggcctcccagagtactgggattataggtgttgagccactgcacctggcctccagtattttgtgattacaactaatcaataatgttgtacatgtaaatattttcattttctggaggtgtatcttcagggtgaattcctgaagtaaataggtgggtcaaaaggtaaatcatacgcagttttgttagatattgccaaatttccatccaagagaattatatcactttgcatcttagtgtagtttaatttgcatttctcatattacaaatgagattgaacaatgttccatgtgtttaagggccatttttatatcatttttgtatgtattgtttgttcttgtctttccctattatacttggtttttttggccttttttcccttgcttaaaaattttttttaaattaccttactttttaagagttctttatatattaggattatgctgcagatattttctgccagtgtgtgtcagcagtcctttgattttgcttccgttatttttttgccatgcaaaa

SEQ ID NO: 12562 - DNA, 1085 bp, Homo sapiens
tactgttaggaagcaggatgagaacactccagggaattgcatgtgttcctggttagtcagtagagatgatgctgcacgtattcttcaggttggtctgttgagttaaactatcattgtaatatttaattagatgttaaaatgctgtactaaatattacaataaccttacatctcttttgaatttgttttacttatactaaattatacatttaaaaaatctatattttgaaaggtgtgctacattcttacatgttattttatttaagtccagagatcaacactttcctcatactatacactttatcataatgagaaccagtgaagaaataagattaattgaatggtaatttactttttggatatcttttcaggaatgtactacttctgtatgtaggatacttgttatgaagacctttccaaattcatttgtatttctgttaaatttattttttacttttagagtggctatcattataatgtaatttaaaattatatttgtaaaagtgactattggagtgagtacgaattttgtttataaatctatgataaatgcattctccctttaggaggtagaaaagtatagagctgtatataataagcttcgctatgaacatacatttctcaagtcagaatttgaacaccagaaggaagagtatgcacgtattttagatgaaggaaaaataaaatatgaatcagaggtaagtgattgattatacgagtttctttgttattgttctggtcaacacaattttataattatatatttttaaaaatttcaaattagagtcgattgtatagttttattcattaatggtggagtattcatcatgattttcatcagcttcgtatcaacagtttttttgtgaaagttctgttttgggtgtagatcttttaaattctatttatcctttattttgtccagccaatggagatagacaactttggggagtttcattgtacaaagtcttttgtcttatgtagccacagagatggacttctctctgcaaatatagttagtgtgattccttacttagcattgttctttctgcttcttggaaccaaaccacatatgggaaagcactagct

SEQ ID NO: 12563 - DNA, 1055 bp, Homo sapiens
tttggaaacagttttatctttctgggtcttgcttttaagatttaagtgggagcagagtagtatttagtgtagtgctaattatttcccaccactgaggcaagactcttctgagtagtataacaatttctttatgaaacaaaggattttaatctgtttttggggaacagaaactattcttaggtctttgtgagctctgcgtattcatccttctaatcctttcaggtgtgtatttgcctagccttaggtagtttccttgcacacatgtgttaatcagtactctactgaatgagtcaagactttttgtaggtcttcatagttgtctttctgtgccctcttttctctgctaccctgtcttaggactctaaccaccccactgtccttggatgctcagtttcatctcctcaactcagggagtccctcatgactgcataggtatcctttccggtgccaggtcctgaaaactctcaaagcttatcttctatgttttgtgtctctcagggatctgccttttgctttcttatgtctagtgtcttgcaaactgtttaatttttgtctgttcttttgtttgtttcaggcaagagagcgaatctgggctcttattctatcttggctgaaagtggaaggctttttactttcagtttaacttttggttttggaaatctcaaacatgtaatgcattcccatgtacccatcatccagcattaataattattcattctgagccaggcttgttttatctactactttctcccacccacttccacttttttcctcaatgtttctggattattttgaatcaaataatattctttcaacaaataattgagtatatatctctataacaaatcagtgcagtctgtcttaaaagcataatcacaatacctttgccatatttaaaatacttattcattaataccttttaatatcccacctttgttcagattttcttaattttcccatggttttgcttgcctagttttgaagttagatcatttgaaacaggagccatgtaagctttacctattaatctcttccttttaattgctacctcatct

SEQ ID NO: 12564 - DNA, 1031 bp, Homo sapiens
tatgagtggaagctgtgaatgctgaacccaagatatttgagagattcttcaggtattgcaaatttaattattctgtttcatgagagtgacatctaaatgtgattatttgtaccaagcacatccagaaagtaagtaaagcacatccagaaggctggagtagttatattaattcagataaaagagacttccagacaaagagtatcactaaagataaaaaggatgtttataatgaaaaaaaagggacagttcttccagaagatgataacttcaacaagtaactatgtctctatgcctagttttctcatgtggtaaagcggataaaagtttctgcttaacaagagttgtgaggactaatgagataacatctacatttttactgccatactttccacatagtaaatattcatagattatgacatgtttatttgaattcaggctccatgaaggcaggaactttttttcagtgtgtcttcagtgtttaggataatgcctagtaaacatctatttgttgaatgaatgacgtgaaaaattgaaataaatgaatgaattgggattgttgttcatatattgcactgtctgtgtcaaacatacctacagcctcagcatcttagagttggtaatcatctagtttttctttgaatctattatgggttgagttgtatccccaaccaggatatgttgaagtcctaactcctagtacctcagaaggtgaccttatttggatgtaggttcattacagatgtaattagttaagctgatgaggtcatattggagtatgatgagcctttaactcaatattactggtgtccttaaaaaaagaggagaagagagatggagacagatggggtagagaggagcactatgtgatggtggaggcagagatttaagtgctccagaagctagaaagaggcaaggaaagtttcttccctgcagattttagggggagcaaggcctgtcaacacaccttgatttcagactaatagcctccaaaactgtgaaagaacaaacttctgttatttaaagctgcgtcg

SEQ ID NO: 12565 - DNA, 1035 bp, Homo sapiens
aattcaaacttgattatgtggatgtccatagtcaacaggaaaacaatcttggaaatttagaaatccacctgggcatgatggtgcactcctgtagcctcggttacttgggatgctgaggaagatcactggagccccggagttggaagccagcctgggcaacagagcaagaccttgtctctaaaagaaattaaaagaaagaagaaaatctagaaatctctaattagcaagacttggagtttcagttatctacaagtttcattcactcatctagaatacttcccttagtgtcaattaaatgagatgttactgaccgttcatggaacttcgtcttttattaaaacctattcttaaaggaaaaggaaggggaaaatgtaaccagtgcacatgtttgctatggtactttcagctttagcgcactgtcttaaacttttgatgttcctagatttagttattttaaagccctgtgaaaaccacaaggattgttctcagtatgcgaggtcttagggtaagttctgagtctgtgatctctgcaactaaaaaaccaatccctaatcttatacctttctgctaaggtcgtaatgattcacagaagttttgtagaaaggattttgaaggagagattagtagactcagcaatggaacattaaatcctttataggccaggaagtaaccacagaacgttcttcagaatgttagagccttccttaagtatgattaacaaacacagggacaagtggcttgtcttttttctaattataacacactgtttttcaaacaggattatggtcatgaaataaatttgatgagtaacaactatcactttatattcttatatggaaaagcagaaggaacatcacagcaaatactcatctaccttacccagattcaacaatttaaaatgttcttattttctttgtttgtgtttgtaacctgttaaaagtaagtgatatacagacaccaggtccctttcttttttcttctcttttttttttttttttttttttttttttgagaccaggtctcactctgtcaccc

SEQ ID NO: 12566 - DNA, 1035 bp, Homo sapiens
ttagctaccagaaggaatgaaacagaagtggggttttccttgactcgtcccttcacccccacatccaggtggtggcaagtcctctcattccacctccttcatagacctctcacgaccaccctacatccagccttcaccagctcttgccatagattgctgcagcaggctccaggctccagttggctccatggaaatgcattttccatcttgctttctcagaaggacttgtttaaaacaggatgtgatcatcctaatcctctatgcggctgccaagggacctacaggatgaaccccaaacacctctgtatgagttaagtgggaccctccgggtgtgacccatctgctgtcccagtcttcaactgcaccaagtcctccaaatctttacttctctgtctaactgattcaccttctgacaagcctttctgctttccattgactttttcccctccccctttcctcttatctcccccttagcagctccttccaagtgctcgcttagcaccaagtactctcctgacacttatcagtggctgtcattgtgtctctcccccggccactacgccaggaggcggctatgcccctttgcctccccagcacgcctcgctgcgcctgacactaggaggcacccagcaagtgtctgtctcatgaatgaatcaacagagagtctcctgactgctcactgtctttaagccacttcccttcccttggtgctggctggcccctttgctctgccttcatcacattggtgtttactgtgcccagtccactgctggcatttgctctgcctaacaaggtttgttgagccgagcccatttccttattggtaaagagagagtaccagactgaatgtcctcttgcaatcccagagtcggggtgattgatagcaggcgcccttctagtcgacctccctgcaaagatatagaatgtggatctcttctgctgactgcacaaagagcccatttgtacagcaatgtgttgaatacggtgcattattactgacatttgtattgggtacagtgcagggcgtggagtttc

SEQ ID NO: 12567 - DNA, 1027 bp, Homo sapiens
gcctcataccacctgcactgttatttgcttgatatttctaaatcagttatctccttaaaacttacatttattttcaaagtatcagtgtcattattctagctatatatcttctgagtttgaggcctcccagcagcagattaagaagtagattagcactgggtgtggtggctcacgcctgtattcccagcactgtgggaggccaaggtgggtggattgcttaagcccaggagtttgagaccagcctgagcaacatggccaaaccccatctctacaaaagatacaaaaattagctggacttggtgatgcatacatatgctctcagctactcaggaggctgaggtgggaggatcacctgagccctgggaggggtgaggtgggaggggtgaggctgcagtgagccttgattgcatcagtgcactccaacctgggtgatggcgagaccctgtctcaacaaaactagttagcaagtgttggagcaatgttagaaagtttttagcaccaaagacttttcctggactgaatcaactgaattggattgaggattgaaaaggaaataactcgctcactgtgattctatgttatttaatgcttttgtcttatgtcacctaaaataattcagaatcatctaggaaaaccctggtcttaatgtatcatctcctttcgttccttcatgaaatatttatctttagacccatggtctagaagatgcttagaaacatttttcccactcatgggttgtgaaaatttgagttagtgagtgttttccttttttattttggccaacaggaacccagatccaaatttcagcagaaccgagtgagatttttatagcctgcttctttttcttttcttcttcttttttttttttttttcttacctcttgattttggcttccttttctaatttatatttttttctggcctggtttcaatgtgtgtgtgtgtgtgtgtgtgtgtgtgtgtgtgtgtttacatatatgtgtttcctgtaatctatcttaaatccttgtataccaaatgaggtactc

SEQ ID NO: 12568 - DNA, 1029 bp, Homo sapiens
actctgtctttaaataaataaataaataaataaataaataaataaaacaattctactgacaatgttattgtacctgctgccttgtattgttagcatggagatacccgatttttaaataagctgtgtattaaaactgagttagacattatatgtgcggattatcgtaaattagcacattgggccagtcagatctagtgaagagaggaaatcagagaagggctagaacttcagcagaccgtaatcacaaattctactacagtgatgctggacttcttgaggtcccagttgaaacttctcagctatctgcttttaggttttttattgttgagacagcgaggaataggtagaactagtgaaatttttgtaaactcataataataacttttctcaagcagggttgatgtaatttcaagtctgtcctgaggctacaataagtctgttgtaatgaagggaaagcaacaattttactgtgcagaaagtattcatccatttaaatgatcgtagctcctgtattgtggaactcacttggatgcagctgtaaagatatgttttcctgacacccagaacgtatgtgatgcgagaggaagacatcgagtgctaatttcttgatgtcaccatctccttgggaggaaactagtataggatttaaaaagaacccttttatgaactcatttggtgaattagctcccctaaaaatgccaatgagaactagggggtcatgggaagagtcgactaatctttcagggatatggagtttctgcctagaagtgggcaaagactccatgagatgaagttcttagttactgaatggtcattttttaaattcaaaatcaatacctgttgagataacagggaaactacatggtctgtcttgctgggcttatttcagcctttgagactggaataataatgaggcagtgtactctttcaacattgcagaaatctatttttacatctaggtggactgacctagataacccctccccccttagtgaaaatgtaagtaatgaattctgtgattgttgctaa

SEQ ID NO: 12569 - DNA, 1023 bp, Homo sapiens
tacacacacacagagagagagagagcgagcgcatgacactgagtgataaacagtaaagccattcagaggaaagctgctggataaaatggaagcctgaaaacattcccacagtaaaatcctaccctgtgtttcgttaccattaaatatcctttcagagttatctctaagaagcccacttggagacatctagactttctaaaatttaataatgtctccaatggaaataacattacatgctaattaattgtcatggggtaacattattcaaattggtaactgtaactcccaaagattacattaagtttgatcagtgggcacagctgttctctgagaaataaattcagaaacttatttctgtctcttcttcttttgaccaaaggaaaaattaagtcagtgaccttggtaggtttcttattttgaacaatgtgtatgagattttgtgctgtcatttctaaaagctttttaattcaggttagccaaaaatctctggaagagggtaattttttcactggaaaattcgagtgtcatattattttcaaggttaccttgtattgagctgggttttttgtttttttttttaatgtctcagagcttcagtttctaaatctgtaacatggaaataataatggtacaacatcttagtggtagtagaagaattacatagtgtctggcatgcagcaagtgctcaattattgtaactctgtatgtttgcataataactccaggtgtatagcattatatacacaagttatcttggtttctcacctcctatttacaccatatttggcacatactaggcatcaattatttttttgcctaaagtcccctattttgtgggatcgaaaaatcaaatcaattgaactcatagacatagagagtaacaggatggttaccagaggctgggaagggtagtgagggttggcggggaggttgggattgttaatggatacaaaaaaaaatagaaggaatgagacctactatttgatagcacaatagggtgactatagtcgataataatttaat

SEQ ID NO: 12570 - DNA, 1022 bp, Homo sapiens
tgtcaattttatggttgcaatattatactatagttttgcaaaaacagttgagggaaacagtacaatgtacaagggatcactgtattatgttttacaactccatgcaaatctttaattatctcagcaaagttttcaattaaaaagacaaatgaattaaaaggacactgaaacactggataggtggaaagatgtgaagaaaacccagctgattacatcccacatgtaaaggaactgacctcaaagcaactgttagtactctttttttttttttttttaattttattttattttaaagacgaggcctcgccatgttgctcaggcgggtctcaaactcctggcctcacgccagcctcccacctctgccttaaagagtgctggagttacaggcatgagccaccacgcctggccctattagtaaatttggaaaggttatagagaataggagcgatcctaaaaaataggaaaatgcagggtgttgttccactttttcacaaatggtctttgacatttcatgtaaaccctgacaagtttataatagatcctcaaatatttgtcagcaattggagaagaataaagagatcaccaggaacccataagggttcgctaacaacactcattatggtaaccaggctcagggaacaatatctagatagtgaatctcagtttcagcaaagcagtcacaaaactcctcattaaaatattgaaaataagattgtatacttatttggagacagtcaagtggatgatttttgccagaaaatgttgattctgttggttttagaccaaactaaagtaatgcctgtaataaagagccatgttattagtaacttggataaaaacaaagaagactttatcaaaaaatttgcagctgggctgggcgtgatggctcacatctgtaatcccagcactttgggagactaaggtgggtggatcacttgagcccaggaattcgagaccagcctgggcaacatggtgaaatgctgtctctactaaaaatacaaaaatattaacctagcattgtg

SEQ ID NO: 12571 - DNA, 1050 bp, Homo sapiens
agcctcctgagtagctgggattacaggagtgtgccaccacacttggctaatttttgtatttttagtagagacgggttttgccatgttggccaggctggtcccaaagtcctgggctcaagcaatctgcccgcctcagcctcccaaagttctgggattacaggtgtgagccaccgagcccagccccagcactattattaatagcactctctttcactctcaaaaatgtcccgatttggaccatcaaagtatgtggcccacccttctcacagttagagaactgagaatttatccttagggaagtgggaagccattgaaaattttaaacaaatgcacattgtcaaaagttatttggcttgatttgggccacttgaccttgcgcaataaaaagatcttttgtttgactcggaccatcaagctcttggtctccaggatgactggaaaagatatcagaactgggaaaataaactcaagtgctggtcagcagcgtgacatttgctgccacaggacagcagtattatctgtgaacctctgtgtacacatatacctagaaacagagccagtgtctgatgatcctgtgaagtggaaacattctctttccttagctgaacttcgaagagttcctgtgttgtctggaacagttataggtctgtctcagaaaattcaggaagggtggtggcttttcctttcctttctccctgcacgtgtgagcgtccatacatgtgcgcgtgtgtgtatgtgcgtgtgtgcgtgcttccccatatgcaagcccgtgctcaactccctttcctgatttgactttctttccccagttgattttctttgctggtcagagcgagcagttggcagacacttatttatcggtctcatgctttcagccaaaaaaagacaggagaatttaggaaaacccaagactcatgttttacattttgtgtaggatgctttcattgcctcagagacacagattcgcccctttgggaattcctttactcttagttattatttctgtcccattttgagctctcctgtctgctgttgggtaggtggaaagat

SEQ ID NO: 12572 - DNA, 1033 bp, Homo sapiens
acacagcctttgtggtaaactgacctaagccagtttagtggttcacagctaataggttatgtatggttgataccaggagcctccagtgatgacagatctctactccacaacctctgtaagggtgaaaggagaaagcaagagcagttctcaaaccaatcctgctacggggacaaacatgcatgaccaagcaggcacacagcctgtgctgtaaactgcgctggagaggcccaagctcccagctttcagccgcttagacaaacaccttgcatgaaaggctctcctgtggcctgtgcagcagcagtgttgtagccatagcattgagctaactttacttagagtcacgcaggccacagaatcctccataacgtaagactggagggatggaggctgctggcgttgctgaattctcacaccctggtcataagaaggcggagtggcctgtacagcatttccagctgatccatatacagcaagtcctcaaatgatgtcatttcaatcggtgtcatttcatgatcaccttgatgagaaagtctgttcctggctggggcccctgtctgtgtggagtttgcacatcctcccacatctgcatgggttttctccaggtctcccaatttcctcctacatcgcagagatgtacatgtttggttaactggcatgtggtcccagcctgagtgagagagagagagcgtgtgtgtgtgtgtgtgtgtggcaggggtgtgtgtggtgggggtgtgggtctgagtgcaccctgctaggggatgtatcctgtccaggatgggtcccaatgttgcagcctcagctgccgggacaggctccagctacccttgaccctgaaacaggaataactgggcaaataattatcttccttgtgtttattaaccttacttaaatgtatgtatagctcacatgtatttcagtgtttaatattataaatgttttggtttttatttagaagttttgtgattttttttgtgatcagaaatatgccataagaacttagctcttgttgatctcaattagcctgtggcaaaat

SEQ ID NO: 12573 - DNA, 1029 bp, Homo sapiens
ctctagcagccaacctcggcccttactgtaatctgaaagtgccatgcccccgaaatccaagttgctatttggtgtgctgtaatgattaaatattcatttgtctaacggattgtgtgatttcacagtttagcgatactctctagatgaaataattggccaaaagcaatgttgggaggttttgtttttgaaaaatgtttattgaatgtttcatatgtgccagatgttattctaagtacttttcatctccttaactcagttaaatttcaccacagccctgtgaagtctgcactactgtcccctggatttttatctgttttgtatattcccatatcccagtgcttggcacataaaagacactcaatatttgttggacaaatgaatacataaatgaataaatctcatatggctagacattttggctttccagataacatcatgggagttggtcctgtggtagatcctgtgtcaacagcaaggacagaaagacacagatgttccaattctggtttagaaaaaagctttcagaactaactgcattattactctgatggaagacttcctttttaaagcaccaaaatatttcagatgttatacttggcctagatagatgttaagtggaaattgtctacatctggtaagaaatgggttaattgattagattctgaaattgagtaagtagtttttaaatttttttattgctacagccatagactttggtaggtcctcattggtgccacttagggtatctagatgattgtatgattatagtaaaagccagtatttattaggctttacctatatacctggagcgattttcagtgttttacaggcattaacattttaataacccatgaagtaggtactattattatttccattttacaaataaaataagtaagtgttgagagatggaccaacatcacatacctagtaagtgatagaaccaaattcaaacctggttaggctagcccagagtctgtttcttaactattatactctaatgcctttgatatacaaagtacttggaga

SEQ ID NO: 12574 - DNA, 1043 bp, Homo sapiens
agtaaggcgggcggatcacgaggtcaggagttcaagaccagcttggccaacaccgtgaaaccctgcctctattaaaaatacaaaaattagctgggcatggtggtgggcacctgtaatcccagctactcaggaggctgaggcaggagaatcacttgaatccaggaggcagaggttgcaatgagctgagattgcactactgtactccagcctgggcaacagagctagactccatctcaaataaaataaaataaaataaaataaaaggaacctgagaagtactatactatgtcagagatccatggagaaggtttgtgagtccctagagaatggctcaaacaacactgtctggaggtagaatcagggaagttttcacctaaggagttgcagctcagctgagtcaggggtacacatccaccagggcaagagaagggccaagcagacagagatccagcgtaagcacagacacagagagggtgccgagcgaggcaggaggaatctggtcactgctctttggaagagctggcagagtagggtgtggaatgacagcagatggaggccaaattgttaattaagctgttaagaagttgtgatgcccatcctggttaacacggtgaaaccccgtttctattaaaaatacaaaaaattagctgggcgtggtggtgggtgcctgtagtcccagctactcgggaggctgaggcaggagaatagcgtgaacctgggaggcagagcttgcagtgagccgagatcgcgccactgcacaccagcctgcacgacagtgcgagattcggtctcaaaaataaattaaaataaaataaaataagaagttgtgatgagccactgaatttttaaaaattcttaagagatagggtctcactgtgttgctcaggctggtcttgaactcctgggctccagcaatcctcctgcctcaggcttgagccactgtgccaggcttgaatcttttaatcaagggagaaacatgatcagatttgttttagaagggtccagtttgggggtaccactgtaaagggtagattttttttctt

SEQ ID NO: 12575 - DNA, 1065 bp, Homo sapiens
tgagtagtattccatggtgtatatataccacattttctttatccactcgttcactgatgggcatttaggttggttccttatttttgcaattacaaattgtgctgctataaacatgtgtatgcatgtgtctttttcatgtaatgacttctttttctttgggtacatacccagtagtgggattgctggatcgaatggtagttctgccttcagttctttaaggaatctccttactgttttccatagttgttgtactagttcacattcccaacagcagtgtaaaagtgttgtgttttcaccacatccacactaccatctattattttttgaatttttaattatggccattcttgcaggagtaaggtgctatctcattgtggttttaatttgcattttcctgataatcagtgatgttgagcatttttttcataggtttgttgactgtttgtatatcttcttttgagaattgtctgttcatgtcctttgcccacgttttgatgggattgtttttttcttactgatttgtgtgagttccttgtagtttctggatattagtcctttgtctaatgcatagtttgcaaatattttctcccactttgtgggttgtctgtttactctgctgattatttcttttgctgaacagaagctttttagtttaattaggtaccatttatttatttttgtttttgttacatttgggttcttagttatgacttcttgcctaagccaatgtctggaagagattttctgatgtgatgttctagaatttttatgttttcaggtcttagatttaactctttgatccatcttgagttgatttttgtataaggcaagagatgaagatccacttccattcttctacatgtggcttgctagtttttccaacaccatttgttgaatagggtgtcctttccccactttatgtttttgtttgctttgttgaagatcagttggctgtgagtatttggctttatttctgggctctctgttctgttccattggtctacctagctacttttataccggtagcatagtgttttggtaactgtagcctcgtagtataatttg

SEQ ID NO: 12576 - DNA, 1034 bp, Homo sapiens
gcctcagcacgatgggaaatgaaggcgggagtacaggcggcacggagctccagctcctgcccgtcccgtgggtccagaaaactacaattcccaatatgcctcgccgctcacgcccccttttcgagcccgcttattggagaagagagtgagcgtgtaagcgagagaggcgggagcgagctgaagctcgagccctccgattggaggaggctagggcttttgtctgccttttacggccgcgactagcagggggcgcccggagcactgctgatttttggagcccgagaagggcacgcgccagcggagccgaagagagcactgctcgtgcccgcgcctggctgtcagcctgccgctctgcggggcggtgctagtgctcgcccgcccgaccccggcggctcgcgcccgggagcgccgcagggtcgctagagtcggccgcgtcctttgtgtggcgctcaggctgcgccgcggggcggcgggacggaatgtgggcgctgcgggggcttttctctcctacccgaactgtgggaacaatggactgaaaggggaagatggattgaggggccgagcggggaagcgagctgcaccggggaatcatgacttctgcagccggtaagtgacggcgctcgcgctgccgcgggaaagtttgtggcgagcgctgctaggcttgggctcgcgagcaactttcttcgccggggtgggcgagttgtgtgccccgtacctttgccgagcacctcggcaagcgcggagctaatgggattcgctgccggctttctcgtcttttcctgcccagaggggctgtttggaaacccgggatttctcgggatctcccttccaagggggactgtgctgggggctctgcaccaggtgaaatgcgatgtgtgaagggcgttcgctcatctctccagcagtgcgaggacttcgcctttgcatgtgaaaatagtgtagattcccaagttaatagatcagttattataggtaaaggcagtgttctcagcgtgttcaatttggccactaagtgagtcgctttcaaccttgta

SEQ ID NO: 12577 - DNA, 1024 bp, Homo sapiens
gtacttctaaatactccagtccttttccatgcactggaggagaggtaagggcacctgtttaactctacactgtaagtaagatagaaaaatgttaccagcccgcatttttttttaaagcatgaagctatacttgtagcaacatgaatgaaattagaatttttcatgagatttatttgtcataaattatttcttacccttacatatgaatgtgtagtcattttcaagcagattgcccactggctgggtttaagtcagtattctaagattcaaatttttcacatataaaaaagagcagacacaaatcatcactctagaggctcctcattgcttcagttctcgggactacttactgtgcttctgaagggggaagagttactgagacagtctgttcctggagcccacacgggtatcttcctgatagtgttaatataaataggaagtaaataaaaacaaagccaagaaagaaaaaaaaatctgtttgacagaaggatacttttgtatgacagtagcaaacaaatgaaagtagtttcttttaacatacaaaggttcttctgggctcacagacacatgaatttcagcttaggccatcttaaactcattctgcaaaacagcctcattagctactgatccaatttctatgtggaatgttttctctttaatattcctttctcctaagggagaaacaggtctctttttagctcttcttaacttatgtggcaataccttgaaaggctccccccaaccctcaggtgtatgagaacagagaaaactgaataaaagcagattaagagaatataatacttcaataagtagatgaagaaatactgattcaggaaaaagagaggagagtataatcattctaattctggtccatgtcatgaatatacagactagataagtggctttcaactaggggtgatttttggctcctcttccctggggacattgggacacttggaaatatctggagacatttttgctagggggaggaacaccactggcatctagtgggtggaggccagag

SEQ ID NO: 12578 - DNA, 1025 bp, Homo sapiens
tgggtggtgacgcggcggggcccccaccccttccctcgctgcttctctaacccatctcgggactcgggggtgcaggggagccagggctgcgagcgcagagcgctgctcccgagggtgaaatgagtggccatgttccgcctcctttccccggggctccgcagtttcaaatactattgatttatttttacaactgggatacacatgcgcttggataaccagctatcctgggtgcgccctgccggggatactgcgaccggggtttctttcttggtttggcttgttaaaaaactgcttttccacttggtgagggaacaaaggacccagctcgccatcccccggcacttcatggcctaaggaatgatgaggaggggtggcccagcgaccctgggcgcgcgtgggctggggccggtctctggtagaagcccatcgctggtgtccctgacctggtgctgggtactagagaaccaggtaaggacacctggggcagggctgagcgccctctccccggagcagtgactggaacgcagtgggactcctggcttggacgataggtggtgatcaccccgggcttgcattgagctggctggccgcccctggggaattggtaccctggcagagactctgcgggaggtcggaggcgggtctgctccctggctcggtaactggacaaccggcgtcggcgtcggcagatgccctctccctcccactcccatcctggctttcttgggctgccctaggccaccggctcctggctcgtggtttctgtattcgggagccccttctgctcctctccctccctcttgcgggtcacctggtttccagttaggcgtaagcgcagccctgtaggtgagggggagagatgtgagggagtctgcagacatccagtctctcgtgcggatcttgactgcttcagaaaggggcgcctgggctagagggatgcgctggtggctacagaacattgtagcacgcatctcctcccttgggcttccactcttccctgagggccgctggcacccagcaaaatc

SEQ ID NO: 12579 - DNA, 1053 bp, Homo sapiens
ccaggctaattcttaacttagtacttttaattacactaataaggaagtttcaggacacgaagaaacagaccagctaaaggttttctactttgctattattttttaagaaatcaatgctaataatgttttggttgaaagcagtgtattctgatcagtcaaggacctctgatcccacctgttcttgaagacaaaatggcatgcctgcagtccacagcctgacacttcatgtaataaactggcagctgcttcgaggtgggagctgtgttgacctttttattgtctcccctagggaacaaacggagtcccagtcacaactctctttaagggagattcagtggtaacttctaatcaaaacttacttcatttaggctctaaggggcaggtgcctctctgttccctaatacaagcatttcagtacaagcaagcatgatttacggagaaagagggatgttttgcaagaattttgcacacactacatgttctttcccattgttgcaaaatatgatttctaagttgagaacacacaaatattggtataatttgcttaacaattaccatgtgttaatttcattttcttctaaaaaggaatgaaatcatcaggcaatggtatcgggctctctcaagggtctagcatctagaacggtgccaattatgtagcaggtgcttgcaggtttgttagatgattagatgtttggaacaaccaagtaaaatccatgacagcaaggacttgatgttgttcatcttgttgtcttgagtgcctagaactgttcctgccatgtactaaatatgctcaactgattccaactactttagcatatactactcgagcacatgacagtcttttgctgaggtgctttggcattctttctaaaagatagatgggtgtttcattaatgtggtatccatttgggtttgtgagttcttggatgatgccagtagtatgtaagttaggtaaaatatttcctattttcctcactttggagtttgttttccttatttaaaagggactttgaaatttaagtatgtactgtagctttaaaactgcatttctgc

SEQ ID NO: 12580 - DNA, 2458 bp, Homo sapiens
caagtaattgagtgcctcctttctgcacaaggatggtgagggatttagacaataagctattgtatcttccttcaaacttctgcaataaaaatattttataagtattatgttaattacaacactgttataagttattatccccatttcccaaggaggtaagttaggtttagctaggtaaagtgtcttgccctaggttgcacagctagtgagtagtaaaagttgagattcaaaccctggcagtcttattgcctccaatatactgctttcttccttctttttttttagaaacagggtctcactctgtggctcagcctggcgtgcagtgatgtgatcttagctcactgcaccctctgccttccaggctcaagtgatcctcctacctcagccttacaagtagctgggaccacagatgcgcactaccacacccggctgtttttgtacttttgctagaggcagggtttcaccatattgcccaggctggtctcgaactcctgagctcaaacaatccacctgcctttgtctcccagagtgttgggattacaggcgtgagccaccgtgcccggcctcaatatactgctttttatactgaaccccctccttcaatcggacctgaaccctggtctttcacgagttgtgtgaggacactgaccatggcatgttccatggcatgttctcttgttgcctttcttttggatcaccaaaattgcctaccagcttctcttacactaaacaggccagtttaattgatgttcagggagcagcaggagagaagctaagaaacaagatgaggcctggtcatgtttgtttgtaaagcactttaaacagccaggccgagaagtgtttggttgagaagttactgggagttctgagtatggaacaaatgtggtcagagcgccccactaactgggcagtcctggttatcataggctgtggtgggaaacaggagctcaggtagggaggggtgattacgatagaatgtttcgaattttgtgttggaaacaggtggcacaaatcatcagtaaacccttttaacgtctaaaaaaggtatcagcaaaaataatactttagatttttttcctagcacttcattaagaagtgccatacattatctcgttaatttttacaacagccttgctagagattatgaggacctgaagtcatacaaaggcagtggaaaagaaaggagtaactgagagaagagacgtttgggggctagaatctattggcaactgattggctgtggtgagaaaagaagaaattaaaaatgactgagcagagatgtaataaagattcagctcaatccagcacacatttattgtcaggcactaatatgatgaataaggaactcacagagcaaatatgtatgtatcaagtaattataatacaatgaaaagtattttttttaaaatattaagtgttgtgggtgaggaaactattaattttaatggtgatggatttggacatcgtcttggagatgacttacaaaggagaatacaagaagtaaactgtagaaccttagaggatcttcattttagagctaggacagaggaaaggtagcaaaataaatggaaaactaaaaagatttcaaaggttcattgttaagaaagctgtgggaagaaataatttaaaagtggtacggagagtggtcagcagtctggtgtgctgtagaattatgaggagcctgagaataaaagcatagaatttggagtttggagtctttcaaagactctaacttcaggggcctgatatagccaaaagacagttccaggaagtttaggagtggagaaggctttgcccattgcttttaaaattggggaaatctgggtggaaaattagttcttcaaaagtgtttctttgatatcaccgctgctaagggatcctttttgggcgttggttcattctagatcccttaagattgctttcaagtaataccaaagtgctggaggaaccctggaatcattcgtgtgcccgggaattctgtaaagagagagtatcttagaaaatctcaaaccacagaaaatactttgatccattgcagcacagaatcttggcttccacgatcctctttttataatgctctcatcatttgtatatgtatttaaatatctgagtctatccacatctctccatttctactaccactgtccaagttcagtatcacatcttcacatcctggaagactgttctggcacccaaactgtgcacttgtatctgttctgacttctcccagccactctccacactaaagctagagtaaacctttaaaagcacaaatgtgtcatgttgtcctcctgcttagcagtctccactggtatctctttgctcttgggctaagacaaaatcctttagtggggattataagctcctaacactctagctccctttgcttcagtcacactggcagttttggagtttctcgaactccccatatgtcctccaacatagtacctgagcatgc

SEQ ID NO: 12581 - DNA, 1025 bp, Homo sapiens
tgaaggttattgcttttagaacttgggttatgcattccttttctgtgtcttcatgtgttatccccttacctataattagaatttctcttctcccttccactgaattacatatattcttcaaggcccaacttaagtcccacctccttttttgaacattctttcactctgaaagtcctcgtagatttccctattctctgaatgttctctgttctctgtggttaatagtacaatgccaaacacgcacacaaaatgtcaaataattacctttctatgaattgatttcttttcttttttactcttagagattttcctaggattcttaaaagcttatgttgagaagttttcctataagagcataactactgatgactggaaggatttcctgtattcctattttaaagataaggttggatttaaaaaccttttctatttttcatgctcgatatatctctatttattgactgattaggttaacttgtattatctaatagtagtattggttcagaactttaggactcaacctctcattgcatattttttctattttaaatgtgatcttaaccacatgaactacctgtagaattttcctatttcagagaagtcatcaatagtatggtgatgaatataaattttagaagatagagttagatgaggtaatggatatattagcttgacttagtccacattgagtacatatatcaaaacatcgcattgtgtcacataagtatacacaattatgatctatcaatttaaaatattaatttttaaaaaagatttagaaattatcttgatatagcagattagacaaaattatatatctaaggacttacaagtttaaatttttttttgacaggaaagggcattctattgtaaactgtgaattcttactattcataggttgatgttctcaatcaagttgattggaatgcctggctctactctcctggactgcctcccataaagcccaagtaagtacttgcctgctaatgctttccttctcattctcctaactcctagagagcctc

SEQ ID NO: 12582 - DNA, 1021 bp, Homo sapiens
gacctcactgggtctttgctattaatatagctgtttactatgtttgcatcttatttggtatgtcatttttaagtgttgtctcctgaaagccaaatttgctgaccaggcattaaatcatttttctagtctttttataagaataaagcctgtattattgagcaagaaacaacagagaatattacttaagtaagcattctattaatagacttccagaagtttatgccaacatatcctagtgttccagtctccaagttttagattcccctaaagttacaccactgagtgaagtaatacctccttattagcttatttgcgtggtgatagcagtctttctatatgtttctccatgttatttcatgtcttgcaggtaaagacatttggggagacacatcctttcaccaaacttgtggttgatctgacagatatagaccctgatgtagcttattcttcagttccctatgagaagggctttgctttacttttttaccttgaacaactgcttggaggaccaggtaagtagttggtattttatgattttttttttctttttgagggtaatgtgagaattaggaagaattgtaaactattgttttgttccatttaatacttccaattcattctggatgtagctgctgaagaaatctgtattgttttctgagttacctctcaacttaaaaccattaataacccctaaggtttaaattatgctgcttcattttttaaaaaatctcatcagtttttgaaattaggataatagtgtgtattccctgaaaacatttctatggtacagaagtttataagagtaacaagtgagagtccatcaacccctttccactccccaggggtaaccactgttagcagtttggtgtaaatggctccagatcattttctaggtgtaaattaacaagcagacaaataaatacatgtaattattttaattacaaaaaatgggtcatgctatatattggctctgcatttgtgttttgttttgctcgatatttcacatacacccttctgtgtc

SEQ ID NO: 12583 - DNA, 1035 bp, Homo sapiens
tgtttacaaatggaggagtcaagaccaaaaaagcactcagttacagtcctggtcattagacatgtatctttgaccttcagtgaacagaatgtgtatgcatgcgtgagtgtgtgtgtgtgtgtgtgtgtgtgtgtgtgtgtgttttcttaattgacctcacaatggataatttgacttccactgcagcttctgtggttccaagctcccataactttggcatctacttattgccgggtaactctgtgtgcctctacaacatgccaatagtgctttgaaacataaaggaataaaaaaagaaaaccaaaaccttttaaaagtcaggaggaaaaaggcaaacatatgggaaatgcgcttcctgtaggttactttttgagaaatgctcaaaatgcaccttttaatagtatgtgtgatcttgtttttcatgtgtgagaagcttttgttcctagcagaataaaaggcaaatagatgttttgaacaatgttttatatcacaattttaagctatatgttaaagatgagaactatttgagaagtataaaagcaaagttatccctactaatattaggagatttgaaagggaatttacttacttttaaatatgaattgtcttactgtgtaacatttgtgaacactaatgcaagcacgtggtgtgcgtttgtttgccctctttaggttccaataccctgctacctgattgctttagttgttggagctttagaaagcaggtgagcttttggaaaaattttcaggtttgtggaaagatcaaaacttaggcatcttgaacttctctcaaggttaattggtcaatcatttgcatatttctcaagatatcaagctgacagctctagaaaaattcaaatctaaaatgtaggcaacaaattaattttacatttaaaaatcttgaccagttaccccttattttttcaagtattgtaaaatgagcatgctcttacctttagagatctggattctcatgtaagcttgaacaagtcactctcaatctctgtttccttatccttgaaattataatgtctga

SEQ ID NO: 12584 - DNA, 1029 bp, Homo sapiens
taccaggttgggctttttctagatatacaaccacagtgatatacagtttgctgatttgcttaacgaacatgaagtttgaaagtacatgagttctaggaggaaatatattgtgtaatgtattgaggagccagagtgaaagaaacttaagttatagataaagtttttcataatagagaaaattttaggagtcagaagcaaacatattttgatttagatttgacttttacttaaagcccaaaatttgtgtgactgtcctagggttatttaacaatatatatgcaaatcttagaacccaaaaattttcaagatgcttagagtcccaaaaaatgagacctagactagcttttgactcttcaattcttctaatttcactctgtattttactctccataagcaactagttgttgtagcctatatctaatatgagttttttctggtaaatgaaactattttcttactatttaaaaatattaattttaggttttggatacaaaggaccttacaatagaaaaagtagtgatcaatggacaagaagtcaaatatgctcttggagaaagacaaagttacaagggatcgccaatggaaatctctcttcctatcgctttgagcaagtatgaatgttatgatctttctcttttacagctaaataatggggaaacatattcttaactaatttaaatattttttctttttaaattttagtttgtaaatatgtaatgattggtacactacttatcctgatcttctgttcagattaaagttgatacagcagttaaaattatatatacttaagatactaaaaatgttgtttgtatataatacaacaaggactttgggaactgttagtttctaaacgattcatccttttactaatatctagagtgatggtgggggcatgccatcataagaaggcatttcaagataacctgggcagctttacaagttgcaccctccttgcccttgccccagaggccagctgcatttattaatgggacaatgataatgccaaagatagaactgttacagtgc

SEQ ID NO: 12585 - DNA, 1070 bp, Homo sapiens
attgataatagtgccagctgtatttcagaggtgagatgggaagacccagtgccagtgcggaatcaggagagacgtcatgtcttcttttcctctccgttcttagagtttgtgatgttgaggaatgctgaaggagacttaatcggacaaattctaagctttctaaaattcttttcaagttttgggttatttacactgaagtttgatcctccaaatttatgataactttcatacatttgtttcttttcactgaaaccttcagaaatgtttaggtgttcttttggttagtggctcaagaggttttagtgccatggccaaggcagaagccagcagttaacaataggtaattctgactgcaaaccatcttgttttcactaagtaaatgtctcaactgggaatcaaatcaaggtggttttttagttttagctttgtgtttcacacataaacctattttttttcatcatatccctgcacatagcaagtagaaaatgtaaatttagacatcataatgaggcataaagctttttttaaaaaaactctgctttgttctagaaaggactgagactgcttgaagcaacatatatagtataagattaaaaataattaaataatttgcaggaagagagaatagggataggagaaacaaaacccatggcataaagccctctatactttaaaagaagtgggccacagggttgacatggagcttcctaccagcctgtgcaaaaaaggaatcagatacctattccatgtcaactgaccagctactgagaagtacaactgctttttagggggatggagggtattgttcaaagaggatactgtgaaacatataaattatatcctataattagtagagctgttgatgcttaacacgtttcttaaaaagtactaaatccaacttgtcaacaatccagttttctttatttttctttcttattacagtttttgactattttttaaaaataacatcgctgaaatttgaaggggaattttaaaaagtagtttgcaaatgatagttgagacttaggacttgagataatacagcttaaacattgcattttttgttttct

SEQ ID NO: 12586 - DNA, 1030 bp, Homo sapiens
cttctagcactaactttgtatgttcagtaaatatcagttccctggaccagctccttttattctggtacagaattattcttagcctatggggtgggggtggggggacagtagtgtctattatttgtgaattttggaaccagtgtcattactttacagtcaaggaggcatgttagagtgtttggatttttatcccttgataagggcccacatccccacatacagagatgctcaattccaattgaaaaacctcagaatttctaagtgtcaaagcaatagtctagatttttttctgaaaattcaagaaatgtgttttctcaaatctctttttttatcctttctcataatcctgccacttaatgcccagtttggatcagttatttagtcacatttcaagttagtttttatcatcacttatagttaaggattgtaattaatcttgaatttaaagcttggtgcttttcagttttcttgtattagaactttccttcttcatgtacaggtgtggtacctttggactggtgcctgctgattttctgatggaacagaaaatatgtctgtattatcactgctccaaattacattacacaacagaatttactggagtgttccaagttatcatcagttcagttccacgatgatgaggttcctgtagaatttttcatctgtcagatttccttcattctcccctaactttagtaatacataaagcagtgtatcctctctcagtttccacaagcaaggcctttagtacctccactctctatttgtattacagcaagtttttgatccatcaaaaattgtgaacacctacctatactgatgaagatacctagtgttaaaaatggtttctttgttgtttgggttcatcaccactctgtgagcttcttctaaagcattagattttttaaatgttaattatagttccaggggaaccccaacttacttatactgacacagtaaatatatcagatggtcgggattccctatggaaaactgagaaaaccagggctaattttttgaaataagaata

SEQ ID NO: 12587 - DNA, 1059 bp, Homo sapiens
ttgtgatccgcccatttcagcctcccaaagtgctgggattacaggtgtgagccaccacgcacagccaaaagtttttaatttaacgacatctattttatctcgtttgttgcctgtgcttttggtgatttaagaaagtattgtcacgtttcaaaggtcataaatatttgctcttatattttcctttaagagtttattatatttttagctgtcagatttagagctttgatccatttaaatttttatgtgtgatacaaagtaagggtccgactttattttgcatatgaatatcaatttttttttccagcaccatttgttgaaaagactgtcctttccccattaagtggtcttggtgcccttctcagaaatcagttgaccatagatgtgaggtttatttctgggctgtcaggtctgttccattagtctatatgtctgtccataagggtttgtagcacaatgttttgattactgtctttagaacgttttaaatcagaaaatgtgagtcttccaactttgttctctttctcaagattgttgtagctattcagagtctcttgaaattcaatatgaattttaagatgggattttctatttctgcaacaacaacaaaacaccattggaattatgatagggtttgcattaaattagaatctatagatcactttgggtagtattacaattttaataatattaaatcttccagtccatgaacacaagatttctttccatttagttaggtcatctataatttcagcaacattttgtagttttcagcatacaagtcttttgccttcttaaatttattcctaagcatcttattcttattgatgttattgtagatggagttgttttcttaatttctttttggattttttcattgctagtgtatagaaatacaagtaatttttgtgtgttccttttgtatcctgcagctttgctaaatttgattattagcactaacagggtttctgtagagtctttagggttttctatacatatgatcttgttacctgcaaggaatgatagttttacttcctcctttataatttggatgctgtttat

SEQ ID NO: 12588 - DNA, 1028 bp, Homo sapiens
acatgggaagaacagaagacagagcatgctcttttaagtctgataacatggtttcaagcccagcccccagcctttcttaccaatcaaggactcagaactgaaggcaattatttcttttggtggacttggaatctccgtttgtctacactgtcctcttcacagtggagtctttttatttcagacctacagattgtttttatatttgttgtcacagtgtgacaattttttgtacagtcggttttaaggtcttctctgccattagagccagtaggttacagctattgatgtaactatagctgcaatttttgtgcaggactgagaaacacagtgcattatttattgcggaatcattgctgctaaataactactgtctgtttatttaacacaacaattgaatgcctgaagaagttgcagtggctttattatatgtgaatgcatctgtttctcctcacgaattgttttactgctgcattttttgtttttaaaattaaactgcagtgtttcctggaatgtaaatttagctttgcttaatagtaaaataagtgagccatcttgaacactttaagtttatactatataatttcttaatgaacattggcaaatagagtagctaagagattgacaagcacattacgtttagataagcatgtgatgcagaagttgattcaagcaagtgaatccctgacattttgaggatctcacattagacaccaacaaattaaagctccaaaattatttattttttatgtgttcctcactttagaaacgtctactgcatattactggatatttgtatactaatacacttacctattttacattgtgttttaaatttagttaaaacttaaccgtagaagtctgttcaaacgcgaaaggtcttgctttgtttgttttaaatacatttattttattagaaaggatgatatttcattggggaatagtttctttcatttgggggctatgtgtttcaataacattcacttggaatcagctgaaagctgtaatatgtctttgaaatgagccatgat

SEQ ID NO: 12589 - DNA, 1048 bp, Homo sapiens
gtatcatacccgaggtttatccaaggcacagttattgctaattgaaaatttttcccaaatacccccaccatgacaacttgtgattatagttggcattggcaatttttgagtttctgcagagactggaacaacaacatacacattataaagcttattgtgctatttctttagctattatttctgtttctgtgaaacttttaaaatattctaaaataatctaggatggaactcaggctagattgtgaactcatgaaagtgggaatcatgtctgtcttctctagcacctaacattgtgctgggtaaatgttgaataaatgagctttgtcctctgtcctctgaataatttctgtaggagagcacgtcaacaagctagtcattatatctattgttaatcttgttgtgttcagcaaataaaaatgcaagcaaaattttctaaaaattttatttaaagattcagtaagtactgttttgatgtaatcattaaatcctaagttggaaattactaaattgggggctaagcttttactttttgaattaggatctgacagacaattcactagtgtaattgtgcctttgtctgaattctctgcctgcctgcctgcctgcatgggtggaattcagtagtgttgtttattttatagactgattattcaaatttaaacttaacctcttacatatttgtctttacagtctaatttgtagtccatttacatagtctttaaagcaaacctcgacattttgtcatagtaaccattggaccctagtgtatttgatgttttaagaacatagtagtattcattcatttaagataaaaggattaataagaaaatttctctactcctgagaagaaaaaatgcctagcttacagtcttatttcccgtgtgcttctcattgttataatgacattttaaatatttttttcaggaacattcattcttttgttcatactagtttgcatttattctcaatatagtgttttttcccccataaaagatgacacaaaacttaaaattcatggcaaaaatgcggtagttccatattcatgaat

SEQ ID NO: 12590 - DNA, 1052 bp, Homo sapiens
tttatctctgtaggtgtgtctctacagaatggtatgctggagttggctcacactagttcataagagatgattgttaaagtttcaggaactttgcaaactggttgttaaacatagctattaaattttaaattatataagtttacaaataggtaaactaaattaaaaacaaaggtaatgaatatgcaaaagtcattgcttcctaattttttaccacttttaactattatctatgccaccggcgttatttttttctgttctagttatagtcaaaaacactatataatggtatgctactgcacatttcttcccaaccatatgttcagtgttgtcatgttggtagcctgaagttgtccatggagagagaagtcagaaaacactacagatcaggccctggcttattgttttcttgtttgtctagaccagggtttgttttttttttttttgtaagggggcagttagtaataaatattttaggttttatgggcatacagtctccattgcatattcttctctgtttaataatcctttaaaaatacaaaaaacatttttagctcatgggccatataaaaagaagccacacttgttctagacccttgttctagaactaagacagtgtattgaaaatgttagtaacgcagattaaatttaaagggtattgtgctggaggagaaaagtatgttgtatctgccgctgttacattacctgatcagcagagagatatccctcttccccccttgacagatgagtaaagttctgacaagccatcattgtttcacgtttgtcttgatggaaatgaaaataccgactggtagtcatgtcagaactacacttgtttgttaatgacgtgagtaatttcttgtttgggtcagatggtactcaagtatttattcatagtctgagattagtaagctttctttgtcgtccaattccttgtgcaacaggacagatttttttttaagtgtgaattttttttttttattatactttaagttttagggtacatgtgcacattgtgcaggttagttacatatgtatacatgtgccatgctggt

SEQ ID NO: 12591 - DNA, 1188 bp, Homo sapiens
gcctggttcctaacaggccatggaccagtactggtctgtgacccaggagttggggacccctgatcaatgtgactgatacacaattccagttatagtccattaacacatcatatttcatatatgtttaacagttgatctggtaaagatttaaaaatattttggggctaggcatggtggctcattgtaatcccagtgctttgggaggctgaggtgaggaggatcacttgagcccaggagtttgagactagctgggaaacatagcaaaaccccatctctaccaaaaagacacaaattagccaggtgtgatggtgtgtgcctgtagtcccagctatggtggggaggatgaagtgggaggaccacatgagcccaggtggttgaggctgcagtgagctgtgactgcaccactgcacttcagcctgtgcaacagagcaagaccctgcctggaaaaaaagaaaaaaaaaatatttgaatagatgtttttactataaatgctgactaaaagctgggtggtaggagtgtgtgtgaaactaatttagcagtcgtgtctgctggcctgttgcttctgcctttgtaatatgtcctaaatctgcctgcttccctccatcttcagtacagccaccctagtctaagccaccaacatttgttacttagggtactgtagtaatctcctccttttgctgttgattccctattgcctgtttttcaaacagcaaccaagatgatatcttaaaaaattgttttcagtaattacaaatataaaggaagttacaaagattatatagaaaggacccatacttgtacccttctcccaatccccccaccattggttccatcttatgtaactatagaacccaggaaacagatactggaataaagtctaaatatagttctgtgtcatgtcctcacctgtgttgattcgtataaccactgcaatcaagattaagaactgtttcatcatgacaatagatctctcgtgttaccttttgtagtcttccctacccccttacctcctactatctttaacccttcacagtgatatttttgaaacatgaatcagatcatatcactctcctgcttcaaagctaccgtaactgcttccaatctgagaataaaattcaaacttttatggtgaagtataaagtgttgaatgacttgttccctccttacctctgtggtctcacctggtac

SEQ ID NO: 12592 - DNA, 1029 bp, Homo sapiens
gctaggattacaggcgtgcaccaccatgcctggctaatttttatatttttagtagagacagagttttgccatgttgaccaggctgatcttgaactcccggcctcaagtgatccgctcacctcggcctctcaaagtgctgggattacaggcatgagacactgcgcttggccctcaacatgttattaatataatagttattaacttttttttggtgagggataataaatgttattgtctgaagccactaaggtttttttttttaatttttaaaaaagttgtaaaatacacatagcaaaattcactatctttaccatttttaagtgcagttcagtggtatttatttcatattgttctgcatctatcaccattttccatctccagaattcatttcatcttgcaagatgtaaactctgtacccattaaagaataacttcccattcctgtccttcccccagcccctggcaaccaaagtccactgtgtattttacagctgcagcacaactcagtttggactacgtacttttcaagtgcttattagcctgctgttggctacagttttggatagctcagttctgtgctgtaatagatactgaatccatttatagttactctgtgttacagaatgttactgttatatgaattaattctgtaataacatttctataatactttgttatttttgtccttatttgtcatccagaacaataggcaggtcccgtggtcagcaaaatagcaaaagggtcattcaaaaatggtgtggcaagattctgaagtggtgatgtctgtatagtcggataatgcaactgtaaaatacacagtggactttggttgccaggggctgggggaaggacaggaatgggaatttattctttaatgggtacagagtttacatcttgcaagatgaaatgaattctggagatggaaaatggtggtagatgcagaacaatatgaaataaataccactgaaactgcacttaaaaatggtaaagatagtgaattttgttatgtgtattttacaacttttttaaa

SEQ ID NO: 12593 - DNA, 1760 bp, Homo sapiens
tgcaccccaggaacaaagcttacttaattatggtgaattaacattttgatgtgctgctggattccatttgctagtattttgttgaggatttttgtgtctatgttcatcggggatattgttctgaagttttcttttttcattgtatctctgccagattttggtatcaggctgatgctggctccctagaatgagttagggaggaaaccctccttgatattttggaatagtttcagtaggattggtaccaatttttctttatacgtttggtagaattcggctgtgaatccatctggtcctggactttttttggttggtaggatttttttttttttttttaattactgattcagttttggaacttgttatttgtctgttcaggttttcacttccttcctggtttaatcttgggaggttgtgtgtttccaggaatttatccttttcttctagattttctaatttgtgtgcatagaggtgttgatagtaggctgaatatcttttgtatttatgttttcactattttaaatcggtgctgtgacaaacttgaacatgcgatatccctttcccacccgcccacaccattttgcatttccttagggtagatagatgtctagaagtggaattcccaaaccaaagtctgtgaacccttttctgatatctctgttgtaccagtaccacgaataatgtgccacatctgtttttagtgatataattatctaaaatgtttgcttttgatcattggttttagaaaaatataattatatttgcatttctttgatttctgggatgttggtcctcctcccacccccattatccccacggattgctaaggaggagactttgactgctccctgaatcctggcatcttctttttttaattttttctgatatttggtttttatcaagttgttatataataaaaaaaactagataagttgttttggtgatccatctctttttatattcattccagcttatttttcaatgctttgtaatatattttaatatctagtgtggcaaaacacttaatttttttctaataattttgatattcttatatatgtatttttaattctactttagtaaatggcaggcaaaaaaatgtagatctatggacagtagtagagtttatgggaggaaaattgcggatgatcctttcagctcactagaagtctctatttttttcttcaaaactggtctccctgctataaaatttgaactgtaggtatgtcagtatatctataagagttgcctccgtaattgaaatagacttcctgttacccgttgtctaggttgtacactgtaaagagcatcttttttttttttttttgtaggaaaaaatggttttgtacatgggatgaaacaatgtaaactcaaaacttacagataagggttagttgtatcactcatctctttgaaaagtttatatgaatatccagtcaaaaccaacaaggtatcgcccttgaaatgttatctatatggatttccaaggagaccataggactgtatactgtcttggaatgtcctcagaaggcttagagagcatcttgataaaaggttatgtggtttatgatagagtgtattagtttatttgtgttattaccaaagatgaacttatggttaaagatgaatttaggattaacatgacgaggaaagagtgacatttagctgagggtattaagtagatgtctcagatgaactgacactaaaggtaattagctttacaaatagagagatgagagaagagaaccacttcctaggta

SEQ ID NO: 12594 - DNA, 1167 bp, Homo sapiens
gctgcatccatgttgctgcaaagaacaaggtctcattctttttttatggctatacagtactccatggtgtgtatataccatgttttctttatccagttcaccatcagtgggcacctaggttgattccatgtctttgctattgtgaatagtgccgccataaacctatgaatacatgagtctttttgataaaatgatttgttttcctttgggtatatacccagtaatgggattattgaattgaatggtagttcagtttttagctctttgagaaatctccaactgctttccacagtggctaacctaacttaacttatattcctaccagcaatgtgtaagctttcccttttctctgcagtcttgccaacatctgttattttttgactttttaataatagccattctgactggtgtgagatggtattttgttgtggttttcattgcttttatctcatgattagtaatgttgaacatttttttcatgtgtttgttggctgcttatatgtcttcttttgagaaatgtctgttcatgtcctttgtctacttcttaatgggattttttttttcttgtggatttaagttccgtatggattctgaatattagtcctttgttggatgcatagtttgcaaatcttttctcccattctgaaggctgtctgtatactcttgataatttcttttgccatgcagaagctctttagtttcattacgtcctgcttgtcaatttttgttttctttgcaattgtttttggggacttagccataaattctttgccaatgctgatgtctggaagagtgtttcctgggttttcttctaggattttatagtctaatgtctttaattcatcttgagttaatttttgtataggacaaaaagtaggggcccactttcattcttctgtgtatgcctatccagttatcccaacatgatttattgaatagagagtccttctcccgttgtttatttttggcaactttgttgatcagacgatcagacggttgtggttgtgcaactttatttctagattctccattctgttccattggtctgtgtgtctgtttttgtatcagtaccatgctgtgttgcttactttagccctacagtttagttttaagtcgggtagtatgattcctctggctttgttctttctgcttagggttgctttggct

SEQ ID NO: 12595 - DNA, 1051 bp, Homo sapiens
gtgcctctgtgtctggccagtatgtcagtttttaacgaacataaatgtggaaattttttgaagtgaaggcaaagtgattaaaactttctacctgggtgcagtggctcacgtctgtaatcccagcactttgggaggctgaggtgggcagatcacctgagcccaggtgtttaagacaagcctgggcaacatggcaaaatgccatctctttaaaaagtgttttaaaaaattggccagctgtggtggcacatgcctgtagtcctggctactcctctggaaggtaaagtctgcagtgagctgtgattgtgccgctgctccccagccagcgtgacagagttagagaccctatctcaaaacaaagcaaaaaccaagaaaccttcctgtcgttccatcttatttttccctccctttttttttgttctacttggagcgttttagttttaccgggagttggcagttttcttaattttatgtataattgtcttttgtttcaattattttatgttttttcctttagtggatgtttttgtctgactcttttagcttgtttcttatcagtgatactgtttcctatctgtatggtctcagttattagttttagaaaattatttttaaaatgtgagaatgtataatcatataaaaaatgtacaatgtacgttctctaacacagtggttactattttcaaatattatcttggcttttctccaatatgttttgtatttttgtttaagatcctttttatgttttttttaaggtaccaaataattgtggctgttacttttagtgtttgcaaaagatgcttaaccatttcatgttgtttgataattattacttctcatttttcattattttgttttaaaaataatttcaacttttatttttgattcagggcatacaagtgcaggttcgttacatgggtatattgcgtgatgctgaggtctggggtatggatgagcctgtcactctggtagtgagcatagtatgtgataggtagtttttcagcccatgcccccatttgccaaccccttctagtcatctccagtgtctgttgtt

SEQ ID NO: 12596 - DNA, 1040 bp, Homo sapiens
acattccagtttaggcattcaaaccactactctacactgtctccatgaggatgagatgttaaaaagtcaatgttactgtctgcactctataaacaatgagtgagatattagaaaagctcatcaaaatgcgatttaaagtacattgaactggttttactacattaaaagattgcagtatataaaatatgtaaggtaggacatgttgctcaaaatgaattaaaaatcaagatgctaaaaaaatttaaaacatttatatgggcgaggcatggtggctcacgcctgtaatcccagcactttgagaggctgagccgggcagatcacaaggtcaagagttccagtccggcctggccaacatggtgaaacccggtctctactaagaatacaaaaattagctgggcacggtggtgcatgcctgtaatcccagctactcgggaggctgaggcaggagaattgcttgaacttgggaggcagaggttgcagtgagccaagatcgcaccattgcactctagcctggcgacagagcaagactctgtctcgggggaaaaaaattatagattttttgaataaataataaataaaaataaaataataaatattttttgtctaccttttttttttctttttttttttttgagacggagtctctccctcagttggcccaggctggagtgcagtgttgcagttgcgtgatctcaagctattctcgtgcctcagcctccggagtagctgggaccacaggtggtgtgagcttccacgtccaactaaattttgtatttttagtagagatgggttttcaccatgttggccaggctggtctcgaactcctgacctcaggtgatctgtgcacctcggtctcccaaagtgctgggattacacgtatgagacaccgtacccgtgcttctctaccttttaataacacatttttgtttctttttatgcatttgttagtgtaaatatgttcaagaatactctacattttgtgtacatgtttgtaaacaagggaaaaggacccaaagataatttctctttcattgtattct

SEQ ID NO: 12597 - DNA, 1150 bp, Homo sapiens
cgcatgcctgtaatcccagctactcgggaggctgaggcaggagaatcgcttgaacccgggaggtggaggttgcggtgagccgagatctcgccattgcactccagcctgggcaacaagtgcgacactccatctaaaaaaataaataaataaaaactaaaaaattataataggcgcctaaaaatatagtttaaaatgctccttttaattcggcatgaacctgttccgccaaaagatggcctgttgctgggaaaaattaaaacaaactagaaaacataaacggttcaaaaagccctccacacgcaaaagtataaaaaggcgggaatttcctcatttcaaattttggttagaaattagagtgtcatcagttgccctccagggagcgctctgagactctgctgcgagtcatttcagttaataaagcgggaaaacgctcgaacttaacctatagcattttggggccacccctccagagctttcgaaagggcacggaagtccccgtctaaacgcccgctgcaggcggctggtggtccagggaagcggcgtcgactgcgtgcaaaacaaccgccgccaacgcaactccacacctcccagacccacacgtcaaagaacgcgaaccccgcggccccaacttctggcctctccgctccggcgcctgcagccccgcggggaaggggcgacgcgagggggcgcagggacagccccgcacctgggaggcccgagggggcgcccgggagggaggggctgcaaacggcggcgagcgcgcgcggcaaccgccaaacgcccgcctttgtagccccggccccgcgtccttaccctgccgacggctgctcggctccggcccgcggcggcggccccagagccgaggaccggggtgggctcgcgctcttcgtcactggagaagtccgggggccccttgctgttggtgccggcggggagcggcggccggttgcgagccgtgaggtgctgcaggtagagctggacgtacacgtctttgcgctgctccccggccggcagcgtcacattgttggcgaccaactcactcttcaacttgtcttttgtcaggaccgaggggtcttccaggaactccggcatctcggggatctgcgaagccccctccccacagcctttgccgccgccgctcacgccggcg

SEQ ID NO: 12598 - DNA, 1053 bp, Homo sapiens
ctgcatattctgggcactttattttagggcttaggttttttttgttttgttttgttttttgagacaaagtcttgctgtgtcgcccaggctggagtgcagtggcacaatcttggttcactacaacctccgtctcctgggtttaagcaattctcctgcctcagcctcccaagtacctgggattacaggtgcctgtcactacacccggctcattttttgtatttttagtagagatggggtttcaccaggttggctaggctggtctcgaactcctgacctcaggtgatccacccacctcggcctcccaaagtgctgggattacaggtgtgagccaccacgcacggccactagggcttagttttaaatagtaaaaggagagaattatatcaataatccctaagatgccttctggctttaagtggttttatttacttatttaccctttttttaatataaaaaaaagtagaggtgagggtctctctatgttgcccaggctggtctcaaactcctgacctcaacggatcctccgtccttggcctcccaaagtgctgggataacaggtgtgagccactgcgcctgatctaaatggttttaaattatacagatcaataaaatttccaggtcctttaatagaattcaaagaacctagctgggtgcagtggcccacgcctgtaatttcagcgctttgggaggctgaggtgggtggatcacgaggtcaggagatcgagaccatcctggccaacatggtgaaacctgtgtctctactaaaaatacaaaattaggtgagcgtggtggtgagcgtctgtaatcccagctacttgggaggctgaggcaggagaatctcttgaaaccaggaggcaggggttgcagtgagctgagatggcgccactacactccagcctgggcgacagagcaagactccgtctcaaaaaaaaaaaatcctttagcaagtttttagaaagcagattggacctagaaatcatattcttgaaccatgttgctgtgcttgtagatccaggcaatgtttaacattacaggacagcatctaacctcata

SEQ ID NO: 12599 - DNA, 1049 bp, Homo sapiens
agtgagactctgtctcaataaataaataaataaataaaaataagcctgtggcctgttttgagggaaaagtaacataactctgataattaattatgataataactatgatagttaaaaatacgtcattttaaagatttcccaaaccacaccactaaatttgttttatgaattgattttattttatttgaaattatataatgtagtcaactgcaatatggaagtttgttcttgtttctttgtcaataaccttaccagttttataatgcagtttttgatggaattaaacacaaagaacttgaaagcagtcagttacaaaaaggtagttgtggtcaagtagttttaatatgtaaatttgcaagtttttggagaacccccaaactccttctccactggagttaggagggcctgtggtagacagcgtgaatcatgaaaataagcctggagagttctgttattaaggggcatagcattaatttttgcagtcttaaaattacacttcttgacttctgaatgtctcttatttgcgtgcactgacaaaattctatttgtttacttttatattaatggtaataaaatagattataaagtaagctggaactttgttgttttaacctccatcctgtcaaggcaaatgtgatctcttatcttatatcctttacgtttaaatatttttttctcaccgatcaccacatttaatatgaggttattatgaacttatatataccatggtaatggttactgaaagtaaatggaaacaaggtggctactgttctctataatgacacaagggaaaggaagaaaactgcacttctacaagtataacatgagaaaactattaaagtatatatgcgtttgtatgtatgtatagatatctagatagatatatcctgtatttatgaagaggttttcctattaagaaattattagagagatttagatgtacttaatttgtctttctctctttcttccattcatttatttaacacagatgcttaaaatttcaaaaactttcctgtgtatcaaatattaaattacattgttagtctttt

SEQ ID NO: 12600 - DNA, 1050 bp, Homo sapiens
actaaacctttgctcatgtcacaaggtaagcaaggacctatgcttggcaccagggtgggtaaggatgttgtaaaaatagagatgaaatggagcatctaagtccctgcagccccatgcacaggatgagcatataatcctccagaagagaaaagccatggaggaaaattaagtatccctcacaaatgccaggggattccatggatggtgagtgtaagggatttggggaaggagctgcaaaggagttggtattttcacatagggctcaaattggaatctgagccaggcgtagtggctcatgcctgtaatcccagcactttgggaggccaaggcaggcggatcaccttgaggtcaggagttcgagaccagattggccaacatggcgaaaccctgtctctactaaaaatacaaaaatattagctgagcatggtggttcatgcctgtaatcccagctacttgggaggctgatgtatgagaattgcttgaacctgggaggcagaggtttcagaagtgagctgagatcataccactgcactccagcctgggcaacagagtgagactctgtcccaaaaaaaaaaaaaaaaaaattggaatctggttgtagctgttgggggaactctaacataccattagaagaaatcccaggggcaagaaacttcatatatatatatatatatatatatatatatatatattttttttttttttttttttttttttttttcagatagagtctctccctgtcatcccagctctcactctgtcatccaggctggagtgcagtgttggaataacagctcaacctcccaggctcaagcactcctcccaactcagcctcccaagtaactgggactaacaggcacgccactgcacccagctaatttttttttctttaattttttggagagacggggtcttgctacattgcccaggctggtatcaaactcctggcctcaaatgacctttctgcctctgcctcccaaagaattgatattacaagtgtgagccactgtgccttgccaaaacttcacatatttaattaaaagctattga

SEQ ID NO: 12601 - DNA, 1037 bp, Homo sapiens
gctctgcccacatgagggcccagttcctcccctgtaaacacatgcagtagtgtcagaggtgcccaacataggtgtgcctccctcctgagaccatccatgatgctgctttaggaaaacagaacctgactcttgatatttcagacctttgacctgaaatacttaggggaaaaacgtattgactagatcatgccattaataaagtggtggaatgtcattcattccttggctgttgcttcaaaagcgactccccacccccacagtttgtcttgtcagtatttcacaattttgaaaccaaaggttagccacagaacatggtatttatttcatgatgtatttccattcaggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcaggtaaggtgttataagcctttgtgatatttttcaaccatatcaggtaatgccttttaatagtgaacagtagcttcctatggatgcttattgtccgtgcctaactagaatttataccatgttatgccccgcctttcattccttgctcatctgaactagaccgagacagaaatgtctgggaatggaatgtgtacacatgtccttgttatgcattcctgctgaagaaattatgtctgatctcattgcacccagaaagtctttgccctgaagggaataatatagtgtcaaagtcaaatcataatgaaaatgagtaataaaagtctagattacaaaatgtaaattggttggataatggggcagaagtttggggggaaggattaaccctgtgtgatgtggttaatttcctcccaagtctatacattcatacagaaatgctctactgggactagttgcgttttctcatattgtcaccttgactagttgaaaatgatgatgctttctagcacaagtaattga

SEQ ID NO: 12602 - DNA, 1031 bp, Homo sapiens
taccagagctgcattaagaggttcaaaaaagcacattggtattaaagattctgtgaaaccctgaaggagaaaaaaatcaatttattcttatttaatgcaagtttcaaatttatttgaccatgtagacctttctggttccaggaatatatattaacatcacacaggaacaagtatgtaataacaattagtttagcaatgaagaaaccatgagactgcttccatttgatgttatttggtattatcaaaaacccaaagacagatgaaatactatttttctaaccctttgtaagatttagtaggtacagaacagggaggattatattgttcttgtctacagcagcaattccacacagataagcttttggtcttcgccgcttgccactcctcagatttgttcccttccacaaacacaaaacttgttttgcaaagacaaaaccaaaggtattattaagtattctgagcatcctggaattaaatgatgtcatttagtgggagcttttcagaacacaaggaatgactgtactgcatttcaaacaactcatgaaggaaaacatctcttcttatacaagtgactatgactaaagaaagcttgttcctcatgaagaattctcagaggtggagctgcagggctgattggaaagtgctgcctaccagagcagggaaattgcaaagagctacacacagaaccagaaggagcttgttgtgttagtttgtgtttccccctggtctcttccctggtctggagaaccacatcataatggggagaatgcagagagaggccagaggcaggtgtcgcctttgaaagctgagaagaccgaggttggtaggtttcttccaccatgggactgagctctgtcaggcaacccctgagcaacacaatatagatttagagcttgttaagatcaaatgcacaggtgtgttccttcccagtaatccagagaaggctctgagtaagtataatcagggacaccaatctctttcaggaaaaagtgcctccttaggctttccattaaaaaatagagttttggttc

SEQ ID NO: 12603 - DNA, 1022 bp, Homo sapiens
ataagcttttatttgcagttctggacaggcagtacctcattctctaaaataaaatgaccattatgatgaggtgagcaagaggacattggtttatacacagaaaagggctgaggaaagcaaaaatagaaaacaaaaagcagactgattgtttaaatgttactttccttgtaaaggataaagtaaaggggaatttctaatcctgccagctaaaactggcttgtttagagatttggccatcatctcgcactctcttggtttcttggaaggtcagaaaaacaacttagattttgcttggtgatgtggaactttagcatgagtgactccattttggtttgtttttctttttggggggggcctggtacaagagctcagtggtatccaatggcctcctatacattatctttaacactgattaaaataaaataatgcatctcctttggggtaaacataatccagaagggtactcatttcaaccacaaacatttctaaacactctctgtgtgaaaagaacctaagacaactttactgccctcaagaaaatcaagggttaaattagaaaaatggcttgtatccaaagaaaaataatataagacagtgtgacagacttccacgggctaccctcaataaggctttaggagtttctttgccttagcaacggcttatcaaagtcaagcactgtgtcacctggtaatgcaaacccttccagcatctctgcctttaggttttaggggggaatcgtcaaaacagacatgcagcccactacaaagtacttgaaagcaatagggcaccattcaagcacacgcctgcatttactgggctacgtttatttagggcattcaggtggctgtaattattgtgcataaatagttttctaaaaagcataaaactaaaaacttgatccatggaaacacagtgtggttttaggatggagatcggatttcactcacctcaaaataactcctggtgtttgcctccaagacccattaatttatgttatctcttgctctgtagcagtttggatt

SEQ ID NO: 12604 - DNA, 1052 bp, Homo sapiens
taaaattgggtaaagacttagtttgcatggctacataattttccccaattgtgtttgatcacttgggtttagtatagaagaagccagtttgctcagttgacccaggcttaattcataataattgatagtctttgggctgtgatcatgaattctaaggtaaaggagtccagaatttaaagggaaattttgtggtttttaaaaaatgattagaattgggatgaatatagatcaaaacagtttctatgtaattttatatgagaccttatccactcagccccacagaattgcccccaataagcgccatagcaggtagaggagagcatcaacataactgttacttcttttctggttaggtaaggaaatagtttgcattttttcctctgttgattccattaacccatagtttaggttttgcatcaatcctattacttccaagtctctcaactgctatgactagtcccttgtgactcatacctagctatgcatttcccccttagggccaactaactgatctggagaactcagggaagttactgacctctcttggagttactgatgtattccctttgttactaaattctttagtgagtaaaggtagaatttgcaaacgtggagacatttcttgatgcacacgagtcttttagagaccctcaaattgatcttggtgggtaaataccctatagttctgatccattcaataagcacttattgagtacctctgatgttctaggcattgtgctaaatattgcataaggaacagagcaaaaggtataagtgttgacctttaggagcttagaatgtgttaaaattaaggataataagggcaatgaacaagataagcatagggtgctctgggagagtagaaggggaggaatgtgaatgaaggaaggcttgtgggaggaagtgctacatgatttgctagcctcaaagaaggaggagttagatagatgaataaggtatggcactccaggcaaggggcagtgtgtgcagagatgcagagagggtgaaagaacagagtacattcagagactatgcccacttggcatggttag

SEQ ID NO: 12605 - DNA, 1038 bp, Homo sapiens
gaaatatgggagaccaaatctatgacccattggcatctctgaaagagagggagagaaagcaagaaacctggaaaatatatttgaggatatcattcatgaaaatgtttccaacatcactagagaggtcgacattcaaattcaggaaatgcagagaaaccctgtgagatactatgtaagacaaccatccccaagacacacattgatcagattcttcaaggttgaataaaagaaaaaatgttaaaggcagctagagaaaagggacaggtcacctacaaaagtgaggtgagagagttgaacatctcacttacagtgttgtaccattgagacagaaaactaacaaagatatttgggacctaaacttgacacttgactaaatggacttaatagacatctacagaactctccactccaaaacaatgtaatatacattcttctgatctgcacatggcgcatattctaaaagcaaccacacaatcggccagaaaacaattctcaacaaattcaagaaaacagaaatcttaccaaccatactctctgaccacagcacaataaaaatagaaaccaatactaagaatatcactcaaaactgtacaattacatggaaattaaacaacctgctcctcaatgacatttgggtaaacagtgaaattaaatcataaatcaggaaattatttgatactaaggagaacaaaaataaaacatatcagaatctctgggacatagctaaagcagtgttaagaggaaagattatagcactaaatgcccacatcaaaacgttagaaagatttcaaattaataacctaacatcacacctagaggaactagaaaaacaaaagcaaactaattccaatgttagcagaagacaagaaataaccaaaatcaaagctgaactgaatgaaattgagacatgaaaagccatgctcccccccaaaaaaaatcactgaatccaggagtttcttatttgaaagaataaataagtttgatagacccactagccggaatactaaagaaaaaaagagagaagatccaaataaacac

SEQ ID NO: 12606 - DNA, 1029 bp, Homo sapiens
ggttgtctctcgtaaggtacaccacaacagagtaatgaatggagcatgccaaatattctcccttattgaagtgttgcaatttttgccaagacagagttgttttagtgggtatcttttaactgaaaaaaaatttttttttgagacggagtcttgctctgttgtccatgctggaatgcagtggtgcagtctcagctcactgcaaccgccacctcccacattcaagagattctccagcctcagcctcccgagtagctgggactacaggcgcgtgccaccacgcccggctaattttttgtatttttagtagagacagggtttcatggtgttagccaggctggtctcgatctcctgacctcgtgatctgccagcctcagcctcccaaagtgctgggattacaggcgtgagccactacaaactgaactttatttctttggtgtatccttcttaaaaaatggagaatttattcagaattacataagcagctggagatttgactgggtcattttgatcactagtaggagttaactgcaattcaacagtgttctcagcagcagacattattttacttcaaagtcctagtagttttaaaagagaatctaattacaagatattttctgaaaagcatttggaaattgtttcccacttgtgcagttttaaataatcacatccctttcctctcctccaaaaaagtcctcaacaaatcatatattatttaggctatattatttgctactttcttgagcagccttaaggaaaaaaaacaaaaaaataaaaaaacaaacagtttggaggaggggcaagtggtactgcttttaagatctaagtcatgtcaattttgtaatggtgcatggccctcctgatcacacctctgtggagcaggacctagaaacggagatgaggccagaaactagaaattaggtctaggctatgaaagatgtaggagcgcaaaagtgtacttagaagaaagctaaagattcacttttataagccctttgaaatattttgaaaactttttgttaaagaacctat

SEQ ID NO: 12607 - DNA, 1024 bp, Homo sapiens
cacaagttctcataggttgtggtggtcagacagtgcaattaattatagggctagctaaaagggaaaatggaaagtttctattacagtgaaataaattgagttgaaaaatagtcgatgggattttaaaaagccccatatgttattctatatactcgttgacagtgacattttattggaatgatagttcatgtcagaagaatgaatatttatgggacattttttcaataggtcatagagatgacttgtgtgtactcccttgttaaataatcttctctttcaaacacaggtagacaatgtgtgcatatttcagattgcagctctaataattgcctgtagtcacatgtagtttatgtgaaagcaatttatctctttacagttttaagttacacgtaaaataacaacgtttgctgtggatccatcagttataaaaatgattatgtctaaaaactggtatgctgaaagaattttctcaaaataaacaatttcttcgggaaaacatgaggaattatttgagaacagtgagaatttcacttaattttattgtgataaatcgtattttaaaaacactccttgtgacaaaactcaaaagcaaacatcctttaaatactcctttcccagctgtgatttttttttttttttttaaagaatagatgtcaagttttagggataaaacaccaagtatttaatgttagtggacactaaagtatcaaaatagtgacccacagtgtatatcttgagtgagaggttttctcttttgctggtgtagtagtagtagtagtagctctacaacaaagattgcacatagaaaacaaaagtaaacaacatgtgtttattagagtacttcgaaccaagttgtaaaaatcacaaacaaaaccaataacctttaaacttgcttttatccatcttatactgaatagtgtctgaagaaaatgagagttgaaattgtattctttgggcaatcatttgcataaaatgacattcctaagaaggcacattttatttagttgtcactttatttcaaaaa

SEQ ID NO: 12608 - DNA, 1058 bp, Homo sapiens
gttctttaagaaatcacactgttttccatagtggttgtactagtttacattcccaccagcagtgtaaaagtgtcccttctcaccacatccacatcaacatctattattttttgattatggccattcttgtgggagtaaggtggtgtcatattgtggttttgatttgcatttctctgatcattaatgatattgagcattttttcatatgtttgttgcactgtatatcttgttgcatttgcttttgggttcttggtcatgaagtctttgcctaagccaatgtctagaagggtttttccaatgttcccatctagaatttttatggtttcaggtgttagatttaagtctttgatccatcttcagttgatttttgtataaggtcagacagatgaggatccagttttattcttctacatgtggcttgccaattatcccagcaccatttgttgaatagggtgtcctttctccactttatgtttttgtttgccttgtcgaagatgagttggctgtcactatttcgctttatttctgggctctctcttctgttctattgatctacgtgcctctttttataccagtaccatactgttttggtaactatagccttgtagtatagtttgaagttgggtaatgtgatgcctccatatttgttctttttgcttagttttgctttggctatgtgggctcttttttggttccatgtatttggtcccctatatttcgctcacctctctaaatttgtctcagcttcaggtaaggtcaaatcctcctgtgatctggaccttcaggttacccagtgaggatgcgtgtttcaggggcgatgttccccctctcacactatgagcgctcacagtttttcagctgtcttacggagcctgcagtggcaagccgcttccttcaaagagtctgtggattctccctgctttcctggcatatttctgcgttagcaaaaggccatgatgtaggtctccatatgctgctctgtccattcaagagggagctgctagttagtgctgcctcctatccaccattttttcaacaatcattatcctttatatgta

SEQ ID NO: 12609 - DNA, 1046 bp, Homo sapiens
atgtcacgaagtcagataaaattatggcatcttaagggttggaaggaaacagaagttctgttgctcagcctcacaccaaagcaaatccagaatgctcacaacagggagtcaccaaattacagctgaagttcttaacaagaaaacatactaccccataaacctttctgttttaagtagttctagtttgaccttttttctcctatttgtgaattaatgtagctccccattaccacacttggtcctaggtttttcattcacattacagaagagctgttatatctcatgccaagtcttcttttttctagactttacatccataatcctttattcctcaaaagacatggtttccaaagccttcaccattatttgccatttagatgtgccccaatttgctaaagttccgcttaaaatgtggtcacttgcataagttagcatgcttctgtctacaagtaaaggaaaagccaactaaaagtgttaccctattcacataaggaaacatctggcgatggggtggttccagatgcttactgatgatgacggaccctagctctttctgtctttcatctctgccatcctcaatgcaggggatttttatcctcatgttcatggttgcaagcagcttctagcaaaacctctttaaacataggcacattcaaaggcagaaaaaactcattttcctcacacttttctttttaagtaaatctctcctttccagtaatggctcagttgacttccctttacatgtcactgtacctaaatgcatcacattccctcctgaaccatctggttaagataaatcaccctgggctgggcgtggtggctcacacctgtaatcccatcacattgggaggcaaaggtgggtggatcacctgaggttgggagttcgagatcagcctgagcaacatggagaaaccccgtctctactaaaaatacaaaattagccggttgtggtggtgcatgcttgtaatcacagctacttgggagtctgaggcaggggaatcgcttgaacctcggaggcgaattttgcagtgagcctagatcgcacc

SEQ ID NO: 12610 - DNA, 1052 bp, Homo sapiens
ttggcaggagttacagcatataccaaagcaagagactgaaccacatatatatagttctttaaaaaaaagtcaatcagataaatcataccttcttccctgggaagcagtgagaaacaggaccaaaagaatccaagaggactgcatgactgaagttcctcctcaaaaataggaggaatctccccaacaagatactgaggttagaattagcccctgaggcaacagcatgaataatatgggcattcctttttgggatcctcccctgtgcctgtgcccagtagtagacttcagtagggtttgcatatagactaaaatattgagggtagattatgcagctgctaagcccccaggaagggaatgattccctatctagttaacaaacttggtgtatctcacccagaagagcaagctttcctttcccacagtcactagaggtcagctatggcaaatagaaacagcatttataggcaagaaaatgggataaacatgaacaagaaaataggaaaatacaagacattcaacaattctgaaacatttgaaaataacagtactaatcagcttttataattataagctagaaatgctctctagctgattgagtagaaaaggagcttggcaaaagataattggaatgaattgaattgagagttcagagataaactcttacattcattgatctttggcaaggctggcaaaacaagtcaatgagggaaagaatagcgttttcacaagtggtgatggaatgactagatagccacatgaaggaagctgaacttcttccttatgcaggcatactttaaatatattgctgattgggttccagaccaccacaataaagtgagtatcacagtaaagcaagtcataaaaatttttcagtttaccagtgcatatgaaagtcatgtttacactattattatgtctaaaaaatgtacatagcttaatttaaaaatacttgattgctggctgggcgtggtggctcacgcctgtaatctcagcactttgggaggctgaggcagatggatcacctaaggtcgagagttcaagaccagcctggc

SEQ ID NO: 12611 - DNA, 1359 bp, Homo sapiens
agaaaagaagtttaattggcttttggttctgcaggctatattggaagcatgatgtgggcatctgctcagcttctggggaggaggcctcagggaacttttacacgtggtggaaggtaaagcaggagcaggcacgtcacatggcaaaagcaggagcaagacagagagtggcgcagggaggtgccacatacttttaatcaaccagactttatgagaactcactgttgtgagcacatcaccaagccatgaggtatctgcccccatgactcaaacacctcccatcaggctccacctccaatactggggattacaattgaacatgagatttagaggggacaatatccaaactatatcaggggccaaccataaataggaaattccaattcctagttgcttcccaggagcagggtcagagggagaccaatttccttattacacagtagtctctgtggaaggatctaaaatgccttttttgctttacggaactacagtatactatatatactgtattggctatactgtgaatataattctatagctaagaactctgtcctatttatactaacaatcttactcagtttataatcacctaacgtggtctaattgcaatgtttgagaccaacacgataatatatgatctattcttaaaaaataaaagatttctagatttatcatttataaattgttctggtttattttgataagtctgtggctttgagacttagttttatgtgaaaagtttttatttaactcagtgattcccctctgggaccaattttgccccccaggggacatttggcaatatctgaagatagttttggttgtcacaactggacagggatgctgctgacctctagtgagtaaagaccagtgatgccgcctgttaaatcctacaatgtgctggtcagttccccacaatgaagaattatctagcttaaaacgtcagaagtgccaatgtttagaaactgatttaacagttattttctcattatgcagttactacttactttacattcgatatacagtcatgtgttgcttaacatcattaactgtacttagatggtatgtagcctacttaaactcctaggctatatgtatggtatatcctattcctcctaggctttaatcttgtatatcatgttactgtattgaataccgtagcagttataacacaatggtatttgtgtatttaaaccttaccaaacatagaaaatatacagtaaaaatacagtaaatacagtataaaagctgtgttataatcttatgggatccacatcttataagtggcctgtcattggcagaaatgtcattatatggtgcatgaccatatgctccagctttttaaaagactttaaattttag

SEQ ID NO: 12612 - DNA, 1027 bp, Homo sapiens
attgtgtcatttgacttatagttggcatcttttactttagagatttgaaaggaaaatccaaaaaagttagaacaaaccaaactaagaaaatgaggtggtcaagattaagtagtaagaatgagaatggagaaagtgttttctaaggccttacattcctcactattccctgatagaataaattgaatgattttatttaggaagaaaaccttttcaccaaaatatctccttaatagtacaggtctgtaatcactattgtgaaatccaaaaggctctgaaatattataagtttgtgaaaaactcatttggtggcaaaacctgacttatgccaatacttttttttattctttgcctgcttcctataaatatttatgttttgctgcagaattgctatttttattagtgctgcctcagaacctgctgagagtgttgcatggtatatcctgtatataccgtatcatattactgtcgtgaaatctaaacatttctgaattctgaaacatttggctttccaaaggttttacgtaagggattgtagacctgtgctgaaaattctactagttgagataaattggattttacaaattaatatagggagtgtatacatagctatgtctcagttagtatttttctttcttctgattgatttgcccattttgttttaaaatttgatttttatgttcacgttataccaatttgtaatctacttttgattttactatagctgtgtgactttggacaacttacctaacctaacagacttttaataatttcccttttttttttttttttttttttgagatggagtctcactctgttgcccaggctggagtgcagtggctcaaactcggctcactgcagcctctgcctcccaggttcaagcgattctcctgcctcagcctcccaagtagctgggactacaggggcgtgccaccatgcccagctaatctttgtatttttagtagagacggagtttcactatgttggccaggctggtctcgaactcctgacctcgtgatccacccgcctc

SEQ ID NO: 12613 - DNA, 2030 bp, Homo sapiens
ttgtaacaatatctgtatattgtaataaaagttatatgaatgtgatctctctctttctcaagctatcgtactgtaccacaggtaactgagaccgtggaaagggaaatcttgggtaagggaggactactgtatatagcaggtgtctttctctttcatattaatttccaactaaaaccggatactgattcttgttgggtgcttggtctaggagatgttgcaatattagcatactagaatcctggaatcagaagggatttgttcctatctcagagaaggaaattattaaaacattgacatttgtgacttgtccaaggtctcacagatagtgttgaatggtaaagtcactgatccagtacccttttcattgatttttctgtgctgcctattaaggtgtttcctactcgcccccaccccacctcaacagtttgcttttctttttacccagttttcaacactactcttgttttaccatcctgctgtagtatcccttaggagattcttttatgacttgagaatcatttgactctgcggtcctttgaagttagaggaacataatgttttgactcagcatttcttgaaagttgggggatgtctcaggccattttatgttgctataaaagattatggggctgggtaatttattttaaaagacaggttttatttgtttatttatttatttatttttttgagacacagtctcactctgttacccaggctggagtgcagtggtgtgatctcggctcactgcaagctccgcctcccgggttcatgccattctcctgcctcagcctcccgagtagctgggactacaggcacccaccaccacccccagctaaatttttttatttttgtagagacagggtttcaccgtgttagccaggatggtctccatctcctgacctcgtgatctgcctgccttggcctctgaaagtgctgggattacagatgtgagccaccacgcccggcctatttatttatttttgagacagagtttactctgttgctcaggctggagaatagtggcacaatctcagctcactgtaacctccacctctcaggcttaagcaattcttatgcctcagcctccggagtagctgggattacagtcatgtgccaccacgcctggctaatttttgtatttttagtagagatggggtttcaccgtgttggctaggctggtctcaagactcctggcctcaagtgatccacctgccttggcctcccaaagtgctgggattacaggcgtgagtcaccacacccggccaaaaaataggtttatttataaagaaaagaggtttatttagctcgtggttctactggctgagaagttcaagggcatggtgctggcttccagatagggcttttatgctgcatgacaacatagtggagaaggtaaggggaagtggacacttaaagagggcagagcctgagggatgtcttggctttataacaacctacgcacgtgagaactactttattttctgtgagaacttactactgcaagaacaataccaagccatttatgaagaatctgcccccatgacccaaacacttcctacctactaggcgccacctcccaacactgtcacattcgggatcagatttcaacatgaattttggtggggacaaataaaccatattgagactctagcgggaaaacataatgtctttttttcttttctttttttgaataattttccttttttgcagtattacactttgctttagtactgcagtttaaacactttttaaataagttgatctcttatcaattacatgtgttttaaattctgcatattgtatgcttaggacaaataatttttttaacagtgggtgtggctgggcacggtggttcacgcctgtaatcccagcactttgggaggccaaggcgggtagatcacctgaggtcaggagttcgagaccagcctggccaatatggtgaaaccccatctctacttaaaaatacaaaaaattagccgggcatggtggcgcatgcctgtagtcccagctactcaagaggctgaggcagg

SEQ ID NO: 12614 - DNA, 1419 bp, Homo sapiens
ggagagtagtttttcacatgggaatggaaacttctaaagagaagtcgtaacaaatgtgagaaaggaaataaaagcagaagctacctttcagctcaagacattagtgtgtgtgtgtgtgtgtgtatgtgtatgtgtatacacatgtacacacctgtgaacaggcgcttgcaaatcggcaaagtggacgtatatttaattaagccaggacctgaaaaggggtagggaagttttggatacagacactctcttctccttcgctcccttaggctaagggcatactgtgctctgcacaaggtttcctgggagtgggagttgactgggcagacattcacctcacctcggtggagtcatcgtatagtttaaagcagcagttgtcaaccagggtcagtttgtcttgaggtgacatttggcagtgtctggagatatttttaattgtcaagacttggaggggagggtaatactactgccatctagtgaatagaggccagggatgctgctagacgttctacattgcacagcatattccctcacaacaaataattatttgcccaaatgtcagtagttccgagattgagaaaccagcttaaagtgtacaggtgtgtgtcgtatgattgagctagggttctgtgctagtaaagttgttttgcctgcaaacatcagaaagctgatctatttaagtaaaaagggaaatgtaacagaaagcagaagaatatctgaacaaccaaatcaaggaaagaacaggaaccagctagctcctagaatctcattggaagagttcttggaccttcctcttaaagtagcagcagggttttttaaccttggcatcattggcattttgaaatagatagttctttgttgtgaaggctgttctgtgcattgtaggatgtttaatgtctccagacattgccaaatgtctcataggaggcaaaattactcctggttgggagctacagctttagagtgctggcctatcttccataattcccagtctttgatctctcctgtcaggtttcagaatcccctagagagaaagcctttgtgacccagttttgtctacccatggttcaattagcaatggcaaagggttgtacagcaaaaatatggtaatggagagggctattttgagttaggcttgttgctccattagtcatctgtaataggcagtgcactaaattagatttccaagggcctcatttgctacattaaggaaattgaactttatcctgggggtgaggagtgactactaataaaggtaagagggatatgctcattaaagcagtcttatttttgaagtctagggtttaggagcaatatctggggtggaaatacggagtctacaaatggactctgagtaacttaagtagaaaatggggccaggtgtggtggctcatgcctgtaatccaagcactttgggaggcc

SEQ ID NO: 12615 - DNA, 1038 bp, Homo sapiens
tggcatttgtctgctaatctgctgtagcgtttcatgtaataatacgggtatttctagtcggcaaatgaaactttattcttggttcttggcccgctgattgagggaactgcattctcacaagcatcaggtaacaccctcgccccgctagaacccaagtgagggtgcacattctttaactcgtttctcaccctccaaatgaaggtgcagattctttggcttggttaaatccctccacagttttctggggagcatacttcttgctcccaagcatcacaggcgctgtcctgtcttccataaccgccttcagttttgttccgcctctcttctacctgtaaatggtagaaaggactttgtcaagtcacacctattctgttgaactttcccaaggttctctagcccatggtgttgttcatttttcaactcgcagctcttagttatgccatgtctttgccaaataacagtgtggcatcacttctgatgttaactatttttttttgtattaatgtaacttgtttttaatcttctctaatggctctggatgggaaaaggactgtgctttttatcctacacaatacttggtgtacaggaagctttctgggaatattttgtgatgcattggatagagctttattatttttaaaagtgggttttttgtcaaaaatagttattgttttcagcttttttctcaatttcttgtactagctatattgcttcgtggagaactctgattgaagttggttatagtggtactgctgctgtacagtacttttcctgtgcgaggattacattgtcccactatcctccttactggccccttggtttttaggggtagtgaggggatcatgctaaaatattcctattctgctgattagaaaatgagattcccaaaggccgcggccatatttctcttattatttggtttatcttctgtgcctgcatgacacaatagtaacataactaaggacatagtaacataactaattacttgtttgatattgaataatatatttcattgggaggaaaaatatgcacctacgc

SEQ ID NO: 12616 - DNA, 1029 bp, Homo sapiens
atgaactacaaaaggatctggtaaaactgatttttaaaaaacaaaacaggccaggcatggtggctcacacctgtaatcccagaactttgggaggtggaggtgggaggatcacttgaggccaggagttcaagaccagcctgggcaacatagtgagacttcatctctacaaaaaataaaaagtttgttgggcgtgatggtgcacgcctgcaatcccagctaattgggaggctaaggcgggagaatcatttgagctcaggaggttgaggctgcagtgagccgtgattgtatcactgccctccaacttgggtgacagagtgagaccctgtctcaaaaaagaaaaagaaaagagaacaaaacaaaacacatagtcctgtgggtacaagtaagcatgcattagagaagggtaagttgattttcacagtgccatccaaacaaacttgcccctcagttcatgccattacgagatcttggcagtcatccatctggcctgtgtttcttggtgcccaaggagaactcagccacttttgccagatactggcctcactttgttagatgatgattttatgaatatggtgctctagtaacggcttgctcttcaagggacctaaagacagaggaccccctcccccaacccgctggctgcctactcactcattttgagccccaggtgtggtatcttcttgaaataagtgtttattatgaaaaatatctccacagtaagacagattcttcccttgaaaaatataataggcccacagacttgtttccatttgaaaacggcagtaaaaagtatactccctttatgccttttaggaataaattacagactatggaattagaaactttggtactttttatttaatatatgagattggtcattttatttactttatctgggaaagttacagcggacttctggatagccataagaggtaggaacctggctgatgtaattcccctttgattcgttaggagtatttcttagtacctacttgttgacttctttgtgaatgtcaagagtgcacccca

SEQ ID NO: 12617 - DNA, 1031 bp, Homo sapiens
tcgacatataaaggagacatttttaatgatgaaattatcttatatcctttgcttagggtgtaccagtgatggcaataagaaacaaaatgatatcagaaggactagacccagatcttcttgagtaagtaattcttctaatataatgatattattgccaggacattgaatttgtcagttataataaaaatatttcaaattctctgtatttttattcctacagtgttttatggttgaggatatcatctttgtaaatagtgtgtctgttatgttaccaaacagaaaaatatcatattctactaagaccagcctttacacattttaggaacagtttcaatagattagtaattattctagatatccaaaggagctggaatttaatgacaattttttttgctttttttttttttttcctttttgtgctacctctttcttggcttgattgtttttttgtttatttgttggtttgtgcttttttggtgggggggtgattattatgtaccagggggtagatgatttcatgtaagatcttagtttgtaggaaatttagtctgctataatctaggttaagccagattgagaaataaataggctaaagctgttctgggtctatgttaatggttattaagaaactagatactaatttatgtgagttttttttaaccttaaagtatttaatcccttattgtgtgaattttataaaatatttttgagaaatgataaaaaaaaattgtggctcagaaatttgacaacagtttatttcatccaagcaaatctggctgtatagttcatcttggataaaatatatcgtaatgcattcttcagaagaattctgttttgcaagtatctaggtacttgtaaagaatctttccaatttggggctgtagttcaccccaatgtatttagctgtgcactctaagcattcattactgtactagcagtatactttggaatttttcttggctctcagtcctccaagaaaatgtgtacactttggaggtaaaacattatgaagtagtctttttctcatattt

SEQ ID NO: 12618 - DNA, 1028 bp, Homo sapiens
tgcttgtgcagtgaatcctccaaggtaaacaagactcctaggtcctagtgaatgtgcctccaggccaaacccctggcacagaggctcagggtgggttctctccttgccaagccctgtctcagccagaaggaggggcttggaaccaccactgctgttcctcttaagagcagggaccccatccaagcagcagtaagcgtggggtgggtggccgcccctgctactgtgtgacacactgcttctgggtgaggactctggcgcagccaccgactgaagcagcccaggtccagggactgggtttttggagaggaccccatcatcatgttcccatttttctctcttacctcaaaatgctggaagccgattgttctccggtttatccgaaagtaggagtaagcagccaaggcaacagccccagtcaccaggatgatggcaaagaagatccctgctcccaagccagtgtgggtcaaggtctgaacacaaagaaaggaaaggggcccattcttaaaacttctgactccccaaaaggggaacccttggtggcccgaggcattctggagccagtggggataaaaatactgacatgttaacatgtatctggcccttattactgccagggtctaatacccttctgtgaaataacccattgaagtgtgataataacccaaagagatagggagagttattattgtgggagaactggggcacagagaggtgaagcacttgcccgatatcacacagccagtcagtggtggaagtgggctttgaacccagtctggctttggagcttctgtgcttaaccactatgctgtggaactctccagcagctcacctctcccctcatgcttttgcaaaaaagaatactaacaaccaccatcaccaacttttatatagcatgtactgtgtgtcaggggctgttctaagtgttttccatttctaacttacaatccttcccaaaacccaggagggaggcattatgagccccattttgcagatgagaaaattgggactcagagatgctacgaagtgga

SEQ ID NO: 12619 - DNA, 1045 bp, Homo sapiens
gctctgttgcccattctggagtgcagtggtgtgatctcggctcactgcaacctcttgcctcccaggttcaagcaattttcgtgcctcagcctcccgagtagctgggactactggtacatgccaccaggcctggccaagttttgtagttttaatagagatggggtttcaccatgttggccaggctggtctcaaactcctagcctcaagtgttctgcccacctcagccttccaaagtgctgggattctgggtgtgagccactgtcatgcctggcctcgtcatgactcttttctctttttttttttttttttttttgagatttagttttgctctttttgcccaggccggagtgcaatggcacgatcttggctcactccaacctccgcctcctgggttcaagtgattctcctgcctcagcctcccgagtagctgggattacaggtgcccaccaccacatccagctaatttttttgtatttttagtagagacggggtttcaccatgttggccaggctggtctcgaactcctgaccttgggtaatccacctgccttggcctcccaaggtgctgggattacaggcatgagccaccgtgcccagcctatcatgactcaactgggatctggcacactgcactgggtgttttgttctctgatgtgcacattgatgaatgcatattggtacaagggaaatgaatctgttttcagccatttaaaaaattgtgttgtaaagcaaacaaaaatagcttgaacatttaaaaattactgtttaatattgtttgactgattttctaagaattatgtgaacaatgatgagtccagggcagcagccatcacaaatatgacagtccagcaaggcccatggaggtccctttggaagggacttgcacagctgattttctttttccagtgttgtttttacgggtgaaacgtggcttttgaaatactttagttgtttggcttagagctcccactttccccctaacatagtgcctgtctgttttttaaaacattttacccttcggcactattttctgctattcccattaa

SEQ ID NO: 12620 - DNA, 1034 bp, Homo sapiens
ggcaaaaactagaaactgtaactgcccctgattgggcaggcatgatggggttgacttcatgtgggtctgagtgttgcttttggaaaagatacagataagccttttgatatttattttgtaccttacggagaataattctcccaatggttaagacaggagctagcagcccacccctccagcctttccccccatgcagggctgaaaggcaagcttcacattggaactctgattttgcctttttgtttactgaggtcctggaacatcaggtttcctgggataggtgagaccacttgatgccatgtctgtattctagcaggtcaagcttgaaacggttcttgactcctccatggaacatttcctgaacatttacgggctatgcattgggaactgcaggggcacagtgatgggcaaagattagctgcttccagaaggctgatttcgtgggctccacaatggtaaaacgctgctgtgagtggcagagaggttccccaggtgatggccagttcccaaatcatttggtactaaggctttgacattctggcacatcacatcaaatagaacacagcctccctggaaggacttaagtgagaaagaacaagagaagctgcaactcctggacccttttgtcctcagtgtgtggttcctgcgtccttccccagcatggaggagggcaggagagaggagatgagagctctggtcaaaacctgccagctagtggaacagccttctgtagagccttctgcaagaaacgagtgggtttgaagaaccaaaacatttgtggtaggtctcccaggagcttgttaaacctggaaacaccacctgagttggtttcatctgctcattggaagaaagaaaatgaaccaggaaaaagcatctttgtcatgaaatgctatgccatgccacccacccagttgaattggaatcctgttaaaacatgagatttaccagaaacagtcctttgtctagatggaaacaaacaagatcctggcttctctctaatgagttaccaactgagaggtgcttggattggccag

SEQ ID NO: 12621 - DNA, 1094 bp, Homo sapiens
gaaatttgactttcatgtaatttttacatgttaggaaattcttctcttttttttcttttgaggcagtctcactctgttgcccaggctggagtgcagtggcatgatctcagctcactgcagcctctgcctcccaggctcaagtgattctcatgcctaccctcctgagtagctaggattacaggtgtgcaccagcatgcccagctaatttttgtatttttgaagagactgggtttcaccatgttggccgggctggtctcgaactcctggcctcaagtgatccacctgccttggcctcccaaaatgctgggattataggcgtgagctaccacgcccagcctgtcatgaaattattcttcttttgagttttttttcccccaaccattgaaaaagaaaaacccatttgtaagcttataggctgatagaaaaatgggccggtggctggactgatgtaggctattgcactggctagattgtaatatctttctcaaacaagggcaaagatatgtagccaatctgttttgcccctaaagagctgattatgcccatgaacaaccactggagatggagatggctgaagtgcctgtaggatcagttctctgtggggcttcggttagtcttttccaatgttaagtacccactctagagtgcatggtttcacttgaaagattaatgatagctaatgaacacacactgtctttgaaatattttaaagtggatttcagaaccagaggctcttgttttatggagtttggccttgtagggggacagagctggagaaagggggttgggcaccaggagaaatcttcttttttcaatgggagagacttgagcatgtttaatggctgatgggaaggatgcaggcgagagggctgttcctatgagagagatgataaatggtgggaaaggttcatggcagggcagccagcagggcgccccagccagctgctgggtgcttcgtgggaggtaaggcccgaagggtggccgagtgaaggcgcagagctcagggtccccctctgggcatgcgtccctggcctctgattcctggggtctttctcctttacatgtcccttcaacagcctcagggttcagagtca

SEQ ID NO: 12622 - DNA, 1073 bp, Homo sapiens
attgcagttggattttgcagagctgctctgcaacacaggttttgcatcacgtgcagtaaatctctattacgtcttaatatcttcctgccactgtagccgtgggaatggggaagcaggtaagttttaggttgtgacagggacagagtgtgctgttagtatttagtgggtagggatcagggaacgctaaaatatcttttaacttgtgggacaggcctgttcaccaagagctgttctccacaaattcccacagtgttgagaatcactgcactagggttctaaaaaaattacttgtatttgtataataatgggcaagttttgaaacacttttacccccatgtttattctgcagctggtaagcaggtagtctgttcctctctgttaggtgatttgaagcatcagggtgtggtgccctgcagttaatgctttaaattcctcttgtcccagttttccacgtgtcacagtgactccaggaagaagaggcaaaccaagaaccatgtgcagggactcaaaaatgcttggtgggactcaagaaaatgagtgtgatgaaaaacagctataaactgtggcttgctgctttgttactattttgtcccactgactggcggctggagtcatcccaaagacagtggcaagggagttcctacatgggagagccgcaaaccgtcccatgatggggctggttgggattccaaagaaagaagcactaaactctggggtgatcagtgcaaagcgcttattagaggaaccgacttacagagtgggctgctgtgcatcctatggcacagggtccccaacctttttggcaccaggggccggtttcatggacgacaatttttccagcaggtttgtgggggtagggtgatggtgtcaggatgaaactgttctacctgagatcatcaggcattagattctcataaggagcacacaacttagatcccttgcttgtgcagctcacgatagggttccgctcctttgagaatctaatgccaccactgatttgccaggagttggagctcaggcggtaatgctctctcacccactggacgctcgcctcctgctgtgcggcccggttc

SEQ ID NO: 12623 - DNA, 1031 bp, Homo sapiens
aactccctttgtccagatggccagggatcatttgttcacagtactggatataaattactgtctatcatgtgggactttattcagaattattcacagaaattacctcttccaagcactcttttgaaaattgcattggaaattgccaccatcaccatggaaactttggctttcacaaggggctgcctatgaaaatggaccagaattggctgggtgtggtggctcatgcctgcaatcccagcactttgggcggctgaggcaggtggattacttgaggccaggagttggagaccagcctggccaacatggtgaaaccctgtctctattaaaaacacaaaaattagcctgatgtgctggcgggcgcctgtaatcccaactactctggaggctgaggcagaagaatcacttgaacccaggaggcagaggctgcattgagctgagatgggaccactgcacttcagcctgggtgatataacaagactctgtctcaaaaaaaaaaaaaaaagaagaagaaaatggaccagaatttagattttgtgtagggcctggattgtcagactttctagggacagaagttaccatgactgccatttcacttgtactgttactcaggctatctcagttgtattttcgctgattaaaaatgtatcttttggcaggattcaattcgagacgtccacatcaaaggaataatgtacagagcaattgaagcagacattggtatgtgctcagcagtatcacgaagagagtttcagcctttctgtttcttttgcaaccatgccggcattttactttgcattccaggtgctaagcagaggctgcatgagtgctctgtaaggacctggcatcctggcatgttagccgtctcctctttgtcctggaacttgacataattctgacttaaaaggagaggcactggcagctatagccacttagttgtttccacttagaccgaggaggcagggtctttgtgaatgatgcaccagatgtacccgtgttccaccggacaaagcttcttccttagggcctttatt

SEQ ID NO: 12624 - DNA, 1048 bp, Homo sapiens
gaagtccagcctgtacctactcacccatgagtctgcccgagcaagggtgcctcttcttttttttttgaacagagtcttgctctgtcactcaggctggagtgcagtggcgtgatcttggctcactgcaacctctgcctcccgggcctcccgggttcaagtgattctcctgcctcagcctcccaagtagctgggattacaggcgcctgccaccacgcctggctaatttttgtatttttaatagagacgaggtttcaccatgttggccaggctagtctccaactcctaacctcaagtgatcctcccacctcagcctcccaaagtactgggattaaaggcttgagccaccacgcccggccagggtgcctcttcgtcacatgggttacattcaagctcctggctggggggcctgtgccactgtagttgcccagaagggatgcctttttcctttgcctacaaaggttccatgtggctctctaaagtcctgcaaaagtcatgcaagaatccagttgggggacgggggatgtagacaaatgtaaatgtttacgtgagcatatacaaagtcctcacttactgttgcccataggatcttggcatccgtgactttaagtgaaaccgtgtgcaacaggtccttgaataacgccaatttattcgatgtcattttagttttgacaaggaaaaaaattgattttgctttatgtcgtttcacatagagttgcagtttctaagaacctactgaagatgttaaggacttactgtacaaatcatttgtatttataaatttatgtattttatggtcacatgtttatatatttatatatgttctttaagctgtatgaactttttagtactaaaaaagtttatattattttgtatgtatttacatagttataacatatttataaaaatatgtgtttatttaaatatattttttaaagatacatatttacacattaaaatatttttgttatatatttataagtaaatgtaagttttggcagcgtgaatcctgggttttaggaagatagaggataaattatagtttctcaat

SEQ ID NO: 12625 - DNA, 1037 bp, Homo sapiens
tgaccagccttgaaggtgtgactgttctgggaacacttgttggcctttattggtcgtgcctgctgggagggaagactaggcattgggcgcacacacacacactgttggagactctcctataaaacctggtggccacagagtgcttccttccgtgcagggagacaatagagaaacttctctcttttggtctttgctctagatattttttctgtgtgtgggggggcaggttttggaagtgtcccgtgaccttgtaatcacaagctcgtcctcacatggatttgggtttgaatttattcttcttgtattgtctggcaatctgtatgagtccattcttttacattgctttgaagaaataccggagactgggtaatttataaagaaagtggtttaattgactcacagttccacatggctggggaggccttgggaaacttagaattgtggcagaaggcacctcttcacagggcatcaggagagagaatgagtgccagcaggggaaatgccagatgcctataaaagcatcagatctcatgagactcactcactatcacaagaacagcatgggggaagctgcccccatgattcagttacctgctcccgcccttgacacatgggggttatggggattacaattcaaggagagatttgggtggggacacagagccaaaccatatcacaatcccaactgagaaactgagtgatagtgatctgggactcctggtagaagccagtgcaaactctctggataaatagaccgtaaacccaggcctcctaggattctcaagattagatctgagcttacaatccaaaatttaaaaatacacaaataagccaccataagggagaaccagcagactcagcagacagcacaattaatatgaataggacttaagatattggaatttttaggtaaagaatatatgtagtgctatctatgagtgtttgaaacttttggagaaataagagatgaaatggaaaatgtgagcaaagaatatgaaactactaaaatgatcagacaggttttaaaaagaaccaaa

SEQ ID NO: 12626 - DNA, 1089 bp, Homo sapiens
tgcatactgctttctgctttgcatataataggcacttaatatttttgaattaataaattaattcctaacgcctattttctatgccaggcacatggtagagagtcagtagatggtgcaggaatgaatttccagatgtggaaagttttattcaaagctgtgaacctgtcaattgattctgatgccagctatcctttgtgagtcctgcagtacgtaatgctgaagaccttgccaggatgatagactcatataaacacagggttagaaagggacttagatcaaccagagcttctcataataaagagttatcattgagtagcaagcaagggaactttttgttattttttactctttaaagtcttctaggttacattgaattacagccttattaagggttagacatttatgttttttgttttgttttttttgcagacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataacgcgaaatagaatatttgtaagtctactatatgggttgtctttatttcatataaattaagaaattatttaaaactatgaactagtttcattaattgaatttgctaagtggagttatttctcattgctaaactgttttttttcaaattctagatctctgctaactttagtaaatgaacactaaagtggtgagctttgataatgcattttgtggatacaaaatcatcgcctcatcactttctagaatgaaaggctgggggcattgctcaccttttgcgtgaagaaaagacctgtcccttagagccagttt

SEQ ID NO: 12627 - DNA, 1178 bp, Homo sapiens
cgtgccactgcgcttcagcctgggtgacagagtgagactgcatctccaaaaataaaaaataataaataaaaaataaataaataaagtttttctgtgttattaataggaaaatgtgaattgaaacatttttgcattgttgaaaatgaaaataaaaatgaaaacatatatgtcacttcagtgacaatcttcactcatcaggttggcaaaaattaaacagaacaacattacccagtgcaggaaaatgggcatgcttattccttatttatacaatgtgcattttctaagttggtaagacatttggcaaggtcaacatggcaatatctatcaaaaggttgtatgcatatataatttgattcacatgccttttcctcttccaggaatctgtgctacaaaaattctagtacatattaccaaaatacgtgtacaacaatgctagtttcagcattatgtgaattagtgaaaacatttcaaagtgctgaaatgtccaccaatggaagaatatttaaatgaactgtgaaatatgatccagatgttaacgaaagaaggcactctgtctaagcagacataggagattcccaaggcatattgttaagtggaaaaaactagctgcagtataactcgtatagtatgatctactttaggaaattcaaaacccctaactgtaagtgtgtacatgtacatgtatgtgtttctgtgaagaaaaagaactggaaagctatcagattgttaacactatctcttgggaggacagaggaatcagggagggtgctgatgaaaggaagttcagggtgtttcagtattatttgatcattcaaaaggagaatatatttgcatactgcttttataattaaatgtttttgtagtggtgccatcaggaggtactgagatctgtaaaggtgtttgcctataatctaaatggcccttggctgccctgggttttgatgtcttgtgtatgctttctggattttctgtctcatttctcactctccttatcatactattgctcatcattcacttagcctgttgttaacagcccattaactatccatgggtatgaaaactagataaccaaatccaaaaggatggcatgtataaggtttctgggcaagggtttgtccttaacaaaaggcatgaacctcatgactttctgactttggccaggggctatttcccagttc

SEQ ID NO: 12628 - DNA, 1027 bp, Homo sapiens
cttatatattttggatattaacttcttatcaggtatatggtttgtaaataatcgctcccattccacaggttgcttttttattttattgattgctcctttgcagtgcagaaactttttagtttgatgtagtcccacttgtttgtttttgtttttgttaactgtgcttttggtgtcatattcaaaaaatcattgccaagaccaatgccacagagctttccccctgttttcttctagttttacagtttcacatcttacacatttaattatgttattattaaattaataaataataaaaatgaataattacttatttaatatgtaattcattttgagctggttttgtgtatgataaagatccaatttttttgttgttaatatccagttttcccagcaccacttactaaagagactatcctttccccattgtgtattctttgtgccttatggaagaatagttgaccatatatgcgtggatttatttctgggccctctattctgtcccattggtctatgttccattgatctatgtgtctgtttttatgtcagtaccatactttttggattactataactttgtaaatataatttaaaattaggaaatgtgatgccttcagttttgttcctgctcaaaattgcttcagttatttgggggcttttgcggttccatatgcattttaggattttttttttctatttttgtgaaaaatgtcattggaattttgaaagggactacattaaatctgtagattgctttgggtgttatagacattttgacaatgttgattctttcaacccccatcacttttttgagggcataactatataaagttctagaatgttagatctaatagaattgtctgcttcagtcataataatgaggaaactgagacggagagagatggagttatttccctagaatcacacgatcataatggcttgtataagtggggttccaactgtttgccaagtactgttgtaagtacttaatgcatgtaaatgtattactgcatttaatcctcataaagcc

SEQ ID NO: 12629 - DNA, 1032 bp, Homo sapiens
gaaaaactgtttttctcctcatagatggatggtgacagttctacaacagatgcttctcaactaggaatctctgcagactatattggaggaagtcattatgttatacagcctcatgatggtaagcaagccacaattagaaccaaattctcaagttgaagcaagttagaaagtggacatttcattaatatggtgttctaggctacttgtgtctttataggaaaatttacaatcttgtgttacggttcaatgagaaagtctaaaaaggcgtaccatgctatttttattagaaatagtcttcaaaagaatgagtccttgaaaagacttttactataaaaatacaccttgtctaaaatctgtacagtttcttttaaaatttgttatcgacttcctgtttaaatgttaaataagaaatttataatcaattgatagggtaactaaaataattatttagagggtgagttaaatttctagctattatatttcttgcacttatgatttatttttggttttcattcaatattaactttgaactatgtcaggtattagaatggtagtgttggctcagtgtggtgctcacacctataatcccagcagtttgggagggcaaggtgggcagatcacttgagctcaggagttcgagaccagcctgggcaacatggtgaaaccccacctctacaaaaaaattaaaaaattagctgtgcttggtggcatgtacctgtagtcccagctacttagggggctgggggctgaggtgggaggattgcttgaatctgggaggtagaggcttcagtgagccatgtttgcaccactgcacactccagcctgggtgacaaagtgcaaagtgagaccctgtctccaaaaaaaaaaaaaaaaaaaaaggcagtgttatgttggcctatcagaaataatttacttttgtggcattttggtttgtaaaaaaaattttttttttttttttattttttattttttttgagatggagtcttgctctgtcgcccaggctggagtgcagtggcacaatcttggctcac

SEQ ID NO: 12630 - DNA, 1050 bp, Homo sapiens
cactgtccgtgtccccttgtcattatcctacatgctgtgctcttccagcctcattacctggatgaaatccaacactttggcttttgtagtctcatatcaggcctttcaagtgtcacactggacatactggcaccactgtaaactcacggtcattagcttcagctaggcttacactgtccagcactcccctccctttcctttcccattctctgcggtgacagctgtctgtctctccagctgcaagaatcccagcattatccttggtcttcctgtatctctatcagtcagtcaccaagtcacctactaaaaagctgtctagttgttctgcttctcttgatctccagcgctctcacccagacctgatgctaaaatgatcattatcttgcttgaagtcatgccctgactgcagcattgcagtcctcactggtcttctgtgcctatttgtgctcccctccaggtcggtttctgtactgaactgtagccagagggatttttttttttaatgtgatttgtgctcttctgcttaaaactctttgatttcctcttgtccaccggacactgcttgatctagcccctccttagcgccttccaatccaccagtactgtatttcttggttttctctgcctagaacattcgtttcccacctttctttttgcctgactgatttctgtttatctgtcagtctcattttcaatgtcatttcctaagatagcctttcttgacccctcagactagtgaggtcccttttggagtaaactcacatagcacataacaaaacatctttgtttttcttcgtacttggcactagcaattacttaattatttgtaattattttaatagctatatataccacttactgagtatgcccattgtactatgctgtctttacatggattagctcctaacctgtacaggagcctgggaggttaagtcttgttctcatccagtttgttcacggtctcatggtaagtggcagggaattcaaactaggtgattcgattccagagcctgtgtcctggaaggactaataggctctgttctctacccc

SEQ ID NO: 12631 - DNA, 1028 bp, Homo sapiens
cattgttaatatgtaaacatgtaatattataatatgtaatataaatttattcatttatttttcttgctaatcccagagaaattagctaccctcattcttttaaaagctattgtttcctcctgtatacattacttattcaatcagcaaatttacctccatacagaaggtaaatttacctccatatacttcagtaattttgagtttactgcataacttgttctatttatagatagccaaattttttttaagttctgcttttggtcttttcttccttaacctaacactctactctctgaagcaacatattatatacctagcgtctgctgacatgataatctttgtcttaagttcacatctcctaccctccttgcccaggacaaacaattcttattctcataggaatctcctatatgacactgtctcaagctgatttgcattccgtcaatcagatgttgtctactttttaagttagtcactttgctaggtactgaagacgcaggtgtgaaccagtttctctgaaaatagggcatccaaaacagagcctagatgtggcctggctcactgggggggtcccatgggatgactctctttctctcagtctgtgcactatgcttttagtgatagaacttgacatcatgctgcctttttgcctttcctttcatcccccaaaccaaggctcttattatttcgaagtaagtttggcagatattaggccccatattttcttcaaatgagaatactaggctcagagtggtaagaaatttacccaaaggcagaactgaaaatcaaatccagattttacaacttcccactccaggattctttctaatatttcatgcttcctccatacccaaaacacattgtcctagcaaaactttatatgattccaaaacagtctctaccagtgaaacactaatgaagaattgaccacatggaaaagacaatagggcttaaagtacaacctctctctgacagatgtccaaaggcatgtaaaattcatgcctttggaataggtacatgtcttccta

SEQ ID NO: 12632 - DNA, 1069 bp, Homo sapiens
aaaaacgaataaatttaaacccgcttgaactatgtcatcacaatacctttaaaaataaattgcacgggaagaaaactttattcatattgtataagtaaatccaataaatggaatgagaatgtgcaaaggcagagagggaatatcacaaaggtgaatagagcaatttctgcatagttgacaatgaaatttcttagctctataatttagagctagaacagactatgaagacataaatttattcgttttaaagactgagggatcagagaagtgacaaatataactggttagtgttagaaaccagacttctattccaacaatcttttaaataaagtccataaattctgagacagtgtaataattgatgtattagtgatgatggcaccaatatttacttagtacttactataaaccaagcatttgcttagccctttacctatattatcttgtttaattttggcaatcagtccatcaggtaggtaatgataacctcattgtacagatgaggaaactaagacttggagagttttttttttcacttgtagacagtaacagttattcagtgatagagcttcttcaatagcaaacatttgtttcatttgtcatgtataagtattttgctagaaaccaagggatcaaacagaaagaagacatggttttcttctttcggggattgacacattagatccctacaacctaacatgtaagaagtatctgtaagatgagtagtgtttttttgtttgtttgtttgttgtgagacacaatcttgctctttcacccaggctggagtgcagtggtgagatctcagctcactgcaagctctgcctcctggactcaagggatcctcccacctcaacctgagtagttgggtctacagggggctaatttttataatttttgtagagacagggtcccactttgttgcccaagctggtctcaaactcctgggctcaagtgatccacctgccttggcctcccaatgtgctaggattacagatgtgagccaccatgcctgactgagtagatttcatatgttttgaccacagcacttgtaagaaatatgtttattctg

SEQ ID NO: 12633 - DNA, 1050 bp, Homo sapiens
atttctctatttcttcactgtcaagagtccctggcattgggataaactctgcttctagtataacgaaggtaattaactccctggatttaaagttgggaagcaaatatatattgagctccaactctgggccaattactgttgtaaggactttacatactttatgtcatttaatctccaccatgacacagtagggatagacactcttcctaacgctattttacagacgagaaaactgaagcttcagagaggtttcataaccagtggccatttcccctcttatcaatagttgatataagttccgtatggcattaaatcttagagccgaagcctaagtttgaatggctcaagatctgagaacgctctctctctctctctgtgtgtgtgtgtgtgtgtgtgtgtgtgtgtgttgattaatactgctttcccatcgaagtgccaagaacacaggctaatctagatttctattaatcttgtgtcagtggcaatgacagttttactgggagaggctgataaacatcagtctgtgaggataggagtgggccataacataaacacacttctccagaacggctacagagcaaatgaggctgcccagacttggaatgaaaactcctggtgtgagtgtgtgcatgtgcagcgggtgcctctcacacgcacgtgtatttggaagctcatatggtgccccaggcactgccaggcgggaagagaatgcattttcctgtgcgtagccattccatgcctcttctgattgacagggcacacttcataaagcttccaaccaacttcctgcaagcaagtcaggggccttgataagaaagtggaattcagggcaatgaagtgcaatctgagcccggagaatgcattttctgaggctggttgtacaccagctgctttcaatgacattccattcattcagggatgacttttacaaaataggctgcttctaggggctgtgaccaccacagagcctcggtggtattcaggctgggctctctctgggcatgtgaatcatgcagctcatttccaagcctcaaatggaaatcagcttgg

SEQ ID NO: 12634 - DNA, 1045 bp, Homo sapiens
cccctggaagccatgacccagtgacctcttgctcttgcagagtgtttgaccgtagtcacatgtagtctatagaataagcaggaaatagttggtcaaagtagttctccatgggaataggaagtggaatcgcagggtctatttctggcaaagtggttggattattctagaaggagcactggttgtagagttaggaaattccgggctgtatggcttactagcttcttgacactgggaaaaccacttaaccctgtttcctcagctgtaaaacggggtaacagtactactcacaggcctgcttagagcagtgaatgagacactctgtgtttagttttgtaaactgctaagcactcgtgtccaaatgagtcaaagttaaaagcagtggctttggagttagatatttcaaccctgccccttagtaatggcaggatttggggtaagtttcttgatgatttaggctttagtttcctcatctgtcaagagttgccagttcctgtctctgcagattattgtttatttgttcatttttgtttcaaggagtattttctgaactgttactgtgtgcaatgccctgtgcccagtcctggagagtcaataataaacgtgaagattttagacaatactacaatcaaagcaattcatgcttaactgttactatactgggagccttcttaagtggctggccactggagagggaattgaaccggaagtcagctgctctgaaggtgcctacctaggtcctggggagtggtggtcaggccatggctgaaaaattggtcttggtttgagggccaccacatttttctaagggtttgtgtcatcaaccttattgacttcctctccagatccttcctgccacctgcccccagagctctcaaaactaaatgtcatctttacaaggcctggaatgtaagcctcttgcctaggggttgggttctatggtgcagtgtgacctcttggtcccatgatgtattcccagaagtgataagacacatagctttctatgaaatcatgtaattccctaatggaggaaaagaatgattagaat

SEQ ID NO: 12635 - DNA, 1077 bp, Homo sapiens
ggaacagcataaagtcgcaggcatggaaaaaattaaattcatttccttttcaggccaattggttgcattgagtatgttcttgctgtttctcctgtcatttctgcagttgctcatctctgactatggagtggtttaatagattctcattaatattataaaagaaaatattgacaagtgtctgataaatataaattcaagtggtgaaaataaaaggaatatattaggaattcacatatttctgatggtggggcagttagagttcttacaccaaataatgcagctcagtcttgtttcttcattcaatatagtgttcattcattcaataaacatttattgggctgatagccagccattttgctaagtatcagtgaattaaaatgtacaggactagcccagtgggaatgacagtcatgtaaagtggtaggtattagaaatacaggtgccatacttgggtgtattgggccaagaggaaggagtgaccattgtgccatggttggtctagaggtggttagaacaggtttttgaagggctgggggaagtcccttggaatgctttcatgagtaatgggaagcttcgggaaacaggttgttttgccctttgaacaaacaatatacacaaattactgaacatgttggttaaattgcagatccagcaccaggataagaggctgcagtgaaacttctcaggcaggactgacagcaccctggtgaggagactactacaccactgaccatgtggccttgggcaagtcacttagaatggtgatggtgttgataatagagatgatggtggagatggagatgatgatggtggtgatgaagatgatgtgatggtacagggtggttgtcaggactgaatgagcgtgttgaggggttagcacagaatctggcacatcataagtgcttcagtgatcatgcgtgcatggatcataccagaggttaaaatgttgaaatactgttgtcctagttggtgaatagcttctgccctgaaccccctgcatgtcctctctctggaccactatacctctttacaatccagcaactaataggttaatattctagtatagcagagaccaca

SEQ ID NO: 12636 - DNA, 1570 bp, Homo sapiens
tggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttacttttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttttccagagtggttacattctgagaatttcgtaattatgatgtgttttattagcacatggtataaacgattagcaaataggtaagtttactattttaaggctgttttttcttttaattctgaaaccgagatggcctcactcttgggccggggacctcctttgatggactgttagcaagtgtgttcaatgattacttgtctccagctctgttagcttcaagcacaggatctcaaccctcactacctattagaatcttcctaggagcttttaaaaaatgcctgggccctgcccgcacagatgctgattgaataggcataaagaggctggcactgttttttttttttttttttttgagacagagtctcgctctgtcaccca

SEQ ID NO: 12637 - DNA, 1034 bp, Homo sapiens
tttagaagaaagcagaatttaaagccttggcagtttggtctattggctacagctccagaactggagttcagagaattccactaattcaagatatgacttgtcactcagcaaccaccacctcactatgtgaggccactcactcagcctttcttgaggtttagaaatttagaactgaaataatagctggattgtcccacagtgtccttagctgttaaactaagggattgatccagatattatttcagttctaaatttttcagttctaaaattttgtgattctcggaaaaacaaaaccacctttaaatatgctaattctttagaaaaacctattatgaagagtggggatgtgaaaatcaatatgtgcaaatcaaatatcaatatgatatatgcaaatcattccttgggcatacctccaaagattctgattcagttgatctgtggtgaaatctggatactggtagttttaaaagcttctcagttgatttgaataagcagctagtattgagaaccactggatcaatattttgatagagtatctaccactgaactggttttttgatagacccccaaactcatgtgcatgtaactcattagtctttgagaaataacctgacaatatgaaagttatttttttggccgggcacggtggctcatgcctgtaatcccagcactttagaaggccaaggcgggtggatcacctgaggtcagaagttcaagaccagcctgaccaacatggagaaaccccatctctactaaaaaaaatacaaaattagctgagtttggtggtgcatgcctatatcccagctacttgggaggctgaggcaggagaatagcttgaacctgggaggcggaggttgcagtgagccgagatcgtatcattgcactccagcctgggcaacaagagcgaaactccgtctcaaaaaaaaaacagaaaggaagttatttttatttcattttttaccaagaatgcagtctcagccgggtgcggtggctcatgcctgtaatccgagcacttcaggaggccaaggcaggcc

SEQ ID NO: 12638 - DNA, 1029 bp, Homo sapiens
caattcaattaattatttaggaggttttttttttttaagagtttcactcttgttgccccgtctggagtgcaatgctacaatctcagctcactgcaacctcgggcttctgggttcaagcaatccttatttaggaagatttttaaaaatattccacatgagcagttttcttgtctaatttaaatccactttatttccagacttcaacagctcaaatttgtaagtgtatgtgttctgaaagtcaacacccttatactaaaaacctttattttctttttttcagatagaatgagtccatttaagtcccaggacggtggaaactagctagtagattgcagccatgttgtggaagctgctgctgagatcccagtcctgcaggctgtgttctttcagaaagatgcgatcacctccaaaatacagacctttcttagcatgcttcacctatacaactgataaacagtcgagcaaagaaaatacaagaacagtggaaaagctctataaatgttcagttgacattaggaaaattcgtagattaaaaggatgggtacttttagaggatgaaacctatgttgaagaaattgcgaatattttacaagaactaggtgccgatgagactgctgtagccagtattttggaacgctgcccggaagcaattgtctgtagtccaaccgctgttaacacccagagaaaactctggcagttggtctgcaaaaatgaggaagagttaatcaagttaatagagcagtttccagaatctttctttactattaaagaccaagagaaccagaagctgaatgttcagttctttcaagagttgggactaaaaaatgtggtcattagcagacttttgacagctgcacctaatgtttttcataatcctgttgagaagaataagcaaatggtaagaattctccaagagagttatctagatgtaggtggctctgaggccaacatgaaagtttggctactaaaattgttaagccaaaacccatttattttgttaaattctcccacagctataaaggaaacact

SEQ ID NO: 12639 - DNA, 1032 bp, Homo sapiens
tattccccaagaactatgtaactttaaaaaaaaaaatctccattctgagtgttcttttaaaatgaaaaagacaattagttaatataattttctctgtgtgttttcaggcttgggtggcaaattttgaaagacctcgaatgaatgcgaattctctgcttgcaagccctactggacttagtccttatctccgatttggttgtttgtcatgtcgactgttttacttcaaactaacagatctctacaaaaaggtattctctaaaattagagcttattgtttaatactttaaaaaaaaattctgataatacttctttgctttttaaccataggtaaagaagaacagttcccctcccctttccctttatgggcaactgttatggcgtgaatttttctatacagcagcaacaaataatccacgctttgataaaatggaaggaaaccctatctgtgttcagattccttgggataaaaatcctgaggctttagccaaatgggcggaaggccggacaggctttccatggattgatgccatcatgacacagcttcgtcaggagggttggattcatcatctagccaggcatgcagttgcttgcttcctgacacgaggggacctgtggattagttgggaagaaggaatgaaggtaagtgttctaactgatatagcatgccttattttgaaggaatccttaccttaataaaacaaatcctagaagttgtctgtttatagattcatttatggtgtagtttttcagtggataaaacatttaattccccaaatacggggacactttcagagaaaaatggtataatcagacaagcaaaaaggtgaaaactggttaaattgattaacctaaagtcattttaatggttaaaccagcctagccactaagagaactgtaaaatttaacactgaatttgttgatagatatatttataggtgatatttctatcacgaaaagaattcactaaagagttcctagagatagtgaattcatattataaattttaaaatataaatcatttcacctcacttc

SEQ ID NO: 12640 - DNA, 1049 bp, Homo sapiens
gtgtgaacatctgttcttggatatttaggagtagaattgccgtatgtttaactttttgaggaactgctttccaaagtggctgtgccatgttaccgtcctagcagcagtggatgagggttctaatttctccacatttttgccaacagttaattttttatttttatttatttatttttttatttttttgagacagagtctggctctgtcacccaggctggtgtgcagtagcgcaatctcagcctcactgcaacctccacctcccgggttcaagccatccttccacctcagcctccccagtagctgggactacaagtgctcgccaccatgcctggctgattttttgtatttttggtagagacgatttgccgtgtttctacctggtctcatgcgttcgagaccagcctaggcaacatggcaaaaccctgtctctagcaaaagtattaaaaaatcagccagacgtggtggtgcatgcctgtggtcccagctacccagcaggctgaagcaggaacgccactgcactccagccttggtgacagatcgggaccccgtcttaaaaaaaaaaagaaaagacagatagatgactgtggttctaaggtttatgtattccaactattttgtgaatggttgtggagtttaaatgtaatgattgagtaatagtatcataaatactgttccttagcagagtggaaagtgtaaagaatagagcagaagatttacggaggaggacactcataagcttgtgaaagtgaagttgtagtaagaatagagaacaatatataaagggagcatcctctctgccaatgcagaaagaaagaccatatgaaaaataagaaattaagaattttaagcaaataatgtctgcaagaatacaattcttctgccctttgaaagagcaggctgcaaattgtttttgtcttaagaatgtgtcctcaaaacttggttgaccatcttgtttatagtgaagcaaaagagtacagtggtgtagctggctctgacgccagtgtcctatgttcatagcataggtcactggggtcagagccagctgtacc

SEQ ID NO: 12641 - DNA, 1047 bp, Homo sapiens
tttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttgtgagtgtgtttagcctttcttttttggaaatatttgtaaaaagggccaccatccctaacaagttaagtcgtaaagtttggcattaagggagtatagaaagcaactagaccttggaacttttctttgccttggtattgtcctttatattaatgtggtgccttttcttcaagtaagccaaatgatatacatacatttagttggttcttagagcatcctcctgaagaaatgaaatgtgaagtagtcatttttgtattt

SEQ ID NO: 12642 - DNA, 1060 bp, Homo sapiens
tccgtctcaaatcaatcgataaattaattaattaaatatttttgtatttaagcgcaatacagacaattggagtatcaacttgccggtttagaactaacttaaaaactatctttgggactaagactactttctttaggcttatttgtggatatttgcacattatctaaggatgaaaagggctagtaggtgagatttttgcccatgtgtaaaaacctttctaagagtttagccagtggttgtagtgagaatttttaattacctattttcttttaactgagaaaaaaaattttgttttgtaggcctcccagtggcaattccaaacctgggtccctccctgagctctctgccttctgctctgtctttaatgctaccaatgggtattggggatcgaggggtgatgtgtgggttacctgaaagaaactacaccctacctccaccaccttaccctcacctggagagcagttatttcagaaccattctacctggtaagtgttacagttacttgagatgttagagaaaaagaacggcgccagcttttaaacttttatcctgaagatatgaataacacttttttctgtttgtcactattagatattaatctctaggcaggaaaagtatctttgtttatatttatgtacttttcctcttagaatgtggcacataacacattagtaatacagtttgactaagctgaatttcttaattgcacataatttttcttctttctcctccagtatctctttcatttggtgtttataattctacagctataatttcagtcaagcactatagtgtcttgttatagtgtcatgttttttaagttcattgaatttttattctgttataggagtattatatgcttattgcggaaaatttagcaaataagggaaggaaccactcagtcccatcatccatctttttggtgtacttccttcctgccatttgttttggtgtataggtttttaccaattttcataattaagaccacggtttcttctcttgctctcttttttcttttcttttttttttttttcttttaatggagacggagtctcaacta

SEQ ID NO: 12643 - DNA, 1050 bp, Homo sapiens
ccctttccaccgcatctgtttcactagtcaagtgaatgcctgggctaatttgctcctataggacatttatagacactctctgctgaaaacaacagcctcagtggagagcagcagacagccctcagtgtcctgtggacctgacttgaatcaatattctctgtgttcttttaatatgcagaatctcctagtaaaggtgaactcaattaatgaatgacatacagagtttcattttattttgtttttattgatgcataatgtacatagtttcagagtacatgtgataatttcacacattcatataatttgtaaacatcgatcagtatacttgggatatccatcaccttaaatatttgtcttttctttatactagaaccatttgaattctctcttccagctatttttaaatgtataatagactatcgcaaactatagtcactctattgatctatctaatactaggtcttatttcttctgtaaaaccatgttatttgtttatagccaataattactgagcccacaacggggctttttttcctgttgcctctgttccatgtgcaactgtcaacatatggttcactcgcggggccaaaacagagctcactgggaaaactcttggtctaaataactttatggatgaatgagaattaagccatgggcctgtccagcttttcctttccagacagagaaaaagaagctttgaatgctctagggaaggccaaaccagaggcaagaataacaaattcttgacttttctgtggatacagagaaaatatgtgagactagatataaacagggtgttatataaattaggcaaaaatgggccctgtattgtacatccaatggaataaaactagaaatcaacagcagaaggaaaaatggaaaattcacaaatatgtggaaattaacacattctaaagtgactaatgggccaaaaaagaatttataagaaaaattaggctggacatggtggctcacacctgtaatcccagtactttgggaggctgaggagggcggatcacgaggtcaagacatcaagaccctcctggccaa

SEQ ID NO: 12644 - DNA, 1150 bp, Homo sapiens
ctgcctcagcctcccaagtagctgggactacaggtgcatgccaccatgactggctaatttaaacaattttttttttttgtagagatggggtttcactatgttgcccagtctggtcttcaacccctgggctcaagaaatcctcccacctcagcctcccaaagtgctgggattataagcatgagccgccacaactggccacatctatttttaaatgatgaaatatttctgatatccaaaagacatcaacagtgcaatgggcgcttgtatacctgccatccagtttaagaaataccatgtcaccaatacactgaagccccatgggccttctccccttcacatgcccttccctccctcccagaggtcactaccatgttgaatttggtgctgctgcctccatgcatggctttttgcttttatccacatgcatgtatccataaataatatataatgatgttatgcagatttttatgcatgatatataccgtgtggatccttctgcattttggggctcagaattatgtcttagagatttatgctcatgctgatatgcatagttctggttcattaattttacagtgctgtatagtattccattaacaatttatttcccatttacctgttgatgggcatttggattgtttccaatttttccctatcacagactgcagtgaaatacttgtatgattttttggcacatgtgtggaagtttctctaggacaaagtttctcaaagaatcatttgggggggttttggaaaaacaaccacatggggccttgctccagaccaacgaaatcctctaactgctcctctgatcctactgtatcttagctacaagtggaaataatcgtacccaccatgctatctcatttttggtagtggtgacaactgagcacttactgtgtgctaagtaatttgtatggtatttgattgaatttttgtaacaacgccatgaactagatattattaaacccactttatagaaggtgaaaatgaggctcagataaattaagtaattagtctgaggtcacacagcaagcaagtggcagagccagggttcacaaccagtcttcctgactcaaaactgtggttttgacgattatgagaccctaggctttcagagatctcaggttacattttagctcctcagctt

SEQ ID NO: 12645 - DNA, 1046 bp, Homo sapiens
aacctggccaacatggtgaaaacctgcctctactaaaaatacaaaaattagttggctgtggtggcgggtgcctgttttcccagctactcgggaggctgagacaggagaattacttgagcccgggaggcagaggttgcaatgagtagagatcatgtcgttgcactccagcctgggagagagagcaagacactgtctcaaaaacaaaacaaaacaaaaaaaagaattgtctctggacttgaaaggactctgtatactttcttaatacagatgtgtgagccagagagaactgggaatggagtcatccatcgttgagttgaccttgcttgcacaccttgtttgggctttcctaaatgactgaggatggctcattgctccactggcctcccagtttggcagaataaggcaaatgtgatgtgtgaccgcagtggtgtgtgatcagggcatggcgtgtgatcaggactgtgggagatggcattgttaatactggtggaggccaaagaaggcactagtgggtcaacttcgtaccaggaagactgtgggggaagagatgcggcatccagggggaagaccgagtgactgtggcagcgagaagggaaggtctgagctacacagggaggagccaatgttagtacagcctgaaggcacagcacagcctggcattttctgtgagcagcagataattgggtttgaactcagatgcattagagaggggtggggcagtggtcgaggaggctggagtggtaggtgggccagtcagctggacccagcccagggacactcttgaatacagtagcagtgtgcagggcttacgttgcattggaaaggcagcgggtgaactgatggggaggtctgtttgccggaggctgatgtctgttgagcttcagtactggccctctggaggcagtggtgaggacagactgcagtagaagattgtggttaagctctcttaaggacacaaggccatattgaaagtgttttagaaaccacagatcctttgtagtgctttccaaaatgtgctccctggggcacgggtatcagtcactagg

SEQ ID NO: 12646 - DNA, 1022 bp, Homo sapiens
ccacatctgtcatagattagctgtccatttatgtgtgggtctttcttctggattttctgttctgtcccactggtttatgttacactgttgtaatgatgagagttataatgttttgctcttggatagggtgagtcccatccacctttttcctcttcaagaggatcttggctttttttttttttttgccttcaatgcttccatcggatttagaatcagcttttctagttatatttttaaaatctttttttttttaattggaattgcattgaacctggagatcaatttggggaataatttacatcttccaatctatgaacatatataggtttctgctacttatatcttgtctttctgtaaagctttataataatattataaatttgtccagtgtcttcaacacttgacctttagagtcccctgcaagggagatttgctggtaacagattttctgtgttcaaaaaggtctttgcttcccttcttgaaaattattttcttaggctatagaattctagaccgacaacagcaaaagaattctagacggacaatgtgtcctctcagcaattgattgtatctttctgtcttctgatgtctgttgttgctgttgagaagtcagcggtttgtataaatcttgcttcttcagaggtagtcacttttttgtctgactgcttttaagatctcattgatttggtttgctgtcctctaatttcactgcagtaggtccatgtgtggactggcttgaagttttttgggcttcttgactctttttttctatctttctttgccaacaataggattgtgaaggtcagattcttaatatacgtcaagccagcaaaaggttaatgtttacttagcttgccaccctcatttagattttgtccttagtccttagtatttcttgtttctttgccagtttgttgatgacttttaagaagatattatatttaatttagcagttttagttgttttgaatggtacagtgtgtctgggtaactaattcttcctcgttactggaaatggaggcc

SEQ ID NO: 12647 - DNA, 1028 bp, Homo sapiens
agtacgccatggcttcctccgcggagagctcccccggggagtacgagtgggaatatgacgaagaggaggagaaaaaccagctggagattgagagactggaggagcaggtgggcccgggggtgggcagcgggcatcttccagtctttcaggtcctcgggtccccatgtcctggcccgcctccctagtcctcggcggcgataaagccgccaaggctgcaaacccgcttttcgtgacagtagctcctgtcggatttgagtgcttactgcctgcccattgccttgcaaacgttatctcattgaatcctcgccacgaccctgtgaaggaagccctgttatctatccccattttactggaggaaactgaggctcgtggaggaaagtttcttgctcaagataacacttcctgcaagtcaggccttgtactttgatcccattccagaactcccactcttaaccacacgtccaacagtagaaataaactcattcgcaagagagtgttattttgttatgtaggaatgacggcgatgatgaaacttgtggtaagaaaaatattgaccgcgatggtgataatagaaatggaaaggtttctggttctggaggttaaggcctcagttctagctgttcaactcttgtatgtgcttgtaagaatttcttaatttctctcaccctctcgacttccttatctgcagattgggagcaacaatttctgcataatataattgttgtaacagtaactatagctcagtgcctagcatctagtcataacatggtctctcacttgtaaccttatgaggtggtgatatctactgtataatccaggatctcagcaggaaataggtggcacatttaaattaggatgatctgagagaaactcaataaaggtgtgggtagggaaatcgggagtgaaggtttagtatcccatagctggtaactccagaacctggtgtccatctttgggccggaaggggtgaagggtgtgatctgaattgtgtggagagggcacctgagacctgctgataactttgttca

SEQ ID NO: 12648 - DNA, 1017 bp, Homo sapiens
caaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattcc

SEQ ID NO: 12649 - DNA, 1083 bp, Homo sapiens
acaattaaagaattgatacttacgtcttccaaataaaaggaagagaatttttataagccccttttttatattaatctctactaaaaataaaaaatttgctatgtgtggtcgtgggtgcctgtaatcccagctaattgggaggcagagtcaggagaatcacttgaacccaggaggcggagtgagccgagatggtgccactgcactccagcctgggcaacacagcgagactccgtctcaaacaaacaaaaacaaacaaaccaaaactctctatgtgattttttttttttagttggaataatgaaggaaagctgttaaagataattgaaaattgtggtttaaaccaaactaatcaaaatatggttcaaaatagactgaattcaaatttatgattacatccaatattttgaaacacatttgttgtcatctaaaagttcgacagactataaacacagttgttcagaatgtctccgatttatgaagtgtttcttgagcatttattgtatgccaggactgtgctaaatatgctacttgctacctctttcttttcataacaatcatatgtggtaggtgtaacttttatccccattttatggatgaagaacttaaggcttggtgaggttgtcacactctcgtgggttttggtagtagagctggaagtcaaagccaagtcagtctttttattggctatactaaccacagaattttcattaaatcagtctttaaaaatgtttttgggccaggagtggtggttcaccctgtaatcccaacactttgggaggccaaggtgggaggatcacttgagcctgggagttcaagagcagtatggacaatctagtgagaccctgtctctacaaaacattaaaaaaattagccaggtgtggtagtacgtacctgtggtcccagttattccagaggctgaggatttggcttgagcccaggaggtcaagacctcaatgagcttgtgccactgcactccagcctgggcgatggagcaagacccagtcccaaaaaaaaaaaaaaaaaaaaaaaaaaggtttttggtttatctgggactcttttagtttttggttgaaatagtaaaga

SEQ ID NO: 12650 - DNA, 1050 bp, Homo sapiens
tctgtggtgttgctgccagctttgggagacccctattaggcaaatacactccttccttttaaagaaaactttgattttcccctgctatacaattagtacatgtatactgtagagaacatatataaacaaaaggaaaaaaaaatcacttttaatcccaccactcagagagaagatcattattacttttttgatgtttctttccgaaagatatttctgtgcacatacataaattattttacatacagagatgggttcatacactttacacatgggctgctttctgcacttggtggtaggctgtgacccttttcacgtgccattaagctctcttcctatttttaatgacttcatactaatccattttctggatatacctcattttacttgataagtcccctatttctggacactggtgttgtacagaaatcttttcctttatctaaaattggagatttcattttcttttatgaaagcaatacagagagcatgagggaactttgtggggtgatggaaatattctgtatcttgatcatagtagtggctacatgagtttatacatttgttgaaacttagcaaatatatacttaaaatgggtgcattgtattgtatgtaagttataccttaataaaagtggtttatttaaaaagtgatactaatgttagagataggatttttaaaggtctttcccctcaccagtaaaaaggaggaggggcagttcagtttttaactgggaatacacaatgtttatgactcatagtgagttaaataaaaaattataatgccaagtaactattgaaactaaggcccacttttcaaaaaagatgccatgttttttataatcaccatcgactatacttgggaatcatttttgatgttctctcagaacctcagtctgattaaggagaggaaaaaaattccagagctggaattccttcatggaaaattccctgctacctttctcatcaaggctcaatacagggcagcagcaacagactggtctgcattctcccttttacatgtgaaggagaatgggtgattgtcgtgttctgc

SEQ ID NO: 12651 - DNA, 1058 bp, Homo sapiens
gctctgtcacccaggctggagtacagtggcacgatcatgccttgacctcctgggcccaagcaatcctcccacctcaaccttccgagtagctgcaaccacaggcactcaccaccatgcccagctaattttctattttttttgtagagacgaggtttctcacaatgttgtccaggctggcctctaacttgtggcctcaagcattcctcccaccttggccttccaaagtgttgggattacacgtgtgagccaccatgccaggccctaaaccttttttttttattctttttttttagactttattattattattattattttgctcttttccttttatttcttttgggggcattatttgttgtgtttatttgctcttgtgttctttcttggtttgtcttcatttatttctaatttttttcttgatgtctgtcactttgttttgagtttttcaagttctggtttataatgttttatatattgttttcttattttgaatcactataatgtagtttttatctcttttgagcatgtctttttagcagtcttatattgtctaaagggatcttattctgtgtcttattttctttttttctgacagtaattttggagttcaaccttgatttttttttcttgcttatttttatgtggatttaattttcccaagctttttaaatggtggcttggttcagatagctgctctaatttcacagaactccctctctgacatattcagatagtgttcagaaacatggtgccttgctttctaatatttcctagcctggcttttatgtagcctctcttatgcttttatccctcttactgctatcctgctgaaattcgatttcatttcctggagtgtctcctttgtgggcccatcctggaagggagcccgctgtgggtgattttgagagtgctggggtctagattgtgcctgcctcttcagaccttttaaattcagtacccatgtgcccagcttctgttggaaaaggcaaaatccttcccagtttctgctgctgatctcacaccggcctgctgccctcaggtctgtcaggtgtcccctt

SEQ ID NO: 12652 - DNA, 1060 bp, Homo sapiens
tggtaaaagagtttttgcaattgcttgtttccaagctaatggcagaactgtgttctgtccagtggaccctggttaagaaagtccttttcataaagatatacaaacaaaaaacgtgaaaggtgaattaagtactttacattccctcctttagtttccaaaagtaggttatgtgtgaaacaaggctttggaatactttttaatatgatttcttgtccttagttatgatttttaactttaaaatgtgattattggtttggatcagtttttaatgctagcccaaagtaggctgaaaaggttaggcataaacacaaatgggagtacttgctgcccctgaaataagggaagatggtctctaattaatttgtaagcagtctcgcacatgtcaggtagtctcgcacgtgtcagcattggagaaccatgctacttttattttcctctctattggctgtggactgaaacattgtttggaaagctttattaattaaaattattttacataaatacaaattaattcctgaactgtgtcatttaaacatttacccgcttttcctcatgggcttttggctgggaatgtctcctcctgtgatctcataattttggcagctaaagcatattaaggaaatacgctgctgtgaaagggaattgttctgtttaatgtgccttgctaaattgatcattttaatggctatggacgcattttgttaagagaaaggaatatcgtttagacctgatgccagaatttttttttttttttttgggatggagtctcactttgtcacccaggttggagtataatggcgtgatctcagctcactgcaacctctacctcccaggttcaagtgattctcctgcctcagcctcccgagtagctgggattacagccctgcgccaccatgcctggctaatttttatgtttttagtagaaacggagtttcatcatgttggccaggctggtctcgaactcctgacctcaagtgatccccccgcctcagcctcccaaagtgctgggattacaggcacgagccactgcgcctaactctgatgccagaatcttaaacgg

SEQ ID NO: 12653 - DNA, 1065 bp, Homo sapiens
aaggaaatgttaacttttccgtgtttttgctttctgataataaaatgtttgtagttttacaataacttccctcaagttcttaattgattttaaaatatggtctattcagtattaaacccagtttttagagaggatctgtgatgcaaaaattatttgcttggcattttcacttctgtccaaaaagactgctgttttttactcacaggcaggtgaagtctctgtaggcccatactccctctccccagcagcttttgtttctagcttaccttaccttacagggtaactcaatctgtagggtttattccagagcacctccttttacctcaaggatggtatttctggttcccttaaagtaaagcctcctcagaatgttttattcctgggccatgagctgtcactctcagggaccagcctgtgcacaagtcatatattgtgtgcacccgtctttttggtctgctgctgagtctctgttttccatgccgctgtccccttgtcccatgaccacaatcactctagctcctccccgtggagcagcaggggcttaagaaattcaaacaaaacatgtatccacataaataatactgtcataagaaaaaggaagttgaaaaaaatggaaaacccacttcaatagatacgcttttgactcctttgaactctgcacagtgtgaatggagcccttatgcttgggctgaaaacttttcctctacttctgagcacatgtgtgacttaacattctccttgctgagttgaagaattctcagtatgtatcacccaaagccaaaaataagttatgattgaaatttgggcacataaagtgattttgatactcattttttcctaaaatgaaaacttagatgaatattaggtaggggtttgaacaatgtggaaatcttttaactgttctttgagtcaggtcatgtaaagtatctttgtttgccttccccaggatggggtgggggctcttaggcccttacatcttcgggtggtgtaaccagtctggataataggcatagaggactgcagatcaggagatggaaaagtactggaagtgagacagctgcctga

SEQ ID NO: 12654 - DNA, 1891 bp, Homo sapiens
ttattaataaaaatatcccccatccctttttaagatatgagcatccagtaatttcatttcctggtataacagtattgccaaataattaataaaattttattgtctactccatatgactaagtagtgaaaaacagacttaacaagtttgaactgtcatacacagtgtgttttttaccagttgttgataagaaaagtaggtcatcaatatagaaagaatgtttagaaacatattcaaggatttttttttttttttttttttttttttttttgcgacagagtctcgttctattgccaagctggagtgcagtggcgatcttggctcactgcaacctccgacttccgggttcaagcgattctcctgcctcagcctcccgagtagctgggattacaggcgcgtgccaccacgcctggccaatttttgcatttttagtagagacggggtttcaccgtgttagccaggatggtctcatttcctgaccttgtgatccacccgcctcggcctcccaaagtgctgggattacaggtgtgagccaccccgcccggcctcaaggattaatttttaagtgagattgctaggtcactcatgtctataaaagttttgcggttggtgtgagacctcttgggattaatttggctctttgagttgtgttctgctctttgaagagagacacagaattaagcttctgagtctggtctcctgtggtgcactttagggagatggctgctgccagtgttgtgagtatgcgggggggagggggggagggaggaggcgggtcaggtagcgcctgcctttgtcttcccaagggacgtttcttcagcaatgctttttcaaagctccagggaccaaaagaggtggttgtgtttataaagatgctggtgataagcagaaaattgggagatgtggagggttgtaaacatgtcatccttgcacattatctctgtaatagaaatatatatttctgtcattgaagagctagagatgatttcgaagtccttatatattctcacattttagtaactgcaaaatttctgtagtgtcatttctattatattttaagtgagttacaggcctcattatggcatcttttagttcataaaagggtctctctttaataagatgtgagggaattacagttttgttttgttttgttttgtttttttaagagacacagtttcgctttgtcttttggtatcaagttcagtggtgcaataatagctcagtgcagcctcagactcctgggctcaagggatcttcctgcttcagcctcccaaagtgctgggattactggtatgaaccaccacacccagcccagttttaggaattttatcttttgtcttcaggttcattatgtgttactgttttgctgctcattttacttcttgtcagacttgattttcggcagtcattttcatagcgtcacattacgctctgcaatgcgctcactgctttctgcttcacattgccagtgagtgcttaggtttgactttaggtggtccccaaccaagtctctttgtaagaagttcctaaaatgagtatagattataaaatgtaaatatacgagtgctcttctttgaaaactttaaaaagtatgatacctctttattatacctcaccttttatttttatttttattttttttgggtatcactgtgtcccccaggctggagtgcagtgtcgtgatcttggcttactgcaacctctgcctcctgggctcaagcaatcctcctgccctcagcctcctgagtagctgggaccacaggcatgcgccatcatgcccggctaattttttgtatttttggtagagatggagttttgccatgttgcccaggctggtctccaactcctgagctcagcctcccaaagtgctgggaatacaggtgtgaaccaccg

SEQ ID NO: 12655 - DNA, 1003 bp, Homo sapiens
gtcaagatcctattaagtcatctcacctgaggcatctggagagggagttgccttccattggtgggaaattgttggtgccagaatacattttgcccaaaactcttctcattggctggccacctagcagggctcctctaaacacgcaactcagcgaggggacccccttcacctctggcaagagagctgggtagatcagaaacttggtgacacctggctagcacagagcaggctcacttgtcttggtcccactacccagattcctgcagacattgcaaaccaaatgaaggttgttgaatgacccctgtccccagccacttgttttgttatcatctgctctgcagtggaatgcctgtgtgtttgagttcactctgcatctgtatatttgagtatagaaaccgagtcaagtgatcatgtgcatccagacacactgtgtcacctgagccacagagcaaatcaccttaacgatctggaatgaaactgtgaccagtgccgccctgggtggttctggagagactgccgtcttcttgtttggccataggtgctggggccccggcttcagtcactgtctcagacaggagtcccgataagcagatcaccagtcctccactgtccttcctgtcggccttgctgcatgagaagatagctgcttcctccctcttttcctacactgtaattattgttttacaattgagtgccttaataatagtttacaaatactatgtatttatgcaaaactgttaaagtctcatctgttatgattggatacttggtcttgtcagtagtggtcagcattgggttgtgagcttgtcctactccatacgtgtttatcctgctatgcagttttacattgtgtgttcacatctattccaaggagccttgctagaaacaacactggcggttcctgcaggccaggcaggcattggcccatgctgtgtcccataggagccaatgaaagaacgtagcttggtctgctagccagccgtggggtggcgcaggccaggca

SEQ ID NO: 12656 - DNA, 1055 bp, Homo sapiens
cagagccgtgtatgtgagaggccctcaaaacctggacacacacagaccaggaagacctgggagagcagagctcttcatcgttctcttctgctctgggcacgaaacagggccacttctgttctggaaaacacgaagagggcaaacagtgctgaggcagggaaggtcttgcttggtgagggtaaaactatgcaagagatgaaagggcaaagtcatgaaatatgcccataccagtgatcagtaaaatcatctgaagcttttattacctaccgataaagaaaaattacaggtcgtgttttaccaaaatcgaattaagtggagatttaaaaaataactttaaaaaatttggctgggtatggtggctcatgcctatgatcccagcactttgggagaccgaggtgggaggatctcttgagcctaggagttcagtaccagccctggcagcatagtgagaccctgtctctacaaaaaaattaaaaaattagctgggggtggcagcacacacctgtagtcccagctacttgggtggttgaggtggaaggatcgcttgagcctgggaggtggaggctgtgctgcgtgagccgtggtcgtcccactgcactccagcctgggcgacagagtaagaccctgtctcaaaggaaaaaaaaaaaaattggtaactcgaaaacttgtaatgctcccaacacatacaaatgattaatactcaaggtcatggataccccagatactctgacttggtcattacacagtttatgcatgtaacaaatacttacatgttttccataaatatgtaaaatactacgtcgataaaaaattctcgttaattttgagataatttccagcttacataagaattgcaagtacagtgaaaagaactttcttttttgaaccatttgaaagtaatttgtcaacctgctactccattacccttggaatacagaccagggcattctcccacagaaccgcaacacagccatccacgcgggacactgactctgatgcattcccaccgtctagtcctctaaccccattcaagagtcaccatatgtcccagcgtt

SEQ ID NO: 12657 - DNA, 1044 bp, Homo sapiens
acaaaaattagccgagtatggtggcgcgtgcctgtaatcccagctacttgggaggctgaggcaggagaatcactggaacccgggaggtggaggttacagtgagctgagatcacaccactgcattccaccctgggcgacagagtgagactctgtctcaaaccaacaaacaaacaacaacaacaaacattattaagaatttcaagatggcaccaacagagtattaaaccaagcacggggcccctctgagcacatatgaagaagctggccctgcccactagaccgtgagccaccctagggacagggctgcctgacctcctgcctcacagtgcccagtttgccctggataggccctagaggtcttgtaagttgagtattgtttcctgttgagcaactaaaagtggtcttggactttcaggaaacaaaggacagagaaattcttcccaccgttgcctccgttgcagtttagtaatatcggtgctgttagatcagtctcaagacccctctgtcctcatctgtctgcttgtgagctattcattcaacaaatattttttgagctcctactgtgtgccaagccctgttttaggggctgggaatatagcaacaaacaaaataaaaattcctgctctggaagctgacattctgttgaggagacaagacagtaaataaaataaacaagcgcaataatcgtgtgttggtaagtgcccaggcgaaaaaataaagcagggatggaggagagaaaagggagcacccatactccactctgtgattgccttgtgtgcattatttcagttaatctttgtgaaaaccctgtaaggacatttgaattcccattccctggaggagaagactaaaccccagagaggtcagtggcctgtttttatttagtagtaaacggtagagctgagaccctcatactccatgtctcattgactccaaaacctgtgctcttcaccccaaaatccaagcactgtcttttcctcctccctatgcatcagaacccacactgggagacagaatggagtttatcagaagaaccaggctttg

SEQ ID NO: 12658 - DNA, 1040 bp, Homo sapiens
actactccctgctcccccgtcacacacgttccctaggccagttccttttcacctggctgtagtcctcatgaccagctaaaagtgcgcctgccccagatatttgtgatttccctctcttcagagaaagcagggagcccctggcatccctatctgtgacaggtgccacacccgccttacaatgcaggtctgtgtgcccttgttgtatccctaactgctctcaaatcccttagtgacggcctcatttctctgcctttgtgtagcatttaaacagtttaaatggctgggcacggtggctcacatctctaatcccagcactttggaaggccaaggcgggacggatcactggagctccggagttcgagaccagcctggccaacatggtgaaaccccctttctactaaaaatacaaaaatcagccggcctggtggtgcgctcctgtaatcccagctactcgggaggctgaggcaggagaattgtttgaacccgggaggttgcagtgagccgagtttgcgtcactgcactccagcctgggcaacagagcgagactctgtctcaaaataagtaagttgataaaagtgaacagtttaaatggatgaacctttgaccctgcagtaaattccagacatgtaggagaaacagccaggtgtagagggaaggcagtggggttctgagtcaggcagacctaagtttggcatctggctcctgtgctggtggctgagttcctttacctttgtgtgttcttacagctctgtgggtctcaattgttccacctataaaacagggatgacactgtgacctttcagggttgtggagtagttgtgtgatgttccttgtctaggccaggcccagtggctcacgcctgtaatcccaatactttgggaagccaaggtgagtggattgcttgagccccgtagtttgagaccagcctacacaacatggcaagaccccatctccgcaaaaaaaatagaaaaattagctgggcatggtggcgcacgcctgtagtcccagctactcaagaggttgaggtaggagaatcactt

SEQ ID NO: 12659 - DNA, 1121 bp, Homo sapiens
cgccgcgcccggcctgggccgccggacgccgcgccgaggccgccggagctggggccgcgcgtgcggggcaggggggcggctgcgcgggctcctcggggccccgccgtaggaacagagccgggcagccggaccggggtgaccgtgcgaggactgtgtgcgatgtgaccctgtcttggggagctgtgcggggactttgtgtgcggtgtgacccctatcggggggcgactttgcagggactgtgtatgcagtgcgacccctctgggagtgtctgcaggatactgtgtgtgcgctgtgacccacatcagggggttacccccatcttggggtgacccctgttaggcggagactgtgtgcgttgtgacccctaagggtgactgtgcagagactgtgtgtgcagatgtgacctcgtgattgtgtggggactgtgatttcaggtgtgacccccatcttgggttgacctctgtctggggaggactgtgcgtctgtcgggactcccatttgtgagtgactctgcagtgtgaccagggtccaggggtgactggatgtgcaactgggacccttgattgggtgactgcgtgagccgctggttctgagacctgtggccggggtagttctaggccctttgcctgtatgcctggctgtgcgatgtgagatgtgactgttgctgacctgccgtccggggactgtgccagcgtgagacaggcatctgggagtgcccctacaaacgtgtgagattgtttccccgcctgccgcctctggagttctgtctgtaggcgtgcccgtgtcactgtgtgacggtgaccgagcgtgctgtgggctctgtgtggctgtgtttcacgtctgtgcgtgcagccttagtctggcttttcctttctgtaacatcactcaggcctgtgtgtttatgtgcatctatctttctgtgtggctgtgacccattctgggtgattgcataggtgcattcctgggttgcgtgtcctggcactgtgcgcgtttttgtgggtctgtgtgtggcccaggtccgtttgcctggccactttttcctctggggttgattgagggcactgttgccctcttagcctgcagggttggcctggcttgtcctaggctggggccttgggcct

SEQ ID NO: 12660 - DNA, 1087 bp, Homo sapiens
aacaaaacaaacaagaacaacatcaaaaaacaagaaaacaaagaaaaacgagcaataatggaaccaacatttatttagaggacagagcatttctcatgcatcctgtcatctcctcaggcgctctcatgacataggtgctgtagtccgcacttcacagatgaggcaacttaaccccagagaggttaagtgacctgtgggaggccacacagccagggcggaggagacagaaacagaatccacgatatccgactgcagaactcctgctcccactcgtgacaatatactggtggcccaacgccctttccggacaccaaagtaaccctcactgagaagtgacgccaagccacagttctcaccccagccgtgattctcgacagtggcccaacaggtgatcaacgggaaagcggcagtgcttgccacacacgggaggccagcaggtggcaccagggggccgcccggctgctctctttgcgccctagcctgccgtagttcccagcgtgctccggaagtgacgcgaccgattcgctggggcgcgtctttcccaccacgaggccaccagggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggtcagttatgggtccttcctccttaaaggggtggacagttgactttgggcaaacctcttcgcctctgtgggcaacagtttccccttctgcaaaatgagggtttggattgtagtttctaagtttagctgtggcgtgcgaattcccaggaggtagttctttaaaaattcaggtgctcaggcgtggagtgcagacctctgggtttttgcaagctagccagctgattctgatgcacaggtggacgtgggagaccctggatcagattgtccctagggtcccttccggctttaacatcttctgtttcctttctaggacatggttttaaacttt

SEQ ID NO: 12661 - DNA, 1070 bp, Homo sapiens
cagtgtcattttgacactgcaaactgtgacttgtttcatgtcaccggagctcagcccctgcttcatatcattatgaaaagctaatggtatggcattttatggggcattcttttctctttttttgagacagggtctttctctgtcacccaggctgaagtgcactagggccatcatagctcacggcagcctccatctcctgggttcaagcaatcctcccgcctcagccttctgtgtagctgggaatacaggcatgcaccaccaaacacagctaatttttagaatttttttctggagatggggcctcactatgttgcccaggctggcctcgaactcctgggctcaagccatcctctcacctcagcctcccaaaatgctgggattacaggcgtgagccaccacgcacagccgatgggtattgtttcatttaatcctcaccataacccttcgaggggtggatactgttgttgccattccaagtgaggagtccccatttcagaggtgaaatgctttttcaaaagctgatgggactagaaaaggtgaagctgctgaacccaggacttgctgcctcttactgtctgctgtccatggctagttgtgggcctggtccaaggccagatcatttgagtgtggcatccttatggtttaactgctgtctttgtgctaaagccctctggtgggggccctcgtgaaggcctgggctggtaggctgggtatctggccttccagctgttgtctgtgtctggcagagcgatcctgtcggtccttggagagagcactgcatagcctgacccatggcctgcatgttgcctcaaatgcacccttgggtctacaaactgggatagactccctgcatcctgcagctctaccctggcctacaggctggaagcctgtcagctgcaatgaagtttgctacaaataggcagaaatgccaagtgcagctcagccaggcagtgaatccagcagtacagcttgctggttaaaggacaggggctttgaaggtcctgaacaggggatgtgtcatgttgcccaagaaagtgattgcttcaggagaggggacctggcatccagca

SEQ ID NO: 12662 - DNA, 1080 bp, Homo sapiens
gtggctaaacatttttttccacagggttttctagtaccttcacaggagaaaggagacccaaagatgaccaagtgtttgaagccgtgggaactacagatgaattaagttcagctattgggtaagggggacaggattggccttgaggttgcgtttgagtcgagtatgagtaaacgtaatgaatgtgaagctctcacgcatgctgggcagcagcctcggaggttgtcagcccttattgaactttcctcagccctgaagcacaggctggtcagctccacaaggctgtggggctgcagactcctttcccttctggccctgcctgtgcctgcgctggcctctggcccatgccatgtgaagctgcctccctctcatccctcacttttcaggtgagcctgtgtgtgccactgaggttagtatactgagtgaaagaggtgagttagtataatgcacagtacatccaatgtgatcccttttgtgactgttgttttttacataagccaaagtttagaaggtggactcaaggatggaccagatcaggatgggccaggtcatgctgtgatcacagacaaccccaaaatctcctgacttatgacaccaaagatggacttgctgttcccacttcatgcccatcacagggtatattctttggctccatgcggccttcattctgggacacaggctgctagtacagctgctgcctggggcaattatcagtcattgtggcagagggaaaagaggtcatggtgaagctcacattggctcctgacgctgccaggggattgtgcagtgtcagtgttgtcgccagtgaggtttacccaagatgtgattattgctgattgaaaacttttcccactaccccaccatgatgacttgaaatatagtcaacattggcagtttttgacagtctttatggagactaaactttgttggtaaataaaagttgaaaaaaaaatgactaggtgcagcggctcacatgtctaatcccagcgctttgggaggccgaggtgggagaatcacttgagctcaggagtttgagaccagcctgagcaacatagcaagacttcatctctactaaaaagaaaa

SEQ ID NO: 12663 - DNA, 1035 bp, Homo sapiens
caggcatggtagcgcacgcctgtaatcccatcttcttgggaggctgaggcaggagaatcgctagaaactgggaggtggaggttacagtagccgagatcgcgccactgcattccagcctgggcaacaaaagcgaaactctgtctcaaaaaagaaaaaaaagaaaaaaaagcacgtgaccttatgaggctctcgctgtattgttattttaaggactataaagagtttgatttaaaattatgcagggcccctatgtgggattttttaaaaagcaaactggtgtgtattctcatgtggtttgcacagcccagcctcacagcactattgtaaaccctgctctttctgtctcgctagacagatttttttgtttgttttcttttttctggttgttttttgttgttgttgttgttgttttacagctgaaaccaaccagcaagcccttgatgaccaagaggcgtttctttcaaagctatagggcacaaacaattgaccatagatgactccgtttgcattcttctgcagaattatttccttcagggacagattttccaacctaagaaactacctaccgtgtgtattctcttgacggggagagatgaacccttcagctgctaagatccaagaaaacgcctcactgccttaaccttaactgttcttcctggcgctaaaaagagctgtattttttaaagtgctggggcaaacaaagcaaccccaaaagagttgatgtgtgttttaaaagaaaaaacccaatgaggaacaattggagatttttatgcagaaactaaataatccttaataaataaatctctattttggaatcacatctgtgcactgtattggttcttgatttttttttctttcctgcatcagaaattacaactggggacccttacaaatcctaccaagaatgtattttctggcgtccatggttttaaaattttatttatctattatttttaaatgtttttgtagagattggggtcttgctatgttgcccaggctggtctcaatctcctggcctcaagcaatcctcttgcc

SEQ ID NO: 12664 - DNA, 1056 bp, Homo sapiens
atttttcagtgtactttcttattttagaaaaaattagaatataaagatatatcaggaaggcactgtaattgtactaaaaattagattgatagtgtatagcaacttagaatcatttttatagtttctcatttcacatcagtcctgattgaaaaacaaatatgcatttcatagtatccattaaaaaattattgacaagtttgacaaattatgttaggtatttcccttatggaaaagcagccttattaaattcagagtaatttccaggaggtgtttcaccaagggtttaagcatctctggggtcctgtcactggtggccactgagattgcagcactcacgtcacataatgtgtggtgttccaggattcttttactgaagctggcaaggtggtaggtttttggtttgttttgtattttcccgagtgtgtttctctttcccattccagatcgggaggagtgcacttgtgacctcctcttcatctctgccttccttcccctccacactttcctggtcgagggacgaaagcgcccgaagggttaagtacattctgaatggtctgctctctggaggaggggccgtgctcctgggcgctttgtgcttgggctctggccctcctgtccctgctaactgcccttccgtcctgcatgaggcagcacttcctcctggtttctcacagtgcatcaggctcacactcgtccacatgcacgctcacccatcgagggcgcctccctttctctaaccccatactgctcatgttcacgtcatatttaacaaagtttgcaaatcaccctacagcatttattctgagcaaactgtttttttaaacaacgagaaaattagctggctgctggttagatattataataggccaaatttgttcaatttgttcagggctacagttgtcagattgaaactgctgtatgtggactcgctgaagtactaaaatgtcatgcctttttttttttttttaacctgtgacacattttatgtcagcaccacaagtgctgacaaaccaaggtttacaagtccctgcatcttgaatcagaattgtaacacct

SEQ ID NO: 12665 - DNA, 1048 bp, Homo sapiens
tttcaagaatcagactgaataatcaaagcaaaattgaatgggtaccacagttcttgaacatggtgggactaggaatgtaggagcaaagcaataacctttgtagttatttgaaaaattcttcttaaggaatggaaaaaaagtccagaagtaaactttgccaaagccaacttggctatttgtgatagggaacaggggtcagcaaaccatggtttgtagcccaaatctagccagttacttgttttattaaacaaagttttgtatcgtgccactgcacttcagcctaggtgacagagtcagactctgtctcaaaataaataaataaaaataaataaataaataaataaagcttctgccgggtgcaacgggtcatgtctgtaatcctagcactttgggaggccgaggcagaaagactgcttgcacctaggaattcgaaagtagcctgggcaagaggggtgagactccgtctccacaaaaaagttttttaaaaaatcagccaggcatggtggtgtgcgcctgtagtcccacgtacttgggagactgggacttgagcccaggaattcagggtggcagtgagctatgattgtgccactgcactccagcctgggtgcagtgacaaagcaagacccccaactctctaaaaaataaatgaataaagttttattgcaagaaagccgcgcccaattatttataccttgtgtatggctgctttcacataacaacagcagagttgaataggttaagtcgttgcaacaggccagatggccacaaagcctaaaatatttactatttggccctttaaagaaaatattggccaacccctgatgtacaacattcacatacatgtatgcagtgattctccatcctggttgtatgatagagttaagagcctctggtatagtttcagttctgggtgagatggagtaagcacaccccaccgtgtctcctgcaaaatagaactaacagacctggaccaaatgcttggagtagctagctaaagactctgaaaagtaaatcctggttggtagattagggaactcaaaagtgtcat

SEQ ID NO: 12666 - DNA, 1025 bp, Homo sapiens
ggccagggctgctcccccaacaggaaggggcttgggcaatccacaggaaagccaattacagaagtaaaatgtgagcgtcctcccggctgcagcctccagaggctgcaggtgtcacctcccactagaccctttctccgcctgggtgtcctgcccggggaggatgacactccctgagactcgccagagggtccccgtagatgacttccccgctgctgacatccgacagctactctgcccgggagaattgccaggagatcggggtcttccaaacacaaccagcacttaggaggcagtgcttgtctcaagtttgaggatctgaacggcctgggttcaaactagattttgcttctggctgaccttgggctggtgacttcacttggtcacttgcttgatttcctcatttttttcaatgaggataatcgggagtatcacgcttagtggtgaggaagattcaatgaatactcgtagaatcatatcatctaaggcttttcttttttgcattatgctgtctacagtagaactcttgtagtcccttaaagctatatttgactatctaaatcatacgttgattacaacggaaacaaacgcaaaatcaccagcaatataggggcattgaaacgctaaagccattccttcataatgatgcataactgttcatacataatattcacatttagagatcaagtgtgtcttagcaattgcaactgaattgtcaggtctctggatagattattacatgctgttttaggtgcttggatgtattggctttgagttaattcgaaggtaacatggctttcttggcacaatagtgtccgataaacaatcttaattaaatcattgaacaccactggctttgcaactgttctgatcttaagcttgtcatttggaagtggagaccaattgtaaatagaactgtgataactcaaacctcatgtggttgttttatggcccgtacagtgcaggtgttaccagtttcctttgaagatagggagggggtatggaggagtttaaaaagaagtgttttc

SEQ ID NO: 12667 - DNA, 1035 bp, Homo sapiens
tcttaaacaggttatgattgataaatataaaaaaaaataaatgttaaagtttgtacattcttagtcacaaatcaaggcattttgagtaatttccaaacttaaaaaacacatttttatgatttctacttatttattttcttgagacagggtctcactcttgtgcaagctggagtgcagtggcgtgatcgtggctcacttcagcatcaacctcccaggctcaagtgatcctcctgcctcagcctccctagtagctgggactacaggcacacgtcaccacactcggctaattttttttttttttagatggagtctcactctgtcgcccagtaatttccaaacttacaaaatacatttttatgattgctacttatgtgcaccacacctggctaatttttgtatttttagtagagatggggtttcaccatgttgatcaggcttgtctcgaactcctgacctcatgatctgcccacctcagcctcccaaagtgctgggattataggcatgagctactgtgtccggccttggctaattttttgtagcaacaaggttctcactatgttactcaggctggtctcgaactcctgggctcaagtgatccttctgccttggcctcccaaattaccgggattacaggtgtgagctactgcacccagcctctacttattttgatggaaaaacatccaatttaaactttaccaacactcactggctgactactggacatgtttttctctcctccccctgcagggagtcctgtcagaagtacagattgctaggctgggcacggtggctcatgcttgtaatcccagcactttgggaggctgaggcggatggatcacgaggtcaggagatcgagaccatcctgtctaacacagtgaaacctggctctactaaaaatacagaaaaaaaaaattagctgggcgtggtggcaggtgcctgtagtcccaactacttgggaggctgaggcaggagaatagcgtgaacctggaaggcggagcttgcagtgagctaagatcatgccactgcactccagcc

SEQ ID NO: 12668 - DNA, 1042 bp, Homo sapiens
tgttggggtgatcagaatggaagcccttttcaaaatagactcttagtatttttgtcttattcgcaatgcattgattcagccccagaattatttgccagaaatagactttcttcccctggtgttgggagccaggagggttggaaagctcaggaaccctgagctggttcatctgtttgcatattgggtaggttaatttccctggagcctgagagtctttggccagatttcagctgcgtctgcctggctcttttgctgcagctgtgagattggggtctggttccagcagtctgtcactggtcagcctgagtatcacaccctgagctctggggctgggagtttcttcccacaccctctcccttgtgccttaagttgcgatggctctgagtatacaattaatcggaggtgaggggtgggtgtcacagctaatcccaaattcaaaaattagtccaaggtgctgcaaaatataaatttgatgtcagtagaaagtcgtatcctaaaatgtaaaaactgtaagtgtacagtagttaatgagctcagaacatctgataactgcaatttaaaatgggcaaaaagtttctatgagtctttcagtctaagacccaaagcctgcgcaacatcacttgatctgagccacttctaaagagacatataaggctaggcgtgctcacacctgtaatcacagcactttgggaggccgaggcgggtggatcacttgaggccaggagtttgagaccagcctggccaacatggtgaaacccccgctctgttaaaaatacaaaaattaaccgggcatggtggtacacacctataatcccagctactcaatactcaggaggctgaggcaggagaatcacttgaacccaggaggtggaggttgcagtgagccaggatctgcactgcactccagcctgggcgacagagacagtgtttaaaaaaaaataaagccccacagatagttggggtcacaccaggtgagtgtgcggccagtagaagaagctgcctgccccttggcctaggcatgctgtccaggatgcagcctcac

SEQ ID NO: 12669 - DNA, 1032 bp, Homo sapiens
aatgctaggggtaataggtatgaaaaagtttaagaaatttgtggagaaaaactcaaattgagaactctaaaaattaggaagagactcctttttgcacttctggtggtggactccctcaacccagccttggaagcctgagttgtttggagaggccaggctttagcacattttttgggactgtgtggtcatttcactgccgggccagggagatgacgaatcagccagcaagagcaaggcagagattcaggcctctcctttgttttgttgtcccctagtttggaccccaatgaccagaagtctctagaggggatgcagaagatggagaaggaggagagtcccacggatgccactcaggaggaggatgtggacgacatggaagggagtggggaagaaggggacctggagggcagcgacagtgaggcggcccagtgggctgaccaggagcagtggttcggcatgcagtgagggggcggcagctccatggccgcagtggcctgccctgctctgagcacttccgtggactgaaggaaccgtaggagcctgctctcagaaggacaatgattcagcatgtgattgcagcaggggtctctgccccctcgctcccaattcctagtcgtgacttcatttctaaaacagagcctgaccaaccttccatgtatctccatcctcccctgctccagccagggaggactgagggagtgccccgagacccacgcacatgttggggcttctgggccaagagtactttttatataactaatttctaaatccaaaagctcaaggaatagacagtgttctgtgacatggattggtttgaaggagttacccaccatcccagcacgataatgtcatctcccaagttggatggcagcacgatctggccctagggagcttcctgttcccagaagtcattgtcctgggctatccagatgtccctagtaaatcttgcttccttctgcaatgttagtaatgccttaagctgacagttgctattttgcagaacagttttcctctttgcttagctagtaactt

SEQ ID NO: 12670 - DNA, 1051 bp, Homo sapiens
acaaaactagccgggtgtggtggtgcatgcttgtaatcccagctactcgggaggctgagggaggagaatcgcttgaacccgggaggcggagattgcagtgagccgagatggcgccattgcgctccagcctgggcaacgagagtgaaactctgtcgcaaaaaaaataaataataaaataaagaccctaggagtcttccatcttaaacctagccctacaggtgaccgaatgcagctggagaataactgcttgttaagaggcagcaaaaccttgggttttgttgggaacatcatctctcactactttgatctcttggccatatgacagactaatcattagtgtcgcatttattcttccagtggtcagatggggtgctcacatgctgcaggttccttacatgtgcttgtttccttccctaaactgaaggtgcctttgaaggcagtctttttctacatccatcaagttctctggggaagagcacttcttagctattccatcaacactcttgccagtctaatctcaccatcagtttcccgtggcctgccctttgtctgaaactttgaaggttagcaatttggagagctgtcagagtggaagcatgggttggaatggtaatggcattgaatgtcttcacgtgttttacttttttcaggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattagataaagccctgacccaaaggccagattacattaaggctgtggtgaaaaaagcagaactacttagtaagtgtgtcttattttctgtcctgttcatcattaatttttataaaacctgacctcagttggagccccttgtcccagctagttacagatgactagacaggtgtgtgccttttgcagcaggtctgagcctgcttggattggtttatatttagcccaaccaaacgtagctggcttag

SEQ ID NO: 12671 - DNA, 1026 bp, Homo sapiens
ggaggccatacggctcgcaccttgtcgcttagattgttatgaaggtaagaaagaaaacataggtgaatggtgtgaatccgtgggtgtggcagcagccctcagatggaaggtttcattaggccagcacttcccaaactctgttagaataatctggggaagctggccggacgtggtggctcacacctgtaatctcagcactttgggaggccgagacgggcagatcatgaggtcaagagattgagaccatcctggccaacgtggtgaaaccccgtctctactaaaaatacaaaaattagctgggcatggtggctcacacctgtagtcccagctacttgggaggctgaagcaggataatcacttgaacctgggaggcggaggttgcagtgagccaagattgcgccactgcactccagcctggcgacagagcaagactccatctattaaaacaacaacaacaacaacaaaaaaacatcatccggggaagcttttcaatatcctgacgttgggtctctccagtgtagatggaaatacatggaattgggaatagacatcgatatttttggaggtccccaggggttaccaatgtgcagacaggtttgggaaccactgcattaggcattttacatttatttagggctttcactggatttgtcaccccatactttcataatccattttttctgattttttttctggtttttggtgagggtatagttgggatggggttttttttttttgtcctcccaccgctcgcccccatccagtgtggcgtactcattaatatgaatctctctgtgtcagacaccatgcaagatcacttagtttgcctattttttttctcttactcctcttttttttgagacagagtctcgctttgttgcccaggctggagtgcagtggcatgatctcggctcactgcaggctccacctcccgggttaatgccattctcctgcctcagcctccccagtagctaggattacacctggctaattttttgtatttttagtagagacagtgtttcaccg

SEQ ID NO: 12672 - DNA, 1538 bp, Homo sapiens
cttcagcctggaagaaaatcattttgcactcaccagaagcttggtttattgcagtgtctaacctagcttgcctgcttaggactagggattttctttatattcagataaagttcaaggacaagaagagacttgggcttgtgttatgcaaagtcgtttacttgagtaataaataggtgtcacttgtgaatgacattacctttaacaccatgtagcgtatgttgtgttctgaagaactgcaaccacagagttatttgttggtactgagagacttctgctttattctttgtttttgctatcctgtcctatataactttttttaaagtcataagcttaaagttttttattacgaagaattttatatttatgcaaaagaaaatagtatctgtatgaccaatcatccagattcagcaactaagaggatttataatagatttaaaggttcaatgtttaataaatatcttaaagttcactagagaaaaaatccttattgcgagataacgtggacctattgggaagcttggcagatctgtacttcagagctggagacaataaaaactctgtcctcaagtttgaacaggcacagatgttggatccttatctgataaaaggtaagtaattcttggggcaggaagacagtggctgttgttgggggggatcagagataatagggagaatatgcagcattaatactcgataccaagtttcatagaaatggtgtataaaacttatactagtcttttactttttttaggtcatgacacatgtctctaacgcttaggtaataccatttgagcagctgtttttgcttgaattcaagtgtcttctccccacagatcattatttggctttttttcttttgagggggtcatagctcctccttatgacttataaatttatggtgtgcctgactgagaatttggatggcatccctaaaaccataatatccttttagggaattttgttttgccatgtccttagtataattaaaaaggaataagaaagggataaggtgattaaaggcagtaattaggcgtgaacaacagaaaaatcactgatcttgaaaaagattgcaggtgaagggtaatcttcacagggacctccaacagatggcagttaggacactggcagtgagttctcaggaatagtgggaaataaggtcagatagatatgctgtctatttgtaaaggtccaaaaaaggccatcagaaaaacagggccttgtgacaataaacagtcttatgagctcttaagccaggggaatgatggagctgggaaggggccatcccaagcgtttagatgaggaagcagatctagaaggatggatttgtttgcacaagatctcccctcacctcaagtgcttattcctcttctccaagctgcctgcacccatgatgaaaatgatgttttagaaatactagtctggcaacagctggcagcttggaatggcaatggcagcttggaatctcagacccaggcccaggggctagcaggagcattgcagtaatcttggcttgagaggaattttcatgggaatctgaa

SEQ ID NO: 12673 - DNA, 1049 bp, Homo sapiens
agtatcgcttgaacccaggaggcagaggttgcagtgagctgagattgtgccactgcattccagcccagggggacagaacaagacactgtctcaaaaagaaaagaaatactaaattatggtttttctctcatgcatcgctcagaatagggaagcagttgccttttagccaagggaagatgtagcccgttgctccttgcatgtggaagagagatatcgtgccttactttctttcttctgctttctgttggtttaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctggtgagagccacaaagttaattcagtgttcttgaggccctttgcttgtctggaagtctgatgtatctgaagtagcaaaaagaaaaatgagatgctttgctgttggtgctgcagccagtctctgggatgtgttagtcttttatactgaatggtcccaaatgtaatcatgtaatcatctctgttggagacctgtaaaaatagaaatctgactgagtttagctctgtgcctgcacaggtagtaacccttgcaaagcaaagcaggctaccttggtgtgtcatttttttttttttttttgagacaaggtcggtctctctctctctctctctctctctctctctctctctctctctctctctgtctctctctctctctgtctctctctctctgtctctctctctctctgcctctctctctctctctgtctctctgtctctctctctctctctctctctgtctctctctctctctctctctctctctctctgtctctctgtctctctgtctctctctctctctctctctctcccaggctagagtgcagtggcgcagtcacagctcagtgtagccttgacctgtcaatctcccgggctcaaaccatcctcctgctcagcctcctgagtatctgggactacaggcgcatgcc

SEQ ID NO: 12674 - DNA, 1043 bp, Homo sapiens
ctacgaaaagtaaaaattaaacaattagccgggcgtgatggtgcgtgcctgcggtcccagctactcgggaggctgaggcaggaggatcgcttgaacccaggaggtcgaggctgcagtgagccgtgatcgcatcattgtcctttaccgtgggcgacagaacgactgcctgtctcaaaaaaaggaaacgggagactccattaatgggtgggcgtggcgcctttcatgtttccttgaagcactgagctgattccatccttgagtgcatgtccctctcctgcttaatatcctttattggccgggcgtagtggctcatgcctgtaatcccagcactttgggaggccgaggcgggcggatcacgaggtcaggagatcgagatcatcctggctaacacagtgtaaccccgtctctgcttaaaaaataccaaaaaaatttagccaggcgtggtggcgggcgcctgtagtcccagctactcgggaggctgaggcagaagaataacgtgaacccgggaggcggagcttgcagtgagccgaagtagcaccactgcactccagcctggacgacagagcgagactccgtctcaaaaaaaaaaaaaaatcctttattgcacttatgaaaattctttcccatggcctctgaaggcaaatatctgccctccactctctgcgacttcatctcattactctgttcactgctctctagcctccctggctattctgttatttgtttttatttgtttatttatttttatttttttgagacagcctcgctctgtcgcccatgctggagttgagtggcgcagtcttggctcactgcagcctccgcttcctgggttcaagcgatcctcctgcctcagccaaccaagtagctgggattacaggcgagcgccacacgcccagctaatttttgttattttagtagaaacagagtttcactatattgaccagtctggtctttttttttttttttttttttttttgagacggagtctcgctctgcacgatcttggctcactgcaagcttcgccttctgggttcacgccatta

SEQ ID NO: 12675 - DNA, 1029 bp, Homo sapiens
agaggaattccttttaagcccttgactcaagggttcttaacctggggtccaaggatagaattcttcttttccctgtaaaatatgtgtgtgtgtgtgtgtgtgtgtgtgtgtgtgtgtgtgtgtgtatatatatatatatatttttttttccagtgcaattccaaaagccaaggtgagaaagaaatgtatacgctgggaatcactaattttcccattcctggagagcctggttttccacttaacgcaatttatgccaaacctgcaaacaaacaggaagatggtaagaacaggtctctatcctcactctgtgacacaagaagattttctccatttgacttcctaccacccctctttttcttgccttgattcatgtacagattgagagtgaaatcataggaagtacattatcttattagtcactctcacaaacgattcttggcaacaaggatgacatgcagaaaatcttttgaacaaaaacaaatatagttataaaactatctggactgtcatttctattttgtatcctgttcaaatgtataaaaatgtattaccacagtgagcatccagagctgcaaccagtacatttgggatgtatttgcaaatacagttttttttaaattgttctgttttagaagtgatgagagcctatttacaacagctaaggcaagagactggactgagactttgtgagaaagttttcgaccctcagaatgataaacccagcaaggtaagaccctcttcttgcctgcttaattggtaaatcaccttttatcccatagccaccattgaacacactaaggtcttccattgcaagaatatttttaatttctgcattgcaatgttgcttaacttccagtatatgtctagtatgtaatatgagttcactgaatcacactaaataatgaattgcaggccgggcgcagtggctcacgcctgtaatcccaccactttgggaggccgaggcgagtggatcacttgcggtcaggagttcgagaccagcctggccaacatggtgaaacccccatctct

SEQ ID NO: 12676 - DNA, 1042 bp, Homo sapiens
atgttgcatttaataggaaattgtattatttcttctgacttctccaggaaactcttttgagaaaatggaggaaatgtgcttaattctggacactgtttatcagttctttcaaacaaatctaatgctgttacgtctagaatgccacatgcccatcctttctgtcatcaacctggaaaagaacaacaacaaatattttaacctcttcctcgtctaaatctacttcctttattcattcttcaagatcttcatttttagcaatacctcaatcttaaatctgaagtgtactatgtaacattacttacgtctattcccgcttttctgaattttatttcagaaagccgcaatatttttcagacactgtctgagactcttctgatgctttctgagatgttctcccaacagtataatttgtattatgttagacatggtttccctgtaccctgcaagggtctgaactgaattccattcatggtttccaagaccattattataattaccaatttggtacttatccagtccccatttctctgccagactgtttgacttgaccttttttaaacttaattttgttttcaacaccatttgaaagctcagtaaacttaatgcatatggtgagtcaccacagtctctacttgattctgaggaaaaggaacaaggaagaagacagcctgggaaagaagaaaaataacataaaagaaaatcacaaggctgggtgcggtggctcacacttgtaatcccagcactttggaaggccaaggcaagtggatcacttaaggtcaggagttcgagaccagcctggcaaacatggcgaaaccccaactctactaaaaatacaaaaattagctaggcatggtggtgggcacctgtgatcccagctactcaggaggctgagacaggagaatcgcttgaacacagagggtggaggttgcagtgagccaagattgcaccactgcactccagcctgggtgacagagtgagacttcatctcaaaaaaaaaaaaaaattttttttcactgcaaaggccaggcgtgatggctcacac

SEQ ID NO: 12677 - DNA, 1048 bp, Homo sapiens
ggaaagtgaagatatcaaagattataattcaaaagcacacatttacctgatgaaactgaaggctgttgtatatctctgtaacgtacacctaatagtttgaagtaacaaaaatatcaaattttggctattatgcttgcacatagttgtcagtctagtacagataaattacataattaacttttttgtctattaacaatttccttaaatatttctgggattaatatatcatttcatgttacaactgcagaaatatgaattaccatatcagtctttaaaaatgccaaattctatagggcccagtagtatactttacattttgtaatttttaaaattcagtgtatttacaggtctctaaatgaatcactttagaatgcttgatttcactcttggtaaatagaatgattacctgtattttatatatgcaactgtttacaaccaaaataagattgatttagaacaaagtacattaccataagtatgtctgtttaaattgtcatgatacaatcaatgatgaaacctatcccaaagctgatgacctgaagaaaaatacgtacagattcagcttctgagattaaataaatagtcatgataggaaccctatgaataatttctgggattcgggatctcttatgagacttaaaagggggcttacaagaggagactattttgttttgatattgtgtttaacattatgctttatctcaccttgacactttaaagttggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgaggtgatgtatttccctttcccttctcaaatatctccctttcttgattattacttacataagctttatctttagaccagggtttctcaactggtaaggtttttttttttttccctttttcttttccaaatgtaaaatt

SEQ ID NO: 12678 - DNA, 1029 bp, Homo sapiens
taccagctggcttgaatctgcaggggtggttttgatgagtaagaactttcagtcctgcaaatcagatgtatgcatcagcccagactggaagaacatggcaccctctgccccaggctttggtttccttctcacccacagaagaggaataactagaatacttaacgatgggattgtgaggattagcccaccaaaaatctacaacttgccttagtcataagcattcaggaaacagccctggtataagaccaatgaatagccctaagatttagaccaatggcaacacacaggaactttgattaggaaaacttgggccaggcacaggcagaagtcacttttcattcatccttgccaacgtgtgagcttcagaagagtggaaatgatggactatcaacaccttcagcctacgactcaaatagaattgagtacttgcattagtgcatccctgaattagtgggtggttcatagttgtgtgatcacagagatgactgccatcccatctgatcagctgtagctccaacggacttgttgtcatccagatgtattacaagtattccaataatttcaaacacaggtaagtatttcagttgtgagaattatgtcagttatttgaaagataaatatgttagaggattaaagcacttcagttaatcatgtaaacagttttgtaatcaaaaagttaaaactaggctgggtgcagtggctcatgcctgtaattccagcgtgattgggaggccgaggtgagtggatcacttgaggtcacgagtatgagaccagcctggccaacatggtgaaatcctgtctccattgaaaatacaaaaatcagccaggtgtggtggcacatgcctgtaatcccagctactcgggaggctgaggcaggagaatcgcttgaacctgggaagcagaggttgcagtgagccaagactctgccactgcactccagactgggcaacagagcgagactctatctcaaaaaaaaaaaaaagttaaaactaagaaagtttgcagtaatagggaaatagaattttacct

SEQ ID NO: 12679 - DNA, 1437 bp, Homo sapiens
caaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaaccacacggttgcattttggttttgcttctttcaaatagtctgttttccaaagatggattataatacagatactaatactctttgagttgtaacctggagacatctatttgtgtaatagagtgatgaggtggaacgatcctcctctaccatttggggagatggggattaatctgtgtccatagttttcttactgtctgggttcacttgaacttagtggcgaatttgaaagcagctcactttgttttctgagtcagccacctatattttcatgcacagttctttgatctcttcccccttccctggtttatatggaacacagtatcatgtcatattttgtcacaagtatgtatcttaatttctcaaaggtacgctaaaaatgagtgaagagcatgtcatttgaaaagctttttttcctgttacaaagtggtctccctgagggcgttggcagaggacctagcgaggaactctttgaaggacacagaagagcacagggccatggactcccctctgctaacaagccccggtcctgaggcatctggaccctgccatgctcccatcaaagagggaagggggacctcattacctgcctgctccacattgacaatatccaaacttgtgctgtttcacttttacgtaatattctcccagacttctttgactataggaagaaaacagtgaatgataattgtgtcaaaggcaaattctgcacatctttatgtcctgaatgttaatgaattgatactaggatttcaaaatgctataaagtaaaattgggctgctctactaggattatat

SEQ ID NO: 12680 - DNA, 1047 bp, Homo sapiens
gtttgcactgatgaattcaaatccagttgacctcatttttgtgacgtgtatcctaatgtaatgatactggctgcatcagtttcggtttctacttaatgcagaggcctttaaaaaatgacttagaagatcagtgttggttggtatcagtttcgactcctgtttggtcatcaacacaatttgtagatcttatgctcaagcttcctctctctcatcaggcagatataatttgccatccagtctacttgtgggcatgaaagtgcccttgacataggtggcttttggttgaaggcttgcagacatttaatatatatataaaatacttaactaattttattaaaatgaaaagttgtattcaaatgttgattttcatgggacaatttaaaaaccactgcctgttttccaggtacataagtactttatactaccatttcttttttttttttttttaactttgtaaatgtgatggaaaggctgaggtatatgttgttgggtaaaacatgagtgtttgttgatctgtttctgctgccgtagctgtctgatgtacagtaatgcgaaaccgcattacaggttatggctcagaatcttaggatttggaagctaggcgattaccctggctaaacctttcaggagccagatgttcctagtggtctgaggtagccttagggaggaaatgaagagagaatagaaagaggcaggcccacgcttaaagtgctgagagggaaaaggaggaaacaaactgatttttgatggagaagccagcaggaatcagcaggagaagctggagtatgtggcataactaaagaatcaaagccggggcgtggtagctcacgcctgtaatcccagcactttgggaggccaaggtgggtggatcacttgaggtcaggagttcaacctgatcacaagaggtcaggaggtctgaccaacatggggaaaacccatctctattaaaaatacaaaaattagctgtggtggtgcacacctgtagtcgcggacactcaggagattgaggcaggaaaatcactggaacctgggagaccatggttgcag

SEQ ID NO: 12681 - DNA, 1034 bp, Homo sapiens
tgaagtggggatcccatctttcaccgggagtatttcctgagttctaactctgtatgtgtgtctagagagaaaaaaaattacttacgaaaaaaacatttttgttgctcagttgctgttttattaaatatgcatctgtttcatatctttcctcgaagactattattactatgcttttattgcttcttgttgtataatatttttatcagaacgagacttagttacatattttggggtccaaaagtgaactttataactgtaaaattaaggtacatttagcagttccgtgctactttatctgtatctaatgactatccagtctgttacaactggaaccaaaacaaaatttctttcccacaactacctacgtgctgacaagtgagttctgttgcaaagtttgtactttgatagaagaaccctaagtgctctggtggtgtggatgccccatgctgtgcaatgatttctttctcccattattatcttatctgttcaaattattagggaacgtgctttcttacagtatagcacatgactgacatcctttgccctatatagacatgagcataaacacaaatgcaggcccagaaaatgcatggcaaaataagtacaatgaaccaacattttcttaatgaaatgaaaacaacactaacattttttcataggtaaattaaatcagagatcctcaggaggagatacccatggtcctctggaaaacactgatgggggagggttctgagtatttccaatcctgtttcttttcttttcttttctttccttttcttttttttttttgagacggagtctcgctgtgttgccaggctggagtgcagtggcgcgatcttggctcactgcaacctccgcctcccgggtgcaggcgattctcctgagtagctgggattacaggtgcacgccatgttggcgaggatggtctggatctcttgacctcatcatgatctgcccgcctcaccctcccaaagtgctgggattacaagcgtgagccattgcatctggcctgcagtcctgtttctaacagcatt

SEQ ID NO: 12682 - DNA, 1187 bp, Homo sapiens
gaccttcacacagggaaagacagcccccaccacacctgcttccagaccagcccagagtccccagcagcaacatggtcccctcctcagatatgggtgccgactccaccaggtggccaagggtggaggggccagttacacatggcccctgcagcctgctgtgaggatggtgggacgcttctactctcgagtcggctatggtggggctatgcgcaaggcctggggacagtggcttatgagggatgatgcctggaaagccctacactccctaccccgcagtgggcaccttccccagcgctctcatcccaaaacatggacaggaagtccaggccccatccagcccacctggctaggaggaatgtcctgggatgggccttgcaaggagcaggatggaaggaggggagccacacccccagggccttttccctccacaccttcactcaagctgtgccctccgcacagggcaccattctggccaaaccgctgggctctcaagtgccaaataaggacaaacaactgtcaggcaccgggagctgcgctgcagtgacagccagcggaccagcacatggcacagggcatgcagcagcttccatccacctgccctgtccccagcaggcctgagccacttctgaggacaagatggcatctctgggcggcactcagctccatacacggcagggccaccagaccccactccaggcctggtcccagcacacctcccctgctgcatgccagctgccgtcagcccacgcctcgcacgaccacatcctgctcccagctgtccccataggaatccttcctgcccccactgtggccagcctggctaagcccagcacccctgcccttggccacacctttttcaggtgacgccttctgcgcctcgccaccacaaggccatggacgccccaaaccacgagtgccaggctgtgctggcctccagacagaagggagagcaagcagctcccttggcagggagggggcaagcctggctccctgcagtgggtgggggttgttcacgcctgtaacgagcactttgggaggtcaagatgggcggatcacttgaggtcaggagttcgagaccagcctggccaacatggtgaaaccctgcctctactaaaaattcaaaaattagccaggcgtggtggtgcatgtgtagtcccagctactcaggaggctgaggcacgagaatc

SEQ ID NO: 12683 - DNA, 1024 bp, Homo sapiens
agccgaaataaaacgtgcttcagtgcaactgtagacaacacaaccaactacttggctgcttctgagtttgttgtgaaaagaaggctaagaacataagggagccaaagggcgggggagctaggaaagccagcctggttccagatccacccagggtccacatggaaatgcagttccaggctcccttcaaatggccctgtgctgtgatcagtccccctgcaaaggtctctgagccacagtcccgtcatctgagaagtgaagatgaaacaccagcctcgtggggtcacgcagctctccctgactcccgcctacctgaggatccctctttatcccacctggctgttcagcccgcctggagggaatgtgacgggctggaggcaacagacccttcctctctaggcctcacttgccctcatgctgttacctggaaactgtcttgctacctactgccccttctgtgtgctgagggacaggggacctgtcttggcacaaacatttatagggccaggatggtccttctagagtcttccgaggtactgggccacaccccaccctgccaggtcctcataaccagcttgagtggggtctgttactggctttgccctcaggcatccagcagagacaggcaagtcggggcagggcagggctggacacaccagtcaaaggccagagctctggtggcgtgaccacacctacgtggagagcaaggctgatggcatggcctcccctggtgagagagcaggaagaggcacaggtgagcctgccacagcagcccccagaagccaccatggggcttcaaggctgtgggaatcagcttgagctttttctaaggtggggaagctcttaacaggagcaggcctgctggctgtccccctcctcctgggacgctggagggcaggacacagggcagcatctgacacaccccagcagcaagggcttggcccagaccagccttggggagagaccgcccacccccgggaacccccaggccacactagctccctggtggtcttaccttccccagagc

SEQ ID NO: 12684 - DNA, 1088 bp, Homo sapiens
cccctggcatgaagacgtcatatcccagatgtttaacttctggctggagggagggaacttaatttggttcattatctactgggtacctttcctgtgcggaggggaggaccagtgactttccataataagctttctcctttaaaaaaacttcagactcttacttactcttttggttcacactaattagcattcattttccagagaaagctgcttgactttgaggaaataaagacaggtgtccttaaaaatggactgcaaatctggatcagtgtcaggtctgctttagggtccatgaaatcacccaagagtgttggtactaaaagtggtgtaggctgggcgcggtggctcgcgcctgtaatcccagcactttgggaggccaaggcgggtggatcacctgaggtcagacattcgagaccagcctggccaacatggtgaaaccctgtctctactaaaaatacaaaattagccaggcatggtggctggtgcttgtaatcccagctacttgagaggtcgaggcagaatcgcttgaaccaggaaggtggaggttgcagtgagccaagattgcaccactgcactccagcccggttgacaagagaaactccatctcaaaaaaaaaaaaaagaaaagtgcataggggtttgttcccccaccctctgaaagaccccaaggaaattctagaagcaaaaatttgacctcttggagcacagagactaagtataagtggaagaagcagacctaaccctcctcccaggcagtcagtcctatgagttttaggctgaggtttcattttagcctctgatcgatgtatctgtaaagctgatctaaactcccagtttcctagaagccactgctgtgagcctgggggttgtactgaatggctctgctggcacccaagagcagctgactccactgtcactgcccccgtttctgagcctccagacaggttctgggaggagccagccccctatgaattgtatcacttgtatagatagagatttgacttcaggacctccctggatggtggagattgtgtgtgcccatgtgtgcaaggagatagatagattctcaatccagtgaagcagtagcca

SEQ ID NO: 12685 - DNA, 1049 bp, Homo sapiens
actcaggcctgggcaacagagagagactctgtctcaaaataaaaaataaaaataaggctagtcttggactttggtatttaaataggaaggagtactaatatttgtagaaatcctttagaaatttgtgccattaatattgtcaccttgtatgaaatgttgtgttctagaggatattaaggattcaaattttatgttaggcacattttgagttattttggggtgactcaatgtctgactctactaaatgccatattagcatttaaaatgcatttgaccttaaatctttgttaattatgccatgacttggtatccaaaaataagctgatacatacatacatacatatatgtgtgtgtgtgtgtgtgtgtgtgtatatatatatatatgtatgtgtgtatatataatttatttggtgctaggaaatgttaaatttaatcctttaatagatgctctttaaaaaggagtcttgctgtatgtatatactattaaaggggaaactatgtctgtgattgtagtgtgtaaaagatagtaggtgattttattatgtactcaatttgaggtctcaaatgtagttatcctcaccatcttactgtctctgttagtagtttggtgttgttttcctggtaagtagctaaggtccttaatcattaacacctaagccttaattgccttagcacaacttcccctaaaagggagtatcagtactttttaaaagaaactaacagttgggctgctaatttaatctgctgcttcatttccccctgttctaagccattttatgatggtttggtcaagttgccttttattccccttttagagttttcaactttccttcacttccctttttctgaatttaacatcagatttacaagttggaagattttgttttgttttataagttttgcaatgctggtgatctcttatgacttgtgcatccaaagtcaaaatgacaaaacctagttacaaattaaacacacagctttctgtacttaatttgcttcagtgagatcacagctgaggaaactagttctggaatgtggttagtgttatt

SEQ ID NO: 12686 - DNA, 1035 bp, Homo sapiens
catacaacaaggagacaagcccttctttctactttgccagtgagttgggttttttatactaatttttaattgtacagtaaaacactttttaaaggatacatgttaagggagtagacttgttgaacaatattttccttgtgccagtcaaattattgaaagtacttatatatataaataattcagtttttaaaatggaaatacccaatttaagaaggctggagttaatgaaaaatggagttgtttcagaaatcaatttttgcataccaagcaaatgtgactgggaaatgcctaatattttccttgttagagaaacttcctaaacagctttatacacacacacacacacacacacacacacacacacaaacacacacacccaagccacaagcttggtataaatttaaaatgtttatttatacacacacacacacacacacacacacacacacacaccccaagccacaagcttggtataaacttaaaatgtttatttatattctgataagatgaaatttatgcctaccaggatttttaattgaataggattgatgaaatactaagggaaaaacttttcagtcctgtgcatggctaaaggtttaaaatactcaggaagggccaggcacggtggctcacacctgtaatcccagtgctttgggaggctgaggcgggtggatcatctgaggtcagcagttcaagaccagcctagccaacatggtaaaactccatctctactaaaaaatacaaaaatcagccatgcatgctggcatgcgcctataatctcagctactagggaggctgagacaggagaattgcttgaacttgggaggcagaggttgcagtgagccgaagtcgtgccactccactccagcctgggtggcagagcgaaattctgtctcaaaaaataaaatattcaggaagcagacccctcaggatatcttgagcttaagcaagagatcatgacctctcaggtcattatcttggacagcacaggtcccctctccccacctggcaaaaagtacagaaatagttgctcct

SEQ ID NO: 12687 - DNA, 1076 bp, Homo sapiens
tgcctacgacatgcaagagaattttataataataaaagcataaaggtgttctccagcatgaaaacattttgcttcactacttgatctgagggtcactggcattacatattttttttgctgtttgttataatgataatactatgtttctacatcatgctgtattttaatggttgaatattatgtcatattagatatattttagacatgagtcacactttaaatataaccaatgtgaacagaatgctgaaatgaaaatgagaagtattttatgtaaaactaagcagtatttatatgtgagaataataagcaaaaaaacccatcttcgttttgtgactaaacagagaaatttgtgtagatcaacttagcagctgtctaaagtaccaaaataatagatttttcactgttgataatttaaaataaaatgtccatttgtatatcttatgatacagaattaatggattgcttcaaatgtttttcagaatatgtttttaaatagtactgatttcattaagatgttttgttctgaatatttctgagaactaccgtagtgtcgtttagttttcctatttgcgtttttggttgtttggagtaggggataattttggtttattcatacagttgaaaagtgtactgctatgagaatgagattatggttacatgtaactacatgggcatttcatttttaaagcctctttgaactttttgaaatactaagaatataaaatttttattttttaagtttagatgtcctgaacgagtatgtttaggcaaaattgagttatttaagaatttataggctgggcgcagtggctcacgcctgtaatcccagcactttgggaggccaaggctggcggatcatgaggtcaggagatcgagaccagcctggccaacatggtgaaaccccatctctactaaaaatccaaaaaattggccgggtgtggtggcatgtgcctgtagtcccggctacttcggaggctgaggcaacagaattgcttgaacccgggaggcagaggttgcagtgagccgagatcgcgccactacactctagcctgagcgacagagtgagactccatctc

SEQ ID NO: 12688 - DNA, 1046 bp, Homo sapiens
agtagaataatttatacagaaaagacatttctcagtgcccaataattgcctttctgacataaagttttcatttttcctgaattaataagatttcctcaatgtgtttttttgggtgttttgtgtgtgtgtgtgtgtgtgtgtgtgtgtgtgtgtgtgtgtgtgtatgtgtttgatacagggtcttgctttgctgctgaggctggaacgcagtggcgctatcatggctcaatgcagccttgacctcctgggctcaagcgatcctcccttctcagtcccctggatagcgggggctacaggtgcacaccaccacacctagctaatttttgtattttttgtagagatgggttttgccatgttgcctaggctggtctcaaactcctgggctcaagcgatctgcctggctctgcttcccaaagtgcctgcgcccagccaattttctccatgtttgacctaattgtgatttcatagatgttaactaaaactcttaattttcgttttctcagtatgctattttttttttttttagccttggaacatatgaacctgttgaaagaactctgcctgaaataatgtaatcaaattatagagtttaatcttattttgagggcctttagaaattctgagaagaaagtgggtttttttttttactgccattttaatgtagtgttaaggtgttcatgtatcaccagcaggtgtagctgttttcaatgattacttaaaacaatgcaatgggaactttttgttgtcattaaaatataaaaggttactgtagtaagagcaagcatgacagtttggctatctgatgggagagtcacattctaacttcaggaggtactgtctttttaatagaaatgatatactcagagtctgggcacggtggctcacgcctgtaatccagcactttgggaggccgaggtgggcagatcacgaggtcaggagatcaagaccatcctggctaatacagtgaaaccgtgtctctactaaaaatacaaacaattagctgagcgtggtggcaggtgcctatagtcccagctactcgggaggct

SEQ ID NO: 12689 - DNA, 1102 bp, Homo sapiens
ttagccggacatggtggcacctgccgcctgtaatcccagctactaggtggggctgaggcaggagaattgcttgaacccgggaggcaggggttgcagtgagccaagatcgtgccactgcacttcagcctgggcaacagagtgagactccatctcaaaacaaacaaacaaacaaaaaacaaacaaacaaaaaaaccagactaattggctggacacagtggctccatgcctgatatcccagctggaggatgacttgaacccatgagttcgagagcagcatgggcaatatagtgagaccctatctcaaaaaaaaaaaaaaaagttaattccaaagctttttgatctgaaatctgatttaaatctgaacttaaatttgaagaagagggtttgctagattaatttactagattgctaaccttgctttatatatacctacagttatttccccaaagccagaatttcttttgaagcagaggggcaactaacttcaaccaatgttaagatcctattagaaggatgtttcggctaggcttggtggctcacgtgtaattccagcactttgagaggctgaggtgggcagatcacatgaccgggagttttaagaccagcctgggcaacatggcaaaaacctatctctgcaaaaaaaaaatagaaatcttagccagccgtcatggtgtgctcctgtagtcctagctacttgggagactgaggtgggaggatcaattgaaaccagaaggtccaggctgcagggaactgtgactgcaccactgggctccagcttgggtgaaagagcgaaaccctgcctcaaaaagaaaaataagatggatgtttctgcattaaaattagggagttgtcgtataatgtagttgcataaactagtattctgtgcttgtgtggttaaagagccttcgtagaaaaaatcccacatttttcttaaaaggaaatcttttggccaggtgtggtggctcacatctgtaagcccaacactctgggaagccgaggtgggcagatcacttgaggtcaggagtacaaaaccatcctggccaacatggtgaaaacccgtctctactaaaaatacaaagatcagctgggcatggtggtgcgt

SEQ ID NO: 12690 - DNA, 1106 bp, Homo sapiens
tctccccaagctggtattattccaactgaagctgttgccatgcctattccagctgcatctcctacgcctgctagtcctgcatcgaacagagctgttaccccttctagtgagggtatgtaacaaagggcttctggatccataatctcagctgtgaaattgaatgttagagggtgatattatatgaaaaaattctaggttatttttattcatagacaagtatttttagtgcacatttaaaagtttatgtaaattttgatgttgtttaatactactaatttaatatagtgtctgtgttacaaaggttaacattcctgggtgtcaaatacctacataaataaaattattggtgtttcatatgacatctgcaaaggaaaaaaagcctctgtttaaatgaaagcattattttccaaaaacataggaaatcaaaattattgttcagtgttttcttgttttgcttttctaacttatctgaattttttttaaaaaattgttttctagctaaagattccaggcttcaagatcagaggcagaactctcctgcagggaataaagaaaatattaaacccaatgaaacatcacctagcttctcaaaagctgaaaacaaaggttagagtttaaagagtcattaagcttaactgtaggaataggaagaagtatgtctaatttcatgcccatacagaatatttttgttcaacatttcttcttactattgtgatagataaatgtattgcttgacaaattccaaaatccaaatttaatatttgaaattattttctgatcttatatcttattctaatttctatcatctcatactaaaaagaatgtgatgttaaagtttaaaaataaacctgtgtcttaacagttcttaattttacaggtatatcaccagttgtttctgaacatagaaaacagattgatgatttaaagaaatttaagaatgattttagggtaagtattgtactaactgatgaatttgagttttagaaaataagcattactaaagatttatctatttataaaaatgcgttatgtatacagtcagaaacatcaaaccatatatgtagaaagcagaacatttttaaagtggtctttgcctatcctttaag

SEQ ID NO: 12691 - DNA, 1049 bp, Homo sapiens
aactatttccgtagcatttactttgtattaggtattataggtaacctagaggtttaaagtatgcgagagtatgcaaatactacaccactttgtatcagggacttaagcatccctggattttggtatccctagggggtattagaaccaatcccccatagatgctgaaggacaactgtagtgtgtgttggaataatttattttcaaatggatcatttggagaacactattctttaggaaacatagcctcctaagttctgttccatacatccctttcacctccacggcgttgtagcatcctgctttcatgactgtgtcatcactcggaaggaactgcttctcttccagaatgcttttcaagatctactctgaccacagctataaactttacacttctattctcttcttgcccctcacagtgttctctgttcctctaagatcttaaactctgtctactcctaatccagcctgctgggtgtggctggagaaagtcccactggggggctgattagttaggaatgtagggtttccagctcttgctggagcctcagaagagttcagcagacttttttttttttttttttccttaaacctatttctgcagccttgatgaccactccttccagtccctcacctatttgctttattcatggcagaggctctttcttcctgcttgtcagtacaaagaggcaggattcttcacctggatctgtggattctcaaagaatttgtggagagaattcagggcattgatgaccttggatgaagagaaatttacatctttatttacactaaccttcaagtgaaatttagcattttttgccatttaaaaatatgggcaacaaacaactagtagtattagcagtatttatgacttaagcacctatagaactcagttaatttcatatcgcttgatgttatgggtatctcaaattattattttatgtatatatatttttgagatggagtctcgctctgtctcccaggctgagtgcagtggtgcagtctcagcccattgcaacctctgcctcctgggttcaaacgattctcct

SEQ ID NO: 12692 - DNA, 1050 bp, Homo sapiens
ggtgattcaccttagcctcctgattaagctgggactgcagatgtgtatcaccactcctggctaatttttgttgttattttttgtttgatgaggtctcattatgttgcccaggctggtctcaaactctgggcctcaaatgatcctcctgccccagcctcccaaagtgctgggattacaggcatgaacctctgctcccagcccattttttaaaatatattcacagcattgtgcaaccatcactacaatcaatttacattttcatcaccctgaaaagaaactctgaaccccttagcagttcctctctgtttgtttcaattttccccagctccaggcaactattgatttattgtcttcataggtttgcccattctggacattgcgtattaatggaatcatataatatatagcctttttttttcttttttttttttgaaacagagtctcactgtgtcgcccaggctggagcgcagtggcatgattgcagctcactgcatcctctgcctcccaggttgaagcgattctcctgcctcagcctcttgagtagctgggactataggcgcctgccaccacacctactaattttatatttttagtaaagacggggttgcaccatgttggccaggctggtctcgaattcctgacctcaagtgatctgcccacctcggactcccaaagtgctgggattgcagccatgagccaccgcatctggccatatatattatgataggcttgtttcacttagtatgtttcttccatgctgtagcatgtattagtacttctttctttttcatggccaaatattccattatacagttacacaggtacactacattttgtttattcatcagttggtggacattttcattgtttccaccttttgatttatacataatcctgctgcgaacagtgacttttaaagtttttgtgtgggccgggtgtggtggctcatgcctctgtaatcccagcactttgggaggctggggctggcagatcatttgaggccgggagttcgagaccagcctgcccaacatggtgaaaccctgtctctac

SEQ ID NO: 12693 - DNA, 1032 bp, Homo sapiens
ttcatatacgccatgtactctattctaagcatttttagagttagagatagcaaagcacgtgaataaattcaagaaaaatggaatgttgtactgcatgacattgaatatcaaatggagtcagcgatgcaaataattgtctagattttacaaaaaaaattagcctggtgtgctggtgtgcgcctctaatcccagctactcgggaggctgagacaggagaatcatttgaacccagaaggtggaggttgcaatgagctgagatcgtaccactgcactccagcctgagtgacagagcgagactccatctcaaaaataaaaaataaaagaattgtgtagattttagtagttggaagaagttggagtgttaatgtgtaattagagaacagtgagaaataaaattctacagattgttttattctggtgtgctgttgtgttctcatatggttgtctttttggtcttgatagtgtatcagtaacagagtacgagtaacaaacagggatctcttctgaacggcgtgacattagaaaagctgtttacggcctcaactttgctgtggtttattaagacacagatatgtgttcattctggggccaagcagtaactggagagtggcacttattgaggccagtatggaggcagtacagagattattgagattaaaagaaagaaacaggtggaacggatctatgtaatggaaagctaaacagaatagttcgtggtacacagtagaaaagcattacatgtttattaagatatggtcatcttccatttattaaagttacatgttttataatttttagagtatatagaaattctctaccctatcatgtttgccaaagtcagaacaataacttcatttattaaatataaaaaaaataaaaacctctagcataaaatagaattttatttggacaaacgataaaaaaatactgtgtggtactagtaagagtaaggttgattcaagatacatgggagcagaatccaaagtgtagaaataggccaggtgcagtggctcatgcctgtaatttcaacac

SEQ ID NO: 12694 - DNA, 1491 bp, Homo sapiens
tgagtaaggtcagtgtgacttttaagttcttgatgctaacatcattgatttcaataaagtttaaaagttatattcatgcatatatgcaaatgaataaaaggctttgaaatagtgacttcttacggtacagtgaataagtttcctttggtctcttgaatgttatacatgttccagtttgatttactgagaaactgaaagtacctttacgtcatatgagctgtgagtcaccttggcacattcataattagaagagaccatcagattatcattggaaaatcagtttgtatttatcctttatttgaattccagtgcagacagatctgaggttctcttcattttgctaaaacttcttagggccttcagtcgcttttggctctgtattcgtgtatctttggaattgtcctgttatctctgcttgttttttacttgattttccatccatttccagtattcctttctcctctatttttttccttcattttctttctgctcttcctgttgcgccattattcatgttttcctctttactccaactcaactatggctttacttctgtttccttattccattgttcctcatactttttcctactgcttcattttctttgcagtattctcagcctagatgataggggtcagcaaatctgctcatcagtaaataaattttattgtagcatagctatgcccatgcgtttgtgcattgtctatggctgttttgatggctgtagccatagagttgagtagttgtagctgactgtaggacttgcaaagccagaaaatttgactgtctctttacagaaaagtttgccagctcttggcctaaatcatattttccgctgcatttagggctttttaggactgatcaaaaatacatgctatactggctttggtgaagtaacagaatgtgctctgtcctttaaacttacaactaattgcatgctttgattctaatactgtataatatcctgcgattcttattcatgaccattctaattggatttagtctgaagaattacttttgcttaacagattctttgtcacatttagtgaaaaatcataaaaggggaaggttggttaatggaaaagatctccatcaactaaccactaccttccttatctacaaatttatcttcttcctccgtgccatctttttttttttttttttcagatgatcttgctctgttgcccaggctggagtgcagtgatgcaatcacagctcactgcagcctcgacttcccaggctcaggtgatcctctcacctcaacctcctacataactgggactgtatgtgcacatcactatgcctgactaattttttatatttatattttttgtagagatggggtttccctgtattgcacaggctggtctcaaactgctgggcctaagagtcttcccaccttggcctcccaaagtcctgggattacatgagtcaccgcacccggcctcattattatttttcctctggttttagtagagaggatttttaagc

SEQ ID NO: 12695 - DNA, 1066 bp, Homo sapiens
attaatgtttgtttgtttgttttgagacagagtcttgctctgtcgcccaggctgggtacagtggcgtgatcttggcgcactgcaacctccacctcctgggttcaagcagttatcttgcttcagcctccctaataactgggattacaggcacgtaccaccacacccgggtaatttttgtatttttagtagagatggggttttaccatgttggccaggctgatttcaagctcctgaccttaggtgatccacccacctgggcctcccaaattgctgggattgtaggcatgaaccactgtgcccagccagtaagttccatggttgttaaaggatttctccacaaataaagctaaaagtaaaaaaaaaaaaaaaaaaaaaaaattctcaagcaatataagatgcagactattatgttgttcaagttttttttttttttttttaatctttggctttatttttggggaaaccttttttttcttttttgttttccttgggacggagttttgctcttgtcgcccaggctggagtgcaatggtgcaatcttcgctcactgcaacctccgccttctgggttcaagcgattctcctatctcagcctcccgagtagctgggattacaggcatgtgccaccatgcccggctaactttgtatttttagtagagactgggtttctccacgttggtcaggctggtcttgaactcctgacctcaggtgatccacctgcctaggcctcccaaagtgctgggatcacaagcgtgagccaccgcgcccagccagggaaacctttattttgaggcggagtctcgctctgtcacccaggctggagtgcagtggcgtgatctcagctcactgcaacctctgcttcctaggttcaagcaattcttctgcctaagcctcccgaggagctgggattataggcgtctgccaccatgcccagctaatttttatatttttagtagagacggggtttcaccatattggccaggctcttctcaaattcctgacctcatgatccacccaccttggcctcccaaagtgctaggattacaggcgtgagccaccacactcgg

SEQ ID NO: 12696 - DNA, 1070 bp, Homo sapiens
tatttctttttttttttttctttttttttgagatggagttttttttgctcttgtcacccaggctggagtgcagtggcatgctatctcggctcaccgcaacctccgcctcccgggttcaagcaattctcctgcctcagcctcctgagtagctgggattacaggcatgcaccaccatgcccacctaattttgtatttttagtagaggcggggtttctccatgttggtcaggctggtcttgaactcccgatctcaggtgatctgcctgcctcggccttccgaagtgttgagattacaggcgtgagccaccgcgcccggccgtatttcttaaataaaatggcttaaacgtcaaaattatcccttgatccctgggctatggactgattcttgtgttagcagttatgaaaacatttatgtccttgtacattcccatcatagctttttgtcaatgagaagtaattttttttttttttttgagacagaatctcactctgtttcccagcgtggagtgcagtggcatgatctcagctcagtgcatcctacaactctgaggttcaagcaattctcgtgcctcagcttactgagtagctgggattacaggcgcccaccaccacgtctggctaatttttgtatttttagtagagatggggtttcacgatgttggccaggctgggctcgaactcctggcttcaagtgatccacctgccttggcctcccaaagtgctgggattgtaggtgtgagccactatgcctggcctaattggcctaatttcaatattgttatatctcagggaatagagaggcacgaggagaaagagagacaagctgactgctggttcgtggagtagtcataacacacaacatttattaagattgctgtcttatatggaccgtttgtggtgccttaaaagaaatcagggtaacatcaacgattactgattacagattactataacagatacaataataattgtaaattattatttacaattgtaaaatacaatcttttctttattatttacaattattgtaaaatacaatctgattacagattactataacgtatacaataa

SEQ ID NO: 12697 - DNA, 1311 bp, Homo sapiens
tcgaactcctgacctcaggtgatccacctgctgcggcctcccaaagtgctgggattaccagtgtgaaccaccgtgcccagcccgatagtaaatattttaggctttgcagtccatatacagtcccatttttttgtgtatgtttgcacgttttctttacatattttaaaagcccctttttttttttttttgagacagagtcttgctgtgttgctcaggctggagtgcagtggtgcaatcttggctcactgcaacctctgcctcctgggttcaggcgattctcctgtctcagcttcccgagtaactgggattacaggcacatgctgccacgcccagctaatttttgtatttttagtaaagatggggtttcgccacattggccaggctggtctcctgatctcaggtgatctgcccacctctgcctcccaaagtgctgggattacaggtgtgagccaccgtgcctgacctaaaagctctttacagtgtaaaaaatattctgagctttaagccatgtgaaaataggccatgggcatttgctgacccctaatagaactccattttacctttctgatcatgtttcccattaactcttcaaaaatatgacctccatttaaatcaagatggtctccttcctcactgcttgtggaggtccagtgcccagtgtctgcctcttgcttgctcctccatcattgttctgccattcgagatcctcatacttaccctttaagatctagcccaaattttccatgaaactaattctaataattaaaaacttcctgtagaacttaactttgtctagtacaagttagctttcttattcagtagtagcttactataaattacaagaataaaaagattaccattttccctcacactgttttgtggagaatgcctaaagttactttttctttttacaggtcagtattcctatttggcatcctaatcccctttcccaaatctgaattttgggatttgaagcttgcatttgagattatgatttgtcttccttgttgtacacaggagcagggactttacaattagtattcgcatccctgctccttcatacttcgtgatgtaaggcaagttattttcacttatgcttaagtttcttcccctgtaaaaaggggatggaagaggattaaatgaattaaacatgtaacacgcttaaagcaatgcctggcaagtaataagtgctcagtaacttttagctgttcttattagcatgtttggaaaccagtagaaactacaccagcaagttaaggttgaaaagtggtattgatgggcttggggtagtacagtatgaatggctacagt

SEQ ID NO: 12698 - DNA, 1034 bp, Homo sapiens
ctcattgtggttttaatttgcatttccctaatgcccagtgatattgagcattttttcatgtgtttatttgacattcataccatctttggtgatgagaaactatgtttatgcattgcttaatgatggggatgtgttttgagaaattttttcggtgatcttatcattgtacaaatatagagtttacttacacaagcctagatggtatacctactagacacataggctgtcgtacagagtattactcttaggctacaaatctgtatagcatgttgcggtactgaacactgttggcagatgtaacataatgttaagtatttgtgaatctaaacatatctaaacatagaaaaggtgagtaaaaatacagcgtaaaagataaaagtggtatatctgaataggtcacttaccatgaatggagcttgcaggacaggaagttgcttgggatgagtcatttatcagtggtgtgtgaatgtgcaggcctaggacattactgtatgctactgtagacaaacactgaacagttaggatacactaaattgataaatatctttcttattttgttttttgagatggagtctcgctctatcgcccaggctggagtgtagtggcgtgatgttggctcactgcagtctctgccttctgggttcaagcgattctcctgcctcaacctcctgaatagctgggattacaggtgcgtgccaccacacctggctaatttttgtatttttagtagagacgggggtttcaccatgttggccaggctggtctcgaactcctgacctcaggtgatccacccgccgtggcctcccaaagtgctgggattacagatgtgagccaccgcacctggccagagatgaggtcttgctgtattgcccagggcgttgaactcctgggctccagcaatcctcccacctcagcttcccacgtagctgggactgtgggtgcacgccatcatgcctagccgttttgtgaactgttgaccaatgctcttttctgcagacagaaagttcactgtggttaggagttaagacttttaa

SEQ ID NO: 12699 - DNA, 1067 bp, Homo sapiens
ctgggactacacccacctcccgttccgttgtcatcttttttttttttttcttttttggagacagaatcttcctctgttgctcagggtggagtgtagtggcacgatcatagcttactgtaactgtgtaacctcgaattcttgggctcaagcaatcatcccatcatcccacctcagcttgctgagtacctggggctacaggtgtgtaccaccatgtccggctaattacttttcttatttttaatttttcggagataggatcttgctctgttgcccaggctggtgtcaaactcctgggctcaagtgaaactcttgccttggcctcccaaagtgttgggagggattacaggcatgagccactgcacccagcctcctctttcttcccatttaactcctaaccacaccgaactttctgtctgcagagaggagcattggtcagcagttcacaaaatggctaggtgtgatggcgtgcacccatagtcccagctacttggggagctgaggtgggaggatcgctggagcccaggagttcaaggccctgggcaacacagcaagaccttatctctggctgggcccagtggctcacgcctgtaatcccagcactttgggaggctgaggtgggtggatcacctgaggtcaggagttcgagaccagcctggccaacatggtgagaccctgtgtctactaaaagtacaaaaattagccaggcacggtggcgcgctcctgtaatcccagctactcgggggggctgagacaggagaatcacttgaacccaggaggaggaggttgcagtgaaccaagaacacgccactgcactccagcctgggtgacatagtgagactcttatctcaaaaaaaaaaaaaaaaggtcgtctgtactattgcatgttagtagtttctttctgcttattgttgagtagtagtctattgtatgcatgtaccagtttgttcatctagtggtggacattgagttagcaggttttggctattaaaaataaagctggaggccgggtgcgatgtctcacgcctgtaatcccagcattttggaaggccgaggcaggcggatcacct

SEQ ID NO: 12700 - DNA, 1075 bp, Homo sapiens
ttaatattgttttgtgaaactcatttcacttttgtgtgtgtcatgggtgtttcttactgtgggctaatgatcagaatttttcatttgttttttgagataagatctcactctgttgcccaggctagaatgtagtggcaccattacagctcactgcagcctcaggctcagcctctcatgctcaagcgatcctcccacctcagtctccctagtagctgggaccacaggagggtgccactgtgcctggctgatttaaaaaaaaaattttattcagatcggggggttggccgggcacagtggatcacgcctgtaattcccagcactttgggagaccaaggcgggcggatcatgaggtcaagagattgagaccatcctggctaacacggtgaaatcccatctctactaaaaatacaaaaaattagccaggcttggtggcacgtgcctgtagtcccagctacttaggaggctgaggcaagagaatcacttgaacagggaggcggaagttgcagtgagctgagatcacgccactgcattccagcctgggcaacagagcgagacgccatctcaaaaaaaaagagagagagatgggggaatcttactatgttgcccaggctgatctccaactcctgggctcaagcaaaccttctgccacggccctcccagagggctgggattacaggcgtgagccatggcactggaccagaaatgttttaataagcactaatttaaatcgttgttaacatttgtctgtagcaatattaagaacctttctggccaggcgcagtggctaatgcctgtaaccccaacactttgggaggccgaggcaggcagatcacaaggtgaggagatctagaccatcctggctaacacagagaaaccccgtctgtactaaaaatacaaaaaattagctggacgtggtagcgggtgcccatagtcccagctactcaggtggctgaggcaggagaatggcatgaacccaggaggcggagtttgcagtgagccgagattgcaccactgcactccagcctgggcgacagagtgagactccatctcaaaaaacaaaccaaccaacctttgt

SEQ ID NO: 12701 - DNA, 1048 bp, Homo sapiens
ccaaagttagtttgaagtcaaaaaagacttaatttagagtctgattctggggaagcctgtcaaagatgttaaaaggtttaaaacacttgctcaaaacaggatcacatgtcactatgaaataataatcatttatttaaccagagtgaccatcaaaagtctttaaaagcaaaaaaaaaaaaaaaagtctttaaaagcaagtacagaaatttatgtggatataaattttttaacactttaattaaaaacccaatataacaatatgaaacacaggaaattattttgattaaatgtaaaatctttggtttttttaggccagttatcaagaatttaaagaaaaacctgtaatatgatttttttttctttttatggaaagttcatttagatgacctgggagtcaaatctgatgaaaaggtacttgactttaacccatttatgctggaggttgcagcttttttgaattgcagacgtgtgaaaaatcagaccttggggatgaccttgagcagtaggatgtaacttctacatgcttagcattccaataatggaacactaggcataaatgggttttaatcagatactggaagagtatgtgttcaagattatgagagtgtacacagttttataggagaagtaaacaagaaaactagtatcttaagcaggggtgttgggaacaggcccccaaatcccaaactggccataaacaaaatctctgcagcactgtgacatgtttgtgatggccatgacgcccacgctgaaggttgtgggtttactggaatgagggcaaggaacacctggcccacccagggtggaaaaccacttaaaggtgttcctaaaccacaaacaatatcctgagcgatctgcgccttaaggacatgttcctgctgcagataactagccagagcccatctctttgttttggcccatccgtttgtttcctgtaaggaatacttttagttaatctataatctatagaactaatgcttattactgacttgctgtcaataaatatgtgagtcaaactctgttcagggctctcagctctgaaggctgt

SEQ ID NO: 12702 - DNA, 1050 bp, Homo sapiens
gtggctcacgcctgtaatcccagcactttgggaggcggagggaggcagatcacgaagtcaggagatggagaccatcctggctaacacggtgaaacgctgtctctactaaaaaaatacaaaaaaattagccgggcgtggtggtgggcgcctctagtcccagctactcgggaggctgaggcaggggaatgttgtgaaccccagaggcagagcttgcagtgagccgagattgcgccactgcactccagcctgggtgacagaatgagactccgtctcaaaaaaaagaaaaaaaaaagcagacatgttcatattgaacctagtgagtgaaaaagtacctcctttcaaaatgaacatgtctgctttctttaatgaagagtggggacatttgaggaagattaattggttttcaccaggtagaaagaaatgtaggaaaaggatcccaagcagaaggaggcacagataaaagcacaggggcaggaaagtgaattctgtggcgcagtgtgacacagttggcagggccagagcttatggtatacgggaagtactgttagatatgaaggtgataggcacaatagccctgttgtgactatcaagtggttgtttatgttaaaagatctgtctgcatcctggaatgatgagcaagagttcttgttttcagagttctagaggttatccttaacttggccatactctctggatttttcaagccctagcttctgttcttgtcttttgaccttgggaaagttacctaacctctctaggcttcaatctctttatctgtaaatggaaatgataataatgcctacttcataggattatggcaaggattaaacaaagcaataatcggccttatgttgttaaagtcatgtttcatatagttactgagcactaccaaatacctgatgcatatagttttggctaattgtcttttaaaggtaaaaatctcttcaattcagtttccattaggctcctctgctttctttcctccctttctaaatttgaaacactgtgaataaggcctctggactgtgacctctagtcctgattcccttt

SEQ ID NO: 12703 - DNA, 1020 bp, Homo sapiens
cggagtagctgggattacaggcgcctgccaccatgcacggctaatttttgtatttttagtagagatgggatttcaccatgttggccaggctggtcttgaactcctgacctcaagtgatccgcctgcctcagcctcccaaagtgctgggattacaggcgtgagccactgcgcctggccatatttttagtagagatggggttttaccatgttggccagtctggtcttgaactcctgacctcaagtgatccacccgcctcagcctcccaaagtgctggcattacaggcatgagccaccacacctggcctataatatagtttctttaggatagctcttagatctgaaattaactgtatatatacatttatacagttaataaatgtatatgcatatatacatttgtactcatccccaacagtgttgagtatgtatctttaaccatctggtaggtgaatattggtatctcctttttctaatactgatttttaaaattttattgatattgaactgtccaagaatacttcttgagtgaaaagctagctttattaattgattggctaggttttttagttgtatcacatgtttcttggatttctttgatatgtcttctattctttgtccaagtttcttattgtggtagtaatatttttcctatttatatgtgttgagctactgggttcttaacataataatgttactaatcccctgtcataggtgatgcagtttttttttcagtttgttatttgtcttttaacttgagtgattttttttttgtcaatgtagtaatatttttaaaaacaaggataatctttttaatggtttttagctttgtgtgatgtttagaaagggtttttcagctgtcagtgtcatgattgcagaagttgttacctaattttcttccagtgctttgatggatttttttttatttaagtatttaatctatcggaaatttattttaatattactgtgttattttgtatctccaaatgtctagctggttattttagtaccattcattcact

SEQ ID NO: 12704 - DNA, 1032 bp, Homo sapiens
gaaatttagcattgatacaatgatattatctaataaagtccatattcaggccggatgtggtggctcacacctgtaatcccagcactttgggaggccgagacgggcagatcacttgaggtcaggagttcaagatcagcctgaccaacatggtgaaaccccatctctactaaaaatacaaaaattagtcgggcatggtggtgagcatctgtaatcccagctacctgggagactgaggtatgagaattgcttgaacccgagaggcagaggttgcagtgagccaagatagcaccactgcactccagtctggatgacagagcgagactccgtctcaggaaaaaaaaatcagtattcaaagttttccacttatctcaattatgtcttttatacctttttcaaaatactagaatgccgtcagggatctgacatgacctttagttgtcatgtgtgtttacccttctttaatctagaacgcttccttaaccttttactttgtttttattgttgaagacactagcttgctttttggtagaatgtcccacaatctggatttagctgattgctaaatgtaagctgattgcttatattgaagttaaatatagacatgttgtcctttttagtgagttaaatcaggagtcactaatgttgttgtgtcccataattaaataatgaaatctgaaatcaccaataatgggacactaatgtgattaatgttgttgtgtcccattattggtgatttcagatttcatatatgattaaggacatatctaccagatttctttataaaggtgcctttttccctctgtaataagtaagctataggataatgcttgagtctatgaatatcctatttcccaatggcccttcacccactggttttagcattcattgttagttcagcgcctgaattagttattacattgacgtgtcccaaatgatgatttttaaaaattctgtcttttatcatttatcagctgctattattttgtaaaataagagatgtcccaacccattcatacatatttgaatatattc

SEQ ID NO: 12705 - DNA, 1079 bp, Homo sapiens
gcatggctttttaaagaacttacaatggatagtctatcctttggagtttggttcattatggaaaatgaaaaacaaatagctttctaaattaaatttttatttgcttattctttatttgtgtgttgtgttccttaaaatagcattgaaacaaaagctgaataaaactaaaatgttttttgttttcagatgtcttcagtaaatgtaaaggtgacctcttagaagttaaagatggtaacttgaaaacacatcctactcttttagaaaatctagttttctttgttgaggtaagtttttgttctcttcctaaaagacattgttgttcttaatggtctacaggattcatttttcaacagtgaacaggtaataggcaccttatacctgtaacttaaccctccatccctgtttttgttaattgaaaagcaatttaaatcattttctaaaccaatttcttccaagaattctaagatgatttcattcataatacttaggtaaaacttcttgaaatttgctgtactcatctctaaacttccccagattcacctcaaatctagctgttttcattctcctttctgactcactctttattatgtagtttaattcctccagcttcttttatttgttgtcatttattaattgctaagatattatgcattgtgatagtgtccagcaactgatacagcaaaactccctcctctttttttgccagagggaagagaaggaagattgcaaacactcataatctattatcttttcttttatttctgtcacatatttgttgactgttctccccttactactctgtgtggggagtgtacactgttctggtgattggcaaactgtaagtgcctaagagatttttattaagtgaatgagtaataagcggacatatatgtacatgcacacactgtagtataggagaagacatataaacagctaatttgatacagtgcaggatatgtactgatcaactgggtagattttgccatacatatgtaagttaagatttgcaggtaaggtggtatcttacctgcttggagagatgtgacgggagaggcatattgtaaagaacctttggattc

SEQ ID NO: 12706 - DNA, 1022 bp, Homo sapiens
acatggcaaaagcccgtgtctactaaaaatacagaaattagcgaggcaaggtggcgggcgcctgtagtcttatctactccagaggttgaggcaggagaatcgcttgaaccagggaagcagaggttgcagtgagccgagatggcaccactgcactccagcctggatgatagagcgagactttgtctcaaaaaaaaaaaaaaataaaaataagaagcactaaactttgtagagaagagatttcttttgtaagctcctagtgaaaatcacaaatactccatagaccttttccttttatttatttattttttaaatcataaggttagtagatcctaccattcagagtgtttgaagcacatagattttaagctctcttaaggaattttaggtagtacctctggcaaaaaggtaattagtgcctttctttttattcttccttttcctttcattatcattttctttttgtctcaaaataatgaaaaatgcataagggtctgtagagagaagaaaatgtccttgcccatgaacttcttgcaggtatttatcttgcttctttatcttactaaaaatagaattgaaagtttttcattttttgtttttcaattttagaggatacaatggagattcaggaacgaatagaaaatagttttaagtctttactagaccagttaaaaggtaagttttcctactgtagattcctgtatttgtatctggttgtatggcaatagcttcgaagttctttcccctattcccaagcccaatcacccagagataagtaagtagttttaacactttggagtcaatactcctagatgccacctaaacacatatgtgtgtgaatgaaaatacagataaaaagtaatctttaaacataggaaatggtgtaatccatgcttttttgactttaatttttttgttattttggatacctttccatgtcagttatatataccccatttattttcaagactgcgtaatattctatagtattgtattaacattttttatgttatcgcaattggtga

SEQ ID NO: 12707 - DNA, 1050 bp, Homo sapiens
gccggctaattttttttgtatttttaatagagatgggattttactgtgttagccaggatggtctcgatctcctgacctcatgatctgcctgcctcggcctcccgaagtgctgggattacaggcgttagccactgcaccgggccacacccgctatttttagttagacttttatacatccacattacaaaagtctaaaaagatctataccaaacttgataatactgtgagtattggttatcagggcaccttttctacgttttacatttttctatcatttgcattttttatgttgtgtattatttttattagagacaggatcttacccaggctggagtacagtggcgtgaccatatctcactgcagccttgaactcctgggctcaagcaatcctccaatctcagcctccctagtagctgggactacaggtgtgtgccaccacgtccagccaattttttgtatttttttttttttttttttagagactgggtcttgctatgtttaccaggctgttctccaactcctggcctcaagcagtctctcacctcagcttcccaaagtgctgggattacaggtgtgagccaccacacctgtcctcatgtattatttttataatcagagaacaaagtgtcacttataaggaaaatgacctgttttttttgttttgttttgttttgttttgttttgagatggagtcttgctctgtcgcccaggctggagtgcagtggtgcaatcttggctcactgcaagctccgcctccctggttcatgccattctcctgtctcagcctcctgagtagctgggactacaggcgcccaccaccacgcccggctaattttttgtatttttagtagagacggggtttcaccgtattagtcaggatgatctcgatctcctgacctcgtgatctgcccacctcggccttccaaagtgctgggataacaggtgtgaggcaccgtgcccagccaaaaatgacctgttaaataggttatcattcccattttattgatagtgaaatggggtttgagaacattttggcttgtcttaggtcat

SEQ ID NO: 12708 - DNA, 1035 bp, Homo sapiens
ctaaaaatacaaaaattagccaggcatggtggtaggtgcctgtaatcccagctactcggcaggctgaggcaggagaattgcttgacccgggaggtggaggttgcagtgagctgattgtaccattatactccagcctgggtgacgagagagactctgtccccccaccaaaaaagaaaaatatggtacagctaggaacatgtagcttgaccttaatgttgagtgccagatagagactgtggtgtgaactgtttcctaaagaaatctaaggctaagaaagattatgattgtagtgtcttactgtgtgtgttcaaccttgtgcttagagtatcagaaatatctctcttcaaatccagagctctatactatgcatcttttattcttggtagtttttgggatccccggatgctttttccttgggtgactgatgcatttcaattcccacctagctctttgacaggacacttttacttaaatggaaaatctagtgttttgcttagtaatgttttgtgctatgggattgaaagttgtatttggaaggtctgcatagggattttctttctagaaaggttattttctgttgtcatcttactttggaatagatttttaaaaatatgaaaataagcactagattttcatatctttaaaagtcacttacgtgtttttacttcttaaaaatttccctttaaaatctctattttatacaaaaattatctgggtgtgttggcgagcgcctgtaattccagctacttgggaggctgagtcaggagacttgcttgaatctgggaggtggaggttgcagtgagctgagatcataccactgcactccagctgtcactcttggatgacagagtgagactctgtctcaaaaaaaaaaaaaagtaaataaaagaaaatataatctctaggtattcacaaaggtcattattcaggggttttatgtccatatatttcactaatttttacagtgaccagggttcatttcaggaatccattcgggatctaaatagcctcattggtgcataaatgagtagaaaa

SEQ ID NO: 12709 - DNA, 1087 bp, Homo sapiens
agagcactcagttttgttttttttgagatggagtcttgttcttgttgcccaggctcgagtgcagtggcgtgatctcagctcactgcaacctccgcctcctgggttcaagcgattctcatgccttagcctcagagtagatgggtttacaggcacatgccaccaagcccagctagttttttttttttttttttttttttttttttttttttttttttttttttgtgagatggagtctcgctctgtcgcccagactggagtacagtggtgcaatctcagctcactgcaatatcctcctcccaggttcacgccattctcctgcctcagcctcccgagtagctgggactacgagtagctgggactacaggtgcccgccaccatgcctggctaattttttgtatttttagtagagatggggtttcactgtgttagccaggatggtctcgattacctgacctcgttatctgcccgcctcggcctcccaaagtgctaggattacaggtgtgagccactgcgcctgaccagtttttgtgtttttagtagagacaaggttttgccttgttggccaggctggtctcgaactcctgacctcaggtgatccacccgccgcggcctcccaaagtgctgggattcaggcgtgagccactgcacccagccttatcatgccattcttaaaatccttcagacctcaggaagccaaggcttgagcccagtagttcaaggctgcagtgagctatgatcacaccattacactccagcctgggtgacagagcaggaccctgtctctaaaaaatttaaaaagaaaaaaaatccttcagaggtaccctgttttcctgaggataaaagtcaagtgttttgggatagtttataatgctgtttataatctggcctgtgcccacatctccagattcttaggtatttatggtcttgaatctactttaaaatttttttgctactatcacttaacatcatgttgcctctctttgaaataactttcttacctccctcatctaagttttactcaaatggtgcctttaacaaagcctgtcttgattttaactccttccccactggggattttatgctcctc

SEQ ID NO: 12710 - DNA, 1035 bp, Homo sapiens
tcgctcttcttgcccaggctagagtgcaatggcgcgatttcggctcactgcaacctccacctcctgggttcaagcaattctcctgcctaagctgcccaagtagctgggattacaggcatgcaccaccatgcccagctaattctgtatttttagtagagaccgggtttctccatgttcgtgaggctggtctcgaactcccgacctcaagtgatccaccagcctcggcctcccaaagtgctggtattacaggcgtgagccactgcacccagcctcaacgattctagtttttaaagaaattttttgcacagcagtaaaactgtacagactaaaataatgagcagattattttgtaacaaaaccttgtcaggaagatgtttctttagaattcattaaagaaggccacagtaaacctaactaatatataaaatggcttgcaagaatagaagaactggcagtagaaactatagaagcatttaatcaaaaacatgaaaataatggctgggcatggtggcttatgtctgcaatcccagcactttggggaggatgagacgggcaacttgagttcaggagttcgagaccagcctggccaacatggcaaaaccccgtgtctactaaaaatacaaaaattagccaggtgtggtggtgcatgcctgtactgtagtcccagctactcgaatggctgaagcaagagaatcgcttgaacccgggaggcagaggttgcagtgagccgaggttgtactacagcactccagcctgggcaacagagtgagactccgtctcaaaaacaacaacaacaacaaaaacatgaaaatcagtgctgcagtttgttaaaattatgaaatatatatatctgatcataatgattaaaattaatagaattataggtaaattgaagcaaattcattacagatgttaaactgcaggatgagtaggattttgttttaatttttttttatttgtatcaaaaaattacatatactgaagctgggtgcagtggcacacacctatagtcacagctactcaggaggctgaagc

SEQ ID NO: 12711 - DNA, 1051 bp, Homo sapiens
agctcagaatttggctcactgagaaaaatatctttcttagtagtgagaattctctcaaatactgtgtgtgagcttcacgttactggagggattgaagtagaatgtagataaaccaggtgggagggattcattcagtaagtgtcgagcatattgtgtgctaagccctaagataaggaataactgatcttgtcttacagtgcttattgtcttgctagttgaagcatcaaatggtgggggtgcattagaggaacactttgctacttttagatgagatttatgaaggtttgctaccatgaatctagtaccagtaaccttttctgtacagctctacttcattggtgtgtttgagaatcttaggtcatctcatgtgatcccacatagtaagaatcgtctattcagatgacccttactggaatgctagcagtgataagctctagtcactgctctgtgagaataaggatttaaagctgttacattgagtttatagtcctagtctatgtaaattttacttgagagaggtaattttgctgccactttttgactgtaggataacttcagtagctaaatatcctgccagtcagcaagtatgtttgtcagaggattacgaactgtccaagtcaatctgagaattgtcctaatgaattatgaaccaaatctttctaaagtctgactagcccctaagagtgagccagtgagttcagttatcctgaagtggctcgccctgggtgatgttctaatcttttgtttcatttgctttggggttttagctaaacaataaaatgattctagttttttatttatttatttatttttttgagatagagtcttgctctgtcgccctggctggaatgcaatggcacaatcttggctcactgcaacctccacctcccgggctcaagtgattctcctgcctcagcctccccagtagctgggattacagacgtccatcaccacccctggctaattttttttttttttttgagacagtttcgttcttgttgcccaggctggagtgcagtggtgcaatctccactcactgtaacctctgcct

SEQ ID NO: 12712 - DNA, 1049 bp, Homo sapiens
catgtttatttgtttttgctaataactggttagtatggtatcttaagtaaagtttattgatgtacacttacaagccaaattttgtgtttgctttgtagtctcctagaactatattggattgcagcatattctggaaatgttggactttaattttagtaaattctggttcaaaaagtaaagtatcactcataacatgaaaattcacctttgtgattactgctgttgctaaagccatcaagtcactaggaatttacactaactgggatatgtaaatatattgctgttctcccaagaaactttttgtcgtgtatctagatcattaatccccttctgtatggtgttttctaaataaaatatttatggttctcttttaggctggcatggctctatataagattgtccccaaaaatccctactacttttggtctgtgatgagcttaattatgcaagtgagtatggcattcagaatgggattgaggtttggttttattttttatatagttattgtcctcagtgtgtcttctgaactggttttttttgtttgagacagggtcacgctgtcacccaggcaggagtgcagtggtgcaatcatagctcactgctgccttgacctcctaggctcaagcaatccctctacctcaacctcccaagtagctgggactacaggtgcacaccaccttgcctggctaattaaaaaaaatttattttttggtcaggtgtggtggctcacgcctgtaatcccagcactttgggaggccaaggtgggtggatcacgaggtcaggaaatcgagaccatcctgaccaacatagtgaaaccccatctctactaaaaatataaaaattagctgggcatggtggcatgtgcctgtaatcccagctactctggaggctgaggcaggagggtcgcttgaacccaggaggcggaggtttcagtgagccgagatcatgtcactgcactctagcctggcgatagagcgagactctgtctcaaaaaaatgttgtagagacagggtctcactcttttgaccaggctggtcttgaactcctgg

SEQ ID NO: 12713 - DNA, 1045 bp, Homo sapiens
gatactggtctgtggcctgttaggaaatgggccgcacagtaggaggtgagcagcagggtgttgtgggggagagcattactgcctgagccccgcctcctgtcagatcagctcttaggagtaggaacacaaaccctgttgtgaactatgcatgtgaggaatcgaggttggcgctccttatgagactctaactaatgcctgatatctgaggtggaatagttttatcccgaaaccatccctccctgccatctgtggaaaaattgtctttcatgaaatcggtccctagtgccaaaaaggttggggaccactgctctagttcataaatgaaaacttgcaggtcctcaatcaaaagtggtatttattctgacctcctcttggacagtgtggtagctttgtgagtctggtcctattttgcctcagaagtgacagggtaccttggtgagtgaagactatcttgcgtttctgtagaaaagtcacttggcacaacctatttttttccattctgaaaatatgaccatttaaaaagccctgacttactagaacttctctcaatgaatctagaacttccatcaccattggatggctgagaccacctctgccataccaaaaccttgctcataaccaaaacagtccctgttggtcttttgccctggacctgtgacattctggactatttttgtgttcagttttggccaagtgttaacaagcatacaaagctgggcacagtggtttggctgggtgaggtggctcatgcttgtaatcccagcactttgggaggccgaggtgggtgggttgcttgaggccaggagttcgagactagcctggccaaaatggcaaaaccccatctctactaaaaatacaaaaattagccaggtgtggtggcaggcgcctgtaaccccagctactcaggaggctgaggcagaagaatcacttgaacccgggaggcggaggctgcagtgagctgagattgtgctactgtactccagcctgggggacagagcgagacttcatctcaaaaaaataaaaaatagggctgagtgcagtggct

SEQ ID NO: 12714 - DNA, 1097 bp, Homo sapiens
ggcccaggctcaccttcttaaccactgtgctagaaactacctcactttgagctgaagacactgatttgcctgaggtcacacagatggtaagtggcagagaaaggactctgatttcctatttccccggggctgcatattctcatgcccttgccctccagtgtatattttcagagggcagagatatatatacaaggtgggtgatggaaggtgagaactgaatccagggttcatagtttgtgactcattacagctttgtgcagcagctgcctgcagacttttttttttttaaactaaaaacactcaatactttcaagaataatttgatttttaaaattgttcttgaggaccaaagagaatttctttggtcccatagttatttagaattaatagtgttttgactgtctaatgggaaacaccatgtccatttcacatcactaaacatcaggatatattaacaagttatattctcaaaactgaagtcagaattatgtagcttttgtaacatgtacatgggaagaggattagaagaggctttcttcagtaattctaaggcgattagtataaactggcaggactaggaaaagaacggtacagactgtccgtgaattcagcacttaagcacatttgacttttgaactccacacttttgttgtttaaatacattactacccccaaacaaccatggttccttgaattcagacattctgacaaatgaacaaactcatctatggtggtacttgcccaccagccaaaaattcaacaactatcagcattaattagtgtttactggtgggctgactgccctattaggtaggtaagattattgtgatcaaactgaagcctagagattaacttgctcaaggttgtagctaccaagttgtagagctgggatttgaacatagacattctcactgagagctcagctcttcaccaagttcagattcagtagcatcactgtctttgtacaacagtatttgtactgccaaggtttcaggatttattttacaattgtgttggaaaccttgcttggggcctcagctcttgctggaattcattgagggtatatgtggacagggctatgtggtgataaattgtgg

SEQ ID NO: 12715 - DNA, 1059 bp, Homo sapiens
gagttaggcatgaatttttcctccctgggaatcagagtaaagccacagacctggctggggtttagtgacagagatttcaggttgagtcatttgctaaaagtcactgttgttggcctgtgggagaaagtttcccaggaggtccagctcaccagagtagggcagctttcacatctctgcagatgaatagagggtttccaggaaaaggtgggagggagaagttcactcacactgaatgactggtcaagctactcaaatcctgaccctgttctctgttcacacagataagatcccgagccaaaattgagaaaattcgagcaagtttatttaacaataatgacttgattggtttgtcaagtttggatggtgaagatgaattgatggaaatgtcaacagaagagattctaaccgtgtctgtagtaaatcagagtctctttgatactcaagggagcccagggttagaagattatttcaatgataagtcaattaaaggtgggttctggatttgtttttaatctgtagactttttgtggagcaattttaggctcacagaaaaaaatctgcattaaaatctcctcccctccccagtatcccctatttttaacatcttgcattaaagagaaatttggcagctactcctgggttgcagattttgaaaacaattcagagagtgttggtgagatggcacaagaggctccattgtttgtcagtgggggctggttatgtgcatctttgtatgatgtgaaaagaaatgttcccccttctcccagctgtcagggcgctgaaggccgtgggggcagcccctgccacaggcctgccgcgttccagctggagaggctaccaggggtggctttgcgccgcctgcaacaggcttgaatgtgggcttgtattcaagtcattttttcctttttgtctagccagccttcccctggttcaagtgcagtgtatttattttgttctgtcctgtgcagctagaacattgctggtaattatttcatcatatgcttgaggacagctcatgcgtcccccttgtaaactgactcctgggaaagaaacagttcc

SEQ ID NO: 12716 - DNA, 1041 bp, Homo sapiens
cagacaggtcaggctctgggaacccctggatccaagcagccccatttgatatatttcgtagacctgggcctctgtgtagattttattttaggcaacagtttcacagctgaaaagaaagcaaaagtatgaagcccattgatctcctgggtccccctccaccatcctggtgcagaggatctgattgccggcatctgttatccaggacatcatatccaggataaccctcccatctggggtttctggatgggttattcattttctgttacttagactctcacagctactggctgctttgattcttgtcaacttctgtttcctttccgtccccagacggcaccatcagctccagctcgatcctcctggcgcagtctttacagcattgcatccattcccagaactgctccgccacggacctcttttaccagggcaactcccagacagtgagagagtggctcaacgtggccatcacccggaccctgcaccagggcgaggagagccttttagagctgacgaaacagatctgctctttcctgcaggtagaagtctaaagctcatgttcctgcagtgtggttaccatttttaactgggagtctcactggcttgctgaaaatgactcccctttcccttccaagtccctattcctctcgatttccttttcctagaagcttttctgctttatctcatctgtagcttgcttccttccagagggctatttagtcgtttggctgatttcctgggccatgtgagatgagaagatgaaatgctgtccctgtgtttagcccgtggctttccttattcagtgtctctttgcagacagcaccagagcagttcccctccgaagagttcccaatttccgaatccaaagtcaacatggacgtgaatttccccggggcagcttttgttgttgtgtcttgtaaagaaagtcaatctggattccgcaaagagtaagttgcctgttctcaagaagatggtgatggggagaggaaagctaaatgaattctggtgaaactggccaaggaaaaaaattcaaatcactgattc

SEQ ID NO: 12717 - DNA, 1068 bp, Homo sapiens
gaaccccagagacagaggttgcggtgagccgagatcatgccatggcactccaacctgggcaacagagcaagacactgtctcaaaaaaaaaaaaaattacatcatctgactctattttgtcagaatgtaatttaactcattagatttttttagaggggctattgactggtggtcactgaggtgaactttcaaatggaaaattccatcaataatactgttaatctcccactgccttctgatgcaaacttctgactctgattgtaagaaaatacattaggatgatatttttgagcaatagaaatgtgtgaaaataaaaattagaaaaatagaattgtccttattataatcattctgttatttctaaggtaatttctctccagtttaataatccctaaatgaaaattgcattggtatttgcatccaaaatacatatgtatgagcttactttttattttcctagaaataaaatacagctatcagacagattccctgcttttaagatattattaacataaaaacaatgaacataaattttacctagcaacagtttgcgctggaaatatagcactattctctttaaattgctaacttatgattacattgaaaatctttattgtatcaataaaaattttccatctggtatggaaaaactaaaacactcagtactaagcagatgtctttgaacttagactaaatcaatggcatgaaactagcatttattgctataatctggttatatatgtataaatatatatatattagtctggttgtttgtgtgtttatgtatatattatcctgttctttttttattttgattgaaatttttttttttcagtaattggcttttggcctttctagtatgtcattaattcacatttatatttaagaattcatttaaaatctctctgattcctggctgggcatggcggctcacgcctgtaatcccaacactttgggaggccaaggcaggcggatcacttgaggtgaggagtttaagaccagcctggccaacatggtgaaaccccacctccactaaaaatacaaaaattagctgggcacagtggtgggt

SEQ ID NO: 12718 - DNA, 1026 bp, Homo sapiens
ttatgtttactccatgaatgttaaaattaactgagtctagagggcccaccaggcagtattccagactaggggctctcaaaatttggcccaccagtcagcagcattggcatcacttgggaacttgttggttcttggaccccattttgcacctattgaatcagaaggtctgaggatggggcgcagcttaacaagtttcccatttgactgatgcatgctaaagtgtgacaagtgctaggtttatctctagtattttgaccttctactagcagtcagcctctactttactttccagagtctagagacatgtgtttatttttgatgcctagagaaatggtgaggagttctctaatgtagaatgtacatacagttacaaatgtctgtggtattcttgcttaaagtcaagtctgttttgcaggcctctgctctgcctcctgaggcaggttttcagagagaaaactttagagaatatatgaaatttaaaatgaaaaaaatacagaaaacactatcgtttttagcccaacatccatatgtactgaacactgcaggccataataccgcataaaattaattagtggatagatgctgctgaagatcttttcttagccttagccctcttccagctctaatatgtctctaactcaaaatgtagcaatcatagaaaatgaagtctcttttttttttttttttgagagggagtctcgctctgtcacacaggctggagtgcagtgatgtgatcttggctcactacaacctctgtctcctagtttcaagagattctcctgcctcagcctccctagtaactgggattacaggcacatgccaccacacccggctaattttgtgtttttagtagagacggggtttctccacgttggccagtctggtctcaaactcctgacctcaagtgattcgccagcctcagcctcccaaagtgctaggattacaggctgaagtctctttactcttgattttcagctttatcagccaatgtcagttttatcagtcaatatactaaattatttgcca

SEQ ID NO: 12719 - DNA, 1030 bp, Homo sapiens
tagatatgagccactgcgccctccggtgctagaatagtacccggcacacagtagaagcttattaaatatttgctaaatgaatgaattaattaattaattaaacatcacaagagactggaagtattggtttccccggggaaggcaactggttggggcaagacttactttccaccattgatcttttcatatgtttttaaagtttaacaatgggctttttagaaaaattaacttttaaaaaaggaatttttttataaaaaggagaacttgtttaatagcattgaattctgctggagaagtcaaggtcagactgaaagaggccttttgaatgtataatatggaggccgttgcagcgctaacaagagctgttttgaggaataataggagtggcagccagatggagttggttgagggtaaggtagggaggataagatggaaaagaatagatctttctctccaggggtttgatgtgaaaacaggagagaaatcggagggggatgatggaatggactgtggggacatggaaatattttaatttcattttttaaaatttaagttattgaatagattttaaaaagtacctgtttctaaattcacaaatgatagggcttagccatagacctcctatgatttgctgggccaaaccaggcaaaaaactttatgaaataatgctttagatgaaatgattcatagagttctagccctgaaattctctactgagttatgattaatcttgctttctaaataatgtagatacttgtcacatagatgtggccaataataattactggaaggaattagatttgctggtaattatgatttcactccaatacttaggagtattgataagtgctcacttcagcagcacagacatcaaaattggaatgatacagaaaaaattagcatggcctgtaagaaaagaaaaaagaagaccagtctgagcaataaagtgagacctcatctctccaaaaaataaaaaaaaattagccaggtgtggtggtgcatgactgtagtcccagctacttagggggct

SEQ ID NO: 12720 - DNA, 1033 bp, Homo sapiens
gtttgtttgtttgtttgtttgtttgttttttgagacagagtctgtctgtcacccagcctggagtgcagtggctagatctcggctcactgcagcctcagactcctgggctcaagtgaacctcccacctcagcctcccaagtagctgggactacaggcacgtgccaccatgcctggctaattttggtatcttttgtagagacgggggtgggaggtttctccatgttgtccaggctggtcttgaactctgggctcattggatcctcctgcctcagtctcccaaagtgttgggattacagatgtgaggtccccacatctgaactcagtctaatttttaagtatggtggtgaaatacataagaaaatgtccgtatttttaaagatgcttagtgaagtattcagaatattcagaaatggaattgcgtgatgtctgggattcaccttaaaatagttgagcaaaaaagaaaaaataggaggctaggttaaacaggtgtggcaatagttgaatctgaatcatgggtacatggaggctcattgtactattctcttttttgcatatgtttgaaatttttcatcattgaaaaactttttaagtgtcactcagccactaatttagcaactttccttaaacgctaacttgggaagctaaacatagatatctggcttactgcctatggtactttcacagaatggaacactgtgaaatatatacggcagctgggcatggtagctcatgcctgtaaccccagcactttgtgttttttttttttttttgagatggagtctcactctgtcacccaggctggagtgcagtggtgtgatctcggctgactgcaacctatacctcccaggttcaagtgattctcccgcctcagcctcctgagtagctgggattacaggcgcccgccaccacactggctaatttttgtatttttagtagagacagagtttcaccgtgttggccaggctggtcttgatctcctgacctcaggtgatccaccgggcttgacctcccaaagtgctgggattacaggagt

SEQ ID NO: 12721 - DNA, 1032 bp, Homo sapiens
attatcataaattcatttactaaagaaatttcagaaagtgttgcttctctaaaactttgtttttaataagtgttagatacaacacatatgcataacagattcaaagtgtttagtaaatactttttcctattaaaaagtaatttgaattgatcccaagaaccttttcatctgttgcatggctgttcatatttattctattgcccattgtatgaacttttatatttttgccatgtaatttgtgtatgttattattagagataaatatccattttattttgaccagaaagcctagtgaattctcatcttgggcataatggcattaatgatgagctgataggattaatcagaatttatatgtggctctaatggagatttcctccctttcatgcccaggtgtgccaggtggtgccaatgccagccaatcacctccccattggcagcaccatgagcactgtgcacctgtcttcagatggcacttacttctattggatctggtctcctgccagcctgaatgagaaaacaccgaagggacattctgtcttcatggacatttttgaacttgtggtaagtttgaactttctcgcttgtatctttgcagaaacatttctgtttgctttctttttatattggtgtgcaaagggcctaagaaccttgcagcgtgtatagtgtgttcagtgtttccttaaaattgatttttctcttagatgtctttgaaggtttctttgtttggagttgtatgacaataagtagagccaagctttctgaatgttaatctgatgactggagataacattatttaatgtgtagacagaagggtatttaagtagaaatgctcacagtctgttggaaatgtggggcaacattacagtagcaagaatgggtctacagatagaaattgggagtctctgagagagataacaacattgtgacatgtcacttaccttttagatattagccaaatgctcactgagagccaagtgtgttctgtctaggtggtgggagtacagagatgggcagggtgggcagggttct

SEQ ID NO: 12722 - DNA, 1024 bp, Homo sapiens
gaagtgcagtgacatgatctcagctcactgtgatcctcccacctcagcctcccgagtagctgggactacaggcacctgccaccatggctggctaattttttgtatctttggtagagacggggtttccccttgttgcccaggctggtctcaaactcctgagctgaagcaatctgccggccttggcctcccagagtgctgggattacaggcatgagccaccctgcccggcctggagttgcttttctaggaattttatacattcttctacccattgacccgtatgatcactggcatctgtttgtgagaaagaagtttcactacctttgttttccagtagactaattgcctagagaacagttaggaccacagcctgacagattagtgtcagtattctgtctgtcttccgtagaattttttccttggttgggatcttctttcttttagccaaacatctgtgggagaattcttcttggataattatgaagttcttagttataagtcttcttgccctgtttttctctgtatagtttcaaagttgaccttcaaatgattgaatctcaagggtttttttaaggcaaaatggcaccagtgtttattgtaagtttctttgctctgagcaagctgtcatagcctagttttagatcccctaaaactgtggtttgtgaatcctgacatgtgcttaattctagagtcattgtgtggtactgaaacaagtttccttgtaaaggctttatattggattgatttattttctgcatatgcagagacaatttcaagtccaagatctgttatcactgtgcaaattccatttgagaaaatgtgcttttagacagtactatctttagacagatttaggatgttaggaataattatcaactctttagtttcaaacagtttaagttattaattgttggttcataaaactcacatttttattgtgtacccaaattcagcctataccaaaaatagttattgaacttacttcctgtgctggacattctaaatttcattcagcagaaatgttg

SEQ ID NO: 12723 - DNA, 1024 bp, Homo sapiens
aaattagccgagtgtggtggtgcaggcctgtggttccagctacttgagaggctcaggctgcagtgagccatgatcgttccactgcactccagcagcctgggtgacagagcaaggctgctggagtcaacctgtctcaaaagaaaaaaaaaaaaacggcaacaaaacacatatgttatgtgtgattaaaaaaaatacatgaaggctgtgagttactttggcagtcactcccttaattagggtaacgttagcattatcaccaaagtacagttagtaacacttctgattaaggatgacagggatattcccttttccttaaatagctttccacttttttaaagagaaaaatattaatttctaatgacattttggtcaagagcagtggttttatgtgaggatctgagacaaatcatttaatattcataagtaccagaatagatatgccatagctgacttacaaaaacccaaaggtatgatgtctttttataaaatgattttaggccatgaccttcaaactttagaattctgaaaaaacagtggcatagcaaacagttctgagttttcataaggggcccctgaaatggataacgctgagtagcctaatggatttctgaaagcatagtgtgctttagatactgctaaatcaataaacacaacagtcatttaagtgtgtatgttatataatatttggttaattatattataactcaaattctttcagtgcacttgtcttttaaattgaatgctaaatataactggagtacttgtaaaaatagaatggtcagaaaaatgcagagtatattatgtcatttttctaagctatattaagttaatatttggagttagcaacagattttgtcatacacatcattttatgtaccatgaaatgtcatatttcagaagtactcatgtttaataataaaaataaatagccctgttttatgttactgagttgttcatcatttgagttcaataaaagactatattgaatttttttagtagttgcttcatataacataagtagatg

SEQ ID NO: 12724 - DNA, 1030 bp, Homo sapiens
cttagaattttacgccggtcgcagtggctcatgcctgtaatcccagcaatttgggagaccaagacgggcgaatcacaaggtcaggagattgagaccatcctggctaacacagtgaaaccccgtctctactaaaaaaaaaaatacaaaaaattagccgggcgtggtggcgggcgcttgtagtcccagctactcgggaggctgaggcaggagaatggtgtgaacccgggaggcggagcttgcagtgagctgagatcgcgtcactgcactccagcctgggcaacatagcgagactccgtcaaaaaaagaaaaaaagagtcttagaattttagagcagaagagactttagagataataatgtccctcattttagaaagaagttctctgagatcaggagatctcagtgatcagaagatgaggttatgacttagtcactatagcatagctagttgtggcagggcaatgactagaccctagcttttctacctttggattccagtgttctgttcaccctgtaagcgctgctcaaagtcaatctaaagaaagaatccctcctaagaagtagatcaacatgaatttagtattttaatttaagcagatccagagtatttgaattaaaatttttcttcccagtaaattctttttctttctttctttctttcttttttgagaccgagttttattcttgttacccaggctggagtgcagtgatgcgatctcggctcactgcaacctccacctcacgggttcaagcaattcttctacctcagccttccagttagctgggattacaggcatgtgccaccatgcccagctaattttgtatttttagtagacactgggtttcaccatgttggccaggctggtctcgaactcctaacctcaaataatctgctttccttagcctcccaaagtgccgagattacaggcgtgagccaccgcacccggcctcttcccagtaaatttctaaacagatttttttttaaagcaataaataatgtttaatcaactaattcattcaacaagtattggt

SEQ ID NO: 12725 - DNA, 1063 bp, Homo sapiens
tccatttttaaatgcttgcagtatacacgtttgtttgctactgcctacatggtagacacttattgccacaagtgtctgaggcccatttcattgccttgtgtgcaagtgggttagacaagtggtcttctttgtgtagcaacataacaagtaatggtcacctaaattgcaggatgatgattcttcccccttttccttgctaaattaatttttcccccttaggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagaggtaagtttctacttgtcatctcctgtgttagcactggcccttctacctgggagtgaaaagaaacaggttgcacaaaaagaagaaaaatgaaaggttaaataatgaggaatgctgggagatacttagtattccagattcttctaaattgagtagttcttttggcagtctgggagctcaacttagaatcctaaagtttggtggaattgtgtgggaattaactgctaccatcgtattgggaatgtgcccttacttatccttgatgtgtcctaaagtatacaaaagcttaagagctacttttattacattaaaaaatgggttgtgtttcacagcattccaaggaaaggattgtcaaaattgtctttaatgttttctaaatattcttggggattagtacttgtgagacaggactccttagttgacctacaagtaatttggtatgtgcctgttttaaaatgtttgattttctctttatttagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgac

SEQ ID NO: 12726 - DNA, 1051 bp, Homo sapiens
aatcttgctggccccagatggaggctgcaaaacaggtgaccccagggccaaatccagccctctagcttgtttgcctgcatttaaaaattgggggattttatcttaaaatctggattttggcttctcaagatctgggccacattcctgaaggcaaaactggctggagcagagaaggggcaccccctatggggtgcctgtggcctaaatcatcacagtcccctccattgcctgttgggtgccccttccctcgtttatgtgacctggctggtccccactggcatttgaattttccccatctgccccagaatgtccttttctttcttgtcctgctctggctgaggaaacgcccaggcttgtccaacgtcttctaacttctgctacccagatttcttcctgttgtctaactttagtatctcatgctgtctgtttcctatcatctaggctcctccccctcagcccaggggcttcgcctggaggtgggggtaggactctggtgcagatgcatggctgggcatggtgttgtgtgctgtaacagtgtcgggatgaaactccatcgggatgaaacagcctccttgccacattccctgtgaatttctcccccggtttgtgggaggatgcagacatggagggaaggagataggaggagagatgattgatagagagtgactcagagctgaaaagggccacccactagggccgtctggttcatcacagccctccattctccatccattctctacggagcggggaagccttgcctttcaggccagggcaaatccagggacttgctttcacaagcgttgtggcatctttatttatttatttatttatttttattttattttattttgagacgtagtctgactgtcacccagacccgagtacagtggcatgatctcagctcactgcaacctctgcctccagggctcaagtgattctcctgcctcagcctcccgagtagctgggattacaggcacctgccaccatgcttggctaatttttgtatttgttgtggcttcttaaaagagtgattcccacacatcagtcattc

SEQ ID NO: 12727 - DNA, 1050 bp, Homo sapiens
ccagggctggcgattataaggaaaccaagagtgtctaggaggtcacaaggaaggagaggaagccggagtccgagccccgggccgccagcccccaccaccccagcccaccctgtccccctctcccttttcatgattaacaatgatgggtagagctgcaaggccttgaggctctcaggtggcaggcaggtgggcacctcccgcaccttctgcacgctcaccatggggcaggctctgccgtctctctctcacccttgctccgtccgctcattcccctttctgggatatttcacaagcacttgctaggcaccaggcagtgtgctaaggccagggacacagcagtgagtgagacaacatcccacacaaagaaaggcctgcggcagtgtgggtaataaaaagtgccagggggtggggtggcattggagctcagaggtagagggagagggagatctgggtgctgccggtgcaaaggtcttgagcagggggaggtgggccagctccagtgatgcctccagaggaacttggggctttcttagggagtggtggatctgacgcacatgttttagagggatcccttggtgggaggggggtctctagtgaggggctgagaggtacttggattggggtgcagccgtggagatgatgagaaacgggttcaatgtttgaattgatttgggagggacgagattgaagaaacaggctcagagaggtgaaatcgctcacccaggaacacgcagagggaaaccaagtcttcatctctgggccaggcactgtgctagccctggggaggtctcagtagaaaaggctaggccgctgctgtgagctccagggagctcacagcctgcggataaatggaggtaaagggcctcagggtggtttatttggggaggtgtttgagccatggaaagggaggggatttggacagcctctttacactgcctctgtacaaatcaagccttatctgtgagcaaggctgctcatcgacaagtggttagactagcagagggactgacagaggaagccagcctggattccaacctcgctcttttcctg

SEQ ID NO: 12728 - DNA, 1063 bp, Homo sapiens
cggccatgttacttgcccaagatcgcagagatcctaagtgtcggatttggcattcacacccagcttgttaactcccagccttgctcacttccctaccctgttttggtggagtgggaggtttccctgggagagcagggagacaggccaggtagcactgcattggggatggccttgaacctgggctgagagtgtccttgctcgccacctggtccatctgcatggttaggcccccgcatgttcctcctcgggttattgatgaagtgtcacaagacctttggaaaccaactggggtctttctttgcaactggagagaaagacacaatggagattgggtttggtgagaaaccagccccacccttagcggggctccttaagtccctggtggccccggagtctctcaaatgaaggtcagcagccacccaagcacggatgtgtccccctgacgtctgcagctgttttgggtcctatcacctggtgggagacggccttcctctcctttcacgttggtcccgcaccccacgcacactccttgaatccatcacctgaatattctgatggaggcgtagtggagtcaatgttgggcaggagctgctgaagctccgaataacttggaccctctccccccaccactccaggccagccgtgacattggctcggaagaaacaagttcccagaaagcagaccacctccaagatcctggtgcggaacatccccttccaggcccacagccgggagatccgagagctcttcaggtgagaacttcaggtttagtccaggggactggcgtgtgggcggggagcctgcccgagtctcagggaagatggcctttgggtcctggatggttccgttgcaggccggcacagtggtctttcaaaggtcatcttttggctgcttttgatttatctcccttaatctcagatgtggctccccagagcactgtgcaggaaaaaagtcaaaacagccaggcttccccctctccgaggcagatggagaaagggcaggcaggcttccctgtccccatccacaacgtgcaagaggggcaggggccccagtggctaaaacc

SEQ ID NO: 12729 - DNA, 1126 bp, Homo sapiens
ataaggctggcagtccagctgtctctgactagatccagcctcttctcctgcttttaaataaaatttcacagcccaagcaaatgccttttcctaatgaaaccccatcttgaataaatgcaactgaagcctccttcctttctccctaaccctctgccacactcttcagcccagttagagggtcaaggacaaagcttgggtctatgtggctgccctggggcaagcagatttcagtgaattagcgttgtccctgggcagcaggcagggtgtgaggtatgtgtgtgccgctttggaaagggtaagggaaacaaagaggggaaatgtatgttacattctgtaacctgggtgtgggcttctgccacagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaaggtaaaccatgtcacctttgtgatcactggactccagtccctcgtggcctggaagagttgaagggggatggggcaccaaccagggcacttgccctttaaaagctagaagccttctaaacatccttaaacagaagccagagttcaaaaagggctatcaggtgtgtctccccttccccgctaaggcagtagaaggagagcacagaggcctttctcccagatccttatttggctggtggggaggggaggtgggtgtctgtttgcatactacctcttggcaagcagctttgaaaacttgcttgaagcgcttctctcttttctctctgtctctgtttctttctcctcccattctctccaaccaacagaggctccaactgctgacttttcactgtctttgaactctaggttacaatgtgttggactgggtgggggggaagcaagggactctgccacctggaaccgagaaggtggcctagaaaacatccagctataaagcaacaattgacctgggagaggaggtggagcactggggatctgcggtgggggtagagctgggggaggtgggtgaggagtggacaagatggctcaaatcccccctcagttacctgtgt

SEQ ID NO: 12730 - DNA, 1068 bp, Homo sapiens
tcactttgctttgtaggggttgttactcaatgcagacacacctacttggtctgtttgtgtgccatctctcctactagaatgcaggttccatacagcaggaactgtattcccagcatgtagaccggggccttccatatttggaaaaaggcctgcaacttttaaaaacgttttattttgaaataattttgcacttacagaaaagttacaaaggcagcacagagattcctgtatacccttcactcgtctccccctggtgttgacatcttgcatcgtcacaggacaagaatgaggactaagaaatggacatttgtgcatcaccgtaaactcgacctcagcctttgctcagattgcacgttttcccatgaggtcgttttcctgatccagggtccaatctgggaccccacatggcgttcactcatcacgtctccttcgtctcctctgatctgtgaccaatcctccgtctttccttattgctttgtgactttgacagaactgttcttgtttgagctctcgtttgggtgaacagcccaaaaccgactggtcagttattttgtagttatttggtctctcaacttgggttagtctgatattttctagtggtgaaattgtggttatgcatcttgggacaagaacaccatggaagtgacaacgtccttcccaatgcattagtgttgggagggttcgagatgtcatcgtatcatcttacagatgacattaaccttgaacccttggttaaggctgcgtcttctggatttctccaccgaaaagttatttccctcgcaaatattttggaatgaataaattctaggaaataccgcagaagctcagatacatatttgttatgtcctagattttccaccaggggacgatgttcactgacaaatcttaatgggcaaaagtcaagggatttgaaagcagggggccaaggccctggggggctggtctgagtccactctcccagggcagccctcgtttaggtgaagagccccaggggacagattcccggttgggcataggtgccaggtgtaggggtggctgagaagagcaatctggcttggcaaatttata

SEQ ID NO: 12731 - DNA, 1029 bp, Homo sapiens
aaatttagcagcacaaaatggtatagggtgagaaagtaagtcttctatatccactgcctggccacccagtttttcttctagtgttaatccctattaccagttcatttccatcctttcagagattagtctgtgcatatgtacacaaatacatatgtatatattccctttcttatgcagatagtatatccagtggtatacataactctgcccattgttccattcctttatttttacttaacagttatgacattcagtccaagtatatgcatatatgactgtcaactgaatataaagaagatactttatattcactctaaatacttggtctaccttatttactaatttcctaatatatttgttttgttatctatattctatgagtagctcttcttaacagtagtttttcacaaagaaaaatgatcttgctttggccattagtgggcgtgagtaaaataactttccgaagtcctgccgaggaactcagtattattatgaagataagacataagcatttaaagccattagaggtaagacattgttataattagtatcttgatctgttaaatagctgataagaagtaaaggtgaaaacaggtagatactgatatgggctctagtaaagaagagatatttatgaagttaaagtgggctttgacaagcctgtaaggtttggatgccttggggtggaatcaagaggagggaagcagcagtaagacagacacatgtcaccgtggtgtctcaaggaaagactgcactgactggagaggaaagtgcttgcttagcagccgtggaagatatgaagaggttgccctaaaaatatgactcctgagacccagagagtagcagagacattattttatgtccatttgtgctctgccctttgggcccaagatgtataaaagatggtgaattgctttcccaaattggcagtaatgactgaaaaattgggattgttgcttgttagaattatgtgattccagggctacagataaacatggtcttgatacttaaagattaaaaaaatagctt

SEQ ID NO: 12732 - DNA, 1047 bp, Homo sapiens
taaattctttttcttttgctctaggatacatatcatgagattttatattcttagacaatttcaaagtagatgtggtttgtatgcattttacttttaggaggggcaggtgaacttttattgtaaaggaccagataattagtatttttggctttgtagggtatatgggctctggcaaatctagtcaggtctcacattgtactgagaaagcagccatagatgatatgtaagcaaagaggcataggttgttccaataaagctttatttacaagaaatgggtggcaggatgtaatttgccttggggttataatttgctgaactctggtcttaagagggatattagtgttcagagaagttaagtcataagctgagaaccacgcatctacaaagtctaggatcttggatttaaattcaggcctttccaggttcataaccactattttttcagttatttattctgctttcactaataaagttaatgtttataattatatgtagaaatgattatgtagaaattatatgtagaaattaaattatatgtagaaatgattatgaattataaagtgttaaaataatttatctctttacaaaattgcatagagactggcatttagaattacccaagaaatgattggatgaatgtttgagtctttatcataataattcatatgcacagcagagcattttaattgtttttcttccttcctttttttttttttttttttgagacagagtcttactctgtcgcccaggctggagtgcagtggtgtgatctcagctcagcaacctctgactcccgggttcaagcaattcttgtgcctcagcctcccgagtagctgggattacagttaggtgccaccatgcccggctaatgttttgtatttttagtagagaccatcttggccaggctggtcttgagctgctgaccgtaagtgatctacacgcctcggcctcccaaagtgttgggattacaggcgtgagccacagtgcccggccaattattttattaatttactaaagtatgtatacctaaaaaatgttttcctttca

SEQ ID NO: 12733 - DNA, 1046 bp, Homo sapiens
aacctaacatctggttattgtgtaatggtagctgtttgctattagtagtgaaactggtggtagtaatatttagaaaaaaataaggagaattttttatgatgttggtaatttcttgtactagagaaagcttgccaatcaaatatttgtgaatcagtttttatatacacaatttgcattaaataaggtaggtgtttctactataaatctttctacataatggcaatataagaaatgtcatatcgtatactgattttacccctaaaataatgacatcagctgttttctaattttaaagaagtagtcttaccaaatgtttgaaatcaccatgattttggtatgaatttgaaaatatggtgtttactagcattgtggttctgttgctatccttttatggagtcaaaggaaaaaattttgaaaatgcataatgtatattataacaatatgactatttgttgtggagtgttaaatgatgttataaaaataaagcttttaagtatggttcgtagaaattattagatctgtctctgagaacctgttaagtgtggcttgcatgcttcatttaggattttattaacagttgtataagattgaagtataatagcttgatatttatggttaaagaatatcatggggcgggcacagtagctcacgcctgtaatcctagcactttgggaggccgagacaggcagatcacttgaggtcgggagtttgagaccagcctgaccaacatggagaaactccgtctctactaaaaatacaaaattagctgggcgtggtggtgcaagtctgtaatcccagctagtcaggagctgaggcaggagaatcgcttgaacccgggaggcggaggttgcagtgagctgagatcccactgttgcattcaagcctgggcaacaagaatgagactcttgtctcaaaaaaaaaaaaaaaagaattatcgtggaaaactgctaaattaaaatactacattttacggaaactgtggagctgcctccttgatagaatgttaggtctgtttttgttgtcttctgcctatgtctcttgacttg

SEQ ID NO: 12734 - DNA, 1048 bp, Homo sapiens
tttttttttttttttttttttgagacagagttccgctctgtcacccaggctggagtgcacaggtgcgatgtcagctcactgcaatgtcctccaggttcaagcaattctcctgcctcagcctcccaagtagctgggatcacaggcatgcatcaccaacacctggctaattttgtatttttagtagagacgggatttcaccatgttggccaggctagtctcgaactcttgacctcacgtgatccacctgccttggcctcccaaagtgctgggattacaggcatcagccactgcgcctgacctataccttgttttttaatatactggagaggttgagagaataccattattgtaattcctttttaaattcctgctaaataactgaaactaagctcaaaacaaatctctccttgttcaatagaccgttcatccggaaatgtagatgatcttccattaactatttgaccttgtgggacctagtgaatcctttgggacttcagttttagcatttatttctaagttgtcttttagctttctgattctctgattctctaagtgaagtgaagttggtgaagtctggacatgtcctatccatgtatgtctctgtatatatccatatcttttattctttttttctctaccactcagagcatgttaccttcattgtatttagttctgctgtaagcagaaagtaactcttgtattcaccactgcaagagatttgatatcattcttcccaagagttggaaaattttaaaagaacatgtttgtagagagggaaggattatgttaacttgagtaacgatactcataatcagatcaagaaatggaaggagaaattgtaggtcccaaatgggagttgaggtgttaatttcagttttttattacagaggtgaccacctattcacctttgcttaaggtgtcttagccaaaagccactttccctgttggaaacaaagtcagttgaagcttcagagcatgaatgaataaaggttcaaagtttaaccttttggtagcatgagggaagtactgttcagtttactcatatctc

SEQ ID NO: 12735 - DNA, 1031 bp, Homo sapiens
tttgtcactgagatcctcatcacgtaaaaagtattgcctatcacatgcaaagccaaaaaataaaaaataaaaatttaaaaagccagcattaaaacttgcaagatgggctgggcatgatggctcacacctataatcccagcactttgggaggctgaggcgggtggatcacttgaggccaggaattcgagatcagcctggccaacatggtgagaccccgtctctattaaaagtacaaaaattagccagacatggtggtgcacgcccataatcccagctacctgggagattgagacaggagaatcacttgaacctggggggtggcggctgcagtgagccaagattgcaccactgccctccagcctaggcaacagagactctgtctcaaaaaaaaaaaacttgaaagatgggtgttagtggcttggatgaatatctctgaagttctcttaagaaatgctgtattcctaacattcttgatgatgcaagaattgaaattatgcagaagtgtgattttatttgaagtaattctgaagcgtaagatgttttagaaatacatcaatcaatttattttgcttacttttgtttacattttcttttttacgtgggcataagaatctgtgcccagtgtcccagagttctttcggaaagtataacgtaaaaattttaagtgataaaacattttgatagtttaattggtggtgtttttatttttggtgatatatctcatctggtgtattgcttcagcgacttactaatttgttactgatactataaaagtaattcttgatgtaattattttaggtgcctaatggataagaacttcgttaggattgggaaatggtttgtccgaccctacgaaaaggatgaaaagccagtcaacaaaaggtgagcctttagaatgctcttggctttttggtttctttggccttgtgggtgggtgaacagcttattgatttatttatttcctaataatgttagtagtttagatatactcaaatagatcctggatcacagtgttcttaaatactatatta

SEQ ID NO: 12736 - DNA, 1029 bp, Homo sapiens
cagtgtttgacgtgactccatacctgttacgtgccgtattgcttttattctcagcattatcaattttaagatataccttcaatgtaacaatggcttttggagactaaagaagcattatcacgttaaatagactgtaatttacaaggtacatttggacttgagaaataaggaaagaattgggaaaatgtgacagcatgagagttggtatatgctaattattaaatgtcctggctctgtgatcagatatacctgggcttgtgtgcagctctgctgtttattatctggatgacattctcactgtgcctcagcttcttcatctacaaaaattgccattgtaacactcatcttttattactgctacaagagttaaataaggtactgtgcctggtaatcaaccaggtagtggtggtatagtgattctggtagcagttattgataatattattgcagaaacttggtattaaacactagagttctagtggaaatatgtttatatgtactctaataaaaatataattaagtctgttagctggtgaataaactgtggagatgctttttcagttttgcttcttgaatacttcctccttgggtgggtgtgccatatttcctattttctaaatttaatggagtcacagtccttacccctaaaaagcatttttttttaaacttataagcttaggaaaagagatttggttacgctgaaaatgattttcttcattgtgaacaatggaagatcgcagtagaaatttattttctaagtaaaaccagtggagcccagtgactttttggtacattggttctccgaattgactgcccaaaaggagttccattgtggtcatcagaaactattaccattcactaacccatctaacctgtaatgagttgggtgagggcttgaattgtttccatcctctttgatggtgtggaaattacagaggcaaaagccatgtgcagaattgcctcaatatggaataaagaattgctatataactcttttgctggtaggtaggaccctgtatagaagaatta

SEQ ID NO: 12737 - DNA, 1051 bp, Homo sapiens
attatgataacaatagcattatatttgtctattcctatctttcaatgtgttgtgatattgtaatagaggtgatgcaatagaggtgattatcaaagggcaaatgaggccggacacatggctcacacctgtagtcccagcactttgggaggccgagacaggtggatcacctgaggtcaggagtttgagaccaccctgaccaacatgatgaaactctgactctactaaaaatgcaaaattagacaggtgtggttgcacatgcctgtaatcccagctacttgggagactgaggcaggagaatcacttgaacctgggaggcggaggttgcagtgagccaagaccgtgccattgcactccagtctgggcgacaagagtgaaactccgtctcaaaaaaaaaaaaaaaaaaaaaaaaaaaagagcaatgtccttggatgtggtggtgaagggatttcagaataacatactcactggagcatggtgggatgtaccgccctagttgaagaaatcgtgatgtaacattgacagtcgttgggtataatgtgataacaggagcaagaaatgagtaatcaataaataccaattttattgaaataacagtgtttatttctctaaagaaagtaggagaatgagtctttagacttaaggagcatatactttaatgaaagagacagtacagatatcgtagaacaagtgactgaaagcacatgtctatttgtaaatgtctagaaagaaacattcaccctgagactaatcagtctgtgtagctatttagtgaatatttttcagtcaagggaaggaattaagactttaaatttaaaaaacaaaattgatctgggagcagcggcttgtgcctctaagcccagctactcaggaggctgagtcaggaggattgcttgaggccaggagtttgagaccaggctgggcaacaaagcgagacccccatctctaaataaaaataaaagtaaattaaaactaaagaaataaaaaataaagattagctgattgtggtgacatgtgcacttgtagtcccagctatttgtggggccaaggcagg

SEQ ID NO: 12738 - DNA, 1047 bp, Homo sapiens
ttaaactatggaaagaagaattaatatactcaagcaccagttgacaaactattgatagcctatgtttcaaaagataatttgtaagttaattatttggaaaatatatatattttttaacctatgaaaaatctattctgaatggtgggtagattctaaggcctgcctatcaaactgatttagtctgtaatgcttgaccagtgttggtttgggtcctgggttttgtaactagaaggggtagattggttaggacttcactttataaacatttaaaatcctcagaatctgtcttggaaggctttcccacattctagtgcagtttgttagaattatgcaatatgagtgggaaagaatctcaaagaaagtaaagataactataaaagaagcaacagagccagtgaagtgttagcattgcccagtggctcaggctttttgggtttttggtttgatttattctttcaacttttctggtaatttgcaaattctatcctctttgcaaactctttgtatttatttgtaataccttttcaagtgagctctctgtagaacttcctaagttataatggctaaaactacaactggataaaactgcagctgtcctggttgagactggagatggaaagggccagagggactcactggggctcttgcacaggactctagtactccaaggaccacaggaagaaaccactgcaccttgtgttatgggagccgcccaggcctgccctactccagactgtgccctatccaaaacaacggtgttacttaactttgcaaccaaaatgccattctagccagatttcgaaagaacataggattgaactcattcacaccactgcgactgtaaataactgacctttatttcctaaaggacttgcagttttcatattgacttgttaatgcaaaggaatcttgtagagttgaaacaccaacatgaagtaaaaatattggcagtgttggtgtgtttaggtcatttataaattttttgcttatgagttggaaacttcttggcttaagttttggataatgacaacttttcctggatatatt

SEQ ID NO: 12739 - DNA, 1035 bp, Homo sapiens
tttttttttaaatggcttagatacttgttcagagcttatattgtacaataatccacatatattcaacacctacaggctgttagaggactgcatgcagctacttactgaatgccagtattgcttgcattgtctgttgtagaacttctgtagtcactaaattatcagtccccatacagtacatcacaggaagttggcagatacaatgatccatctgttatcacacccatcaagtgcattggcttgaagggaaaaggctgcagattggagctcagtgtgtgagagaagtgagattccaagatgcttatcattctttccagaaagtcctttttggccttttgtcaagcttgacttgctcatttctaaaacagcctttcagtttatgataccgttaccttttcattaatatttttggaaaaactagacatgttgtcagagatgcttatttttcttgaatgaggttttagggtatcagcttttctttcccctcctagcgggtggctgtggggaattcttggtcagattgtcatagaaaatgagcagtggaaaattgaagctgcacaatctggagagttttatttttaaaatagtcattcttaacctgaactaaagtaaagcaagtataaaacatttttatgttattccagtgtggccaagattttttttcttaaatttatacaagtatgatcactttcaaaggagagtatgattttcatagttaatcaaaaatgtttaggcagttttttgtgagtttaagaaacctgttggtttcctggaaagtcatgaatgtttatgatatcaagggtctgttatagagcctctgagatcttttagacaaaagcattgatgctgttcttaatggcactttgaagttttggtgactactcttgaggtaaatggatatgtgctgatcatttcattctttctttctttctttctttcttttttttttttttgagactgagtctcactctgttgcccaggctggagtgccgtggcacgatctcggctcactacaacctccacctccctgtttca

SEQ ID NO: 12740 - DNA, 1042 bp, Homo sapiens
gtgtgaaattatacttaagctatagtggaaaactagtgtcctcttccttggcaactgtgaccaagtgtgggagataagcctgaaggctttaactgaatagccatctgtttaaagcgtctggttttaaatgtagcagctcatgtcacatcagtcagaaaaggctcctgcagctgcagcagcctctgtttcagttaaataaataaacaaaatgtgtttcttttttgtattttgttattatgttcctaagtctccttttttgttgttggtttttttctttcatacttacaagattttggttgaggaagttgaattgttgataggtggggtcacctcatgagttaattatttgagattgtttaaatacatttttatatctgtctctgaaataacaaaagtgaagctttgtggtaagaaactattcagtttttttatttgatatgcactttcatgtgtcttggtgcatagtgctgatgggaaaagaatgaaatatatgatgaaatactgtgcttgaagagcagcaagcattgaacccagtcatagctcgtgaacttgtgaatggacctgtttctttttaagtatgtgaaaatttctgggaaatattctgatgaattttacataggtcatctcttactattgaacttaaaatatttccctttttctcccaagaagaacattttcagttttacttcttttgtcctgtgctgccttcagtgaatgaagaaaattactgctttattcatttgatattatggcattgaagtataccattattgtgaatttgatttctctagtataggcttagcaatttgaagatattactgggagattggcttatattaggaaatagtctcctttataaaaaaattcaaaaacgcaatttcagcttaattcatctctaagcagttattatgtatgatatgtgtacttctctatttagaagggctttactatgaatttttgtaaatacccttttcaatacacttaaaaattcttcaccttggccaggcacagtgtaatcccagcactttgggaggccgaggca

SEQ ID NO: 12741 - DNA, 1031 bp, Homo sapiens
ggttaagtttttgagtttttatttttattgattgatagacacagggtcttgctctgtaacccagactagagtgcagtggcatgatcatagctcattgcagccttggactcttggattcaaacagtcctcctgcctcagcctcccaagtagttgggactacagtgctatcacactgggctaatttttacttttttgtagggatgggcatcttgttatgttgcccaggctggtctcaaactcctggcctcaaggtgtcctctcgccttggcctcccaaagctcagatttaacatacatgtttgcactgggttatcctggcttttccattcttctgtttctcctttatggtgtaatatgagaatatttacccagtcgacctttcatgtggatagtcctttgtgctcctgattccttataaattaaggcaacttatgtgaatttctcgttttgttatccagcaaatgcatgctctgtaaggcagttgaggaaaggaattgcagtatgttaaacatctcggattgaaatgcttttaccactgttgcaaggaaaggagacaagtttaatagaactataaaacaaaaatgtataattatttttcattataacacatttttcttatgctataaagtgcccgttttattgatttatatactgtcatcttaaaataagacagtcctgtgccttattaaaatacagtaagtcctatctatgtccttacctttgtctctggatcactgcaacatagtttcttgagtttgtctctgtctgtaatggttttatatatattgatacatgtgatagtttcatttgaagaaaacctacagtgccatacctggtcaagttatatttagccattgaagtttttattttaaagtagtaatgtcattttttaaacatgagaaaggagtttttgattgaaaatattttattcttaaacctatactttatgtcttttttccatgagtgatagtttttttagattgatgatatagaatcaccaatttggcagactttttttttttttttcctgag

SEQ ID NO: 12742 - DNA, 1061 bp, Homo sapiens
aaaaaaccaaagcacgagaagcttaaggaacttgtccaagttcacacaggttaagtggtagatctgggattcctttccaggtagtctagctttctttctgttacacaggtagtgagtccttatccagttttattcctgatccactttttttctcctctcactccacttgatttttcagtggtctcttccactcccatagcttccctggttgcctgtctgggatcgagacttttgataccatctctagccagactgttttcttgagctccattctgatattttcgatattatgttggactcttccatatgaatttttcaccatctcatatttgacatgattttgttaatcatctgcatttattaatgaccctcctattattattatgcattactgtgtttcctgtcaaggtttaacggcatcatttctcagttatttacccatgtttgaattcctccttctttcttcacttgtaactgtagttacttaaagttctgccagttctccttctctaatgtttagtatgctgctctgtttccttctcatacctgcttttctgggtcctcatcaaggacgtcctgacttgtctccttgtttttagccttttctgtctctaatctgcatctttcaggtaacctgaagagttaatgtttcttaaaagttaaggtctcaatattcctgggttcagaaactgaactccattttatttagaaaagtagaaacttctcagcatgccgtttaaatttttctctttgttgcatattcagatacttcagtgtcttagtttttgttgttacctctacctacaatattcttttttcgtcagaattaagctttttaagaatgtttttagggtcagggaagggggtgtgggtatgtttcccctgtggagtgattatacctttataaaaacctcacataataggggactcaggaaatatttgttaatatgtattgaaattatttcaaatggaatttagtcatgacccaaatcttgcttgagataaatcttaacacttttggcgggaaggtgctggttttcttggggtaaattatataaact

SEQ ID NO: 12743 - DNA, 1091 bp, Homo sapiens
actgtactgtttatttggccacagcatggtttgtgtaaaactcaagttttggcacacatacaatctgcagagtagctttaaccactgtgaatttatttcccagtattttagactcaggtaaggagttgttataaactgctgtcagttctggactcccgttgttttcaaatttctctctgatccttttaaaatgtggctttggtacatttaaatcagcttttctcgaagcaatttttggtcatttttttttcaaatttgtaaactcttaagaaatacatgcaaaaatacattcattctttcttttgattaacattcactgcctgtctgctgtgtggttactaaaacagtctttcacctcaagtagcttaaaatctcaagaggggagataagctgcatacctttgtgtagcacatgaagagcagtgtgttagcagggtgatcaaagtgctctggaagtgtcctgcaggaacttcaggtgggaggtgggagggcgtccttgaattgtggctaggattttggggtggggagagtaaacatgtaatatatgttagagtccattagtttccaaattgtgttctttgggtctccaagtttatcacccttctactttttcacttgttttgtgttggtattgatacagtggagagtgagaaattgacatgtcagagagaaagagagagtgagagagtagaattgctggagcagtgttcttcagtaagctgtagcaaatgggaaacagtacagaagtgtagggcactggcaacaggtaacagcaaggatatatcttctctagtgtaagagaaaagagagagtatggagtacagaggctgataggtgttagatgtggaatgtggcatttctctttcagtggtttctgtcattgaaaaaggaaggaaggtcatcagttgagaccaaagataggagaagtgtcagagatttgtggggaatgcctaagaaaatggttagttttggaggagagtggctaagggaagggcttagggaagtgtgatttgatttctgcacgatgtcaagagcccacttgagttttggttattaaagtaagaccagtttgaatgggtttgggtttttttc

SEQ ID NO: 12744 - DNA, 1672 bp, Homo sapiens
gtgtgtcaggctttgtttaaagcactttttatgtatgaactcattttatcattactgtgaggtagggactatactatgatttcctgctgattgacaggaaactgaagcatggagaggtcaagtagtctctcaaaccaaagaacacgtaagtgagagaggaggggctctggctccatagtccttggtcttaaccactattttgtattgacttccatagagaaaatagcccacattatagctatgataaaatgcaaaatttcactttataggtaatagcctggaatcggtgagctggagtcattaaggcagttcggcaaaaacaaaaaacatgggggcaagtgtgggtaggaaagtgctagctgcctgagtacaaagcattgggtattaataaacatgctgtgtgcggcatagcaggaagcagctgtttggagttgaaggtttgtttgggagagcagtagaaaagatgggtttgattagttatagaaagaattttgaatggaaaagtgtggacttgggaacacattttctaggttgctgttgagaggaacaacagtggtacattaaatatggacttttagaactagaggaaattataaaagttattattggatctgtgctcttcagtgtttctgtgtctaccctgttttgtgttttaggttttgaccttttgctccagcttgtccagggacagagtggtgtagtgaaacaaaagcagtaaaccaagtatcacaaagcttggactttagtaccagcttttgcactttcctcactgtaaagatgttgtatgggttacttaaccagttggggtttaatttccttggctgtatagtggacttagtgtcacatgcctacctcaggatttctgtgacaattaaatatgatattttaaggcttctaacttactggatctaaataaattattcctggaaaaaaaaagtttgctgtgtaataaagcacctaaacaggaatgaaaaagcaggtatagaacttcaggtgttttgtcaccctccctcccccagtggtgtgtgtaggaaaactttgcttctttctgtaaatctgatgtctaatctcttctgactttacgttcaatcagttgattattttcattcagcagatgtgatcggtttgcagggttctcagtcaagtaggatagagaaaacatgaagatacacaactaaataaaatgctatatataaaatgatgttttatgcaataattatagctatgctatgttaattcagcaattattgctgctttggggaaatgagaaggctttgaggaggaggtagtatttcaaaatgatgaggtttgaaagaagtatatgatgaaatgcagaaacgaagaggtagcgtatttgtttcaggagaagggaatagaatgaataaaagcatagagaaagaaaagcatatgatgggctgggcccgtggctcacgcctgtaatcccagcactttgggaggccgaagtgggcagatcatgaggtcaggagttcgagaccagcctgagcaacatggtgaagccctgagtctaccaaaaatacaaacaaattagctgggcatggtggtgcatgcttgtaatcccagctactcaggaggctgaggcaggagaattgcttgaagggaggcggaagttgcagtgagcctagattgcgccactgcactccagcctgggtga

SEQ ID NO: 12745 - DNA, 1032 bp, Homo sapiens
ctggtcttaaaatttgatgactgtttaaccaaatgggaactgtttttctgaaagtgctttagggcaatcagtgctaatgcttttacatgcttactgaaagtagaaacctaggcatttgatcagagtattttctaagagatagaaaatgtttaaaagtcagatgataagcttgcataagcctcaagggtgacacaatttagtattcctaaataaggacttagtgtttcttgcagatgaggatattgcaataggaagctatttgacataaaaataaagtgtgcgtgaagtgtgctgtatcacttttgtgtaaactctctttttgattttcttaagcagaaatggctgagattgggtttacatagtctcttaaaatcaaagcttgctttactgcatagaataaaatgtgtttctctgactgactagtactgtataaaatagcctacctctctcatgcaaaaactgatattggacagaagatggaagagacaagataaaaaaaatgggaccagaatggaaagggaatcacagaggtggctagtattagattcccagagcaaggagaaagaacaagcaaataagaacatggtaactttttctctaaatgggtcagatagtaacctctactttatagtccctaatcagtgtgcccacctgtagacatagaaactttagtggttcctaggggcagagagggtgggaatcaggccttaaagagaggcagcaggagacattaactttgtgtaattgtactctgatgtactaagacttaatgacttaggttccttagcatctatatctttttccaaagctgcagctgtaattcattttactatttctcctaaagagtgtccattcagtgttattattattcatcaaataggttttgcatgcttactatgtggagggcaagtcataagatctgtaagaggaatttcttggatccctttctttatggcgctcttagtctaggggaggtgttagaggcaggatgatggacactaagaaagatgtaattataaaactgttaagtta

SEQ ID NO: 12746 - DNA, 1954 bp, Homo sapiens
aaattagctgggtgtggaggtgtatgcctgtagtcccagctacttaggaggctgaggcaggagaactgcttgaacccaggaggaggaggtcgcagtgagccaagatcacgccactgtactccagcctgggtgacagagtgggactccatctcaaaaaaaaaaaaaaaaaaaaaaaaggtaataatacttaagtatctctatatccgctgaagttaattcccaaaagtttggtaggtttcttagttttgtccaattaatcattgccactttgttttctttatacaaaggaagcaaaaaaaaaaaaaaaacaagtttttagttatgcagtgcattgtaaagttttcacagcagaaactgctgtatttatattaaatatattttaatgaagaagttaatatgtatggttatgattatcgcagtggtgaggcggctttcatttcctcagagcgggaagtgttaactgctttctcaagctccaggaatggcagaagatagatctgaatgaaaggataaggtaggaaaataattggaatcattcaaatggattagattggtggccatttaccaaaatataccttttttaatcattctgtttgtaacccattttcttctgaatggactgatagctcagtttctccctccctctggccaaaaacagtagggaggaaaaggacttagctcttctttttaaaagactttcctttttttttttttttttctcttcctttgttttttttttttaatggtagaacagttgagaaggtgattattgtagggagtggaccattgtgcttcttttatggggtggtgagggaaggaatcttctaataagaacttatgtctttggtcccaagtagctgatgagaagaggactagttctgtttgagtctcattgagtgtaaaaaagctaggaaaaacgttaaaaaaaacacgacttgaaaaaaatttgtattacagcacctctttttgaagtgccatctcatttatcgtgtattgttggaatacatagttaactggtgttttgaagtgcttttgccatcagagctcctagagcaaatggataaggataaaatctgacttctctttctctttaataggcaccgtttttgttcaccattttctgagttctggttaggatttggcgacagtatgaagatgaatttgtgtgtcccagaaggcaagccacatgagtagttgagtaagtaggaggccatgtacagttggaagaaagggtttatggtgttctaggtagccaccagaggagacagcaaagaagcagtatttgtcccagctgtgatcaccactgacactacactgctgctttttcttggcagcgatattattcttcttttatattagccattttataaattctgaaagggaacacatcttattctttgccaattctgaaaactctggccaggttagcttaagaaaataagataataataatacctaagtatctctatatctacagatagggatctacagacaagacaaggtaggtttaggataaagggcaggagccaggtctagggaaaacagtgggtcagaacaagataggggtagaccaaaggaggacacatataatggagagtgagatcaagaatgaccagatagcaactagaggaacttatagtggggaatgagacaaggcattatattaaaagtcatgacagcaaacaccagaacacatactagaagaaaggcagttggtgaaaggtttataatttaggaattagaacatccatctacgctgaaaaataggattgttgtaagaattgccatgaactgcctacagcatgggtactgagacagcaagcagtcttttgctagccaggaaagttcttacaagttcttcctgcgtagtagctactcctagctgatagcagtcatggaatacagcaattcagtttacgtctggcagctcctgactcctgagcagctggtctga

SEQ ID NO: 12747 - DNA, 1029 bp, Homo sapiens
tcattgtgtgaacaacagagtttgcttacacaaacacagacagtatagcctactatatacatctgggctttatgtagcttgtaggctacagcatgttattgcactgaattctgtaggcaggtataacacaatggtaagtgtttgtgtttccgaacatacctaaacatagaaaaagcaaggaacggtggctcacatgtgtaatcccagcattttgggagggtgaggcaggagaatctttcgagcccatgagtttgagaccagtttgggcaacatggggagaccccatctctgtaaaaaatcttaccaaaaaaaaaaaaggtgcagtaaaaattcagttttattatattatgggaccaccatcatctgtgtggtccatctgttgactgaaacgtcatcatggcggcatatgactgtattcgtatacctagagattttctttgttcttagtgtatattttgttatgaatgtgcctttactatgctttaaagtcactcagaataattcctctctgtggtttttgtcaccaactggttacacagtgaggtgcttttgtttcatcttattttggagttttgggggggatatataaaaaaaagttaatcattttataattatgaagtgtagttccaaagtcaaatctacaaaacaaggcataaagaagttaatgttttgttatttaacttgtaaacagtgaactctgtagagaatgcagattattttagcgttttatcttctttcagtatgtttaaatagaaacagatactcagttgtatatcagtgctttggtaactttttaatgctctggattcctagatttaataataagaggaggacaggtgtttgaaaaaaaaaggctacttgctgtttttcctcaacagccctttggcttgctaattttgtatattgttacctttttttccccgtctataacttttctttatccttcttcactgatagatgttcattcatgaaactgatagttcttaaatgtattggtgtaaataactttacttctggctcacatttgaa

SEQ ID NO: 12748 - DNA, 1048 bp, Homo sapiens
gtctgaattgtttaaaggagatcaagagaaaaaaagctattattgaaaaattatattttccttagacattgctggtgaatagtgggaaattttggtattacatatattttatccaaatttaggatgatatataaatatagtattaaaattttgattttgtgtttgattaggttcttggtttatattttgaaaatattcgattcagcctttgaaataggtcttctgaagcttttttttaaacctttttgtctaagtgaagagagaaggtttcttagaaaagaattccaggttcactgaatggctcttgacttcaagaactgagttactgcataacaagataagtcagatggtccaagaagcagtttacagtttttgttaccatgactacaacatattggtagaagaatattatattttatagttactgttaaacccaagttgtcgatgaaaaagtgaaaagttttagaactttgtgtccagtggatttatttatattactaaggaatcctaatttactgtgacttttttgttttaagtgaaagcaaagcaagtgtattagagcagcagagtacaggaaaatggctgcaccatagacagagcagggctaccccataggcagagtagctgtgacttaaattgtacttttaaagatacttcacagtttttcaaggggtgcgtgtgtgtttttgtgtgttttaagggaaatctatacaagatggatgtaacactgtgtttgctaggtacgaactttaaattctgggctgatgagcaaagatttcagaaagcatttctcagctttttctaactggtagctgaataattttctataaggatattataccccttgaaataaaaggattccatatttggtagtgatcagtatgtgtaggtaaattagaagcctcagataggaatttgggataatgaattacaaagtggtaaaaataaaaaagaccttttgctggatgcggtggctcacgcctgtaatcccagcactttgggagtccgaggtgggtggatcacctgaggtcaggagtttgagaccagc

SEQ ID NO: 12749 - DNA, 1895 bp, Homo sapiens
ttgtgaatatggtacacgagaaagtggatttaatttcctgcatggctttatgcttcttacattgatcagtaaagtgacctttcacagttttcccccagcagtcagtacatgtttaaactaaacttggtgttctctgtgagcagccgtcactttggttttcactttttccaaccactattggacctttgcatacatttcttccagaagcatctctgtccccttctttcttgaggcaagcattgattcttgaaggtttagatgctagtaggagtgatgactataagaaacaagatgtactacacttgtagtaggcacagtaatagagctacagataaagttctctgggaattgggaagagtagaggtgacctatagataccaggattaagcaagtcttatggaggaagtagcagtaaaaataatgcttcaggacaggtgtggtggctcatgcctgtaatccctgcactctgggaggccaaggctggaggatcagttgaacccaggagtttgagagcctggacaacacagtgagaccccgtctctaaataaataaataaagcttcagagagtaaattaggacgtgggtttcaggggcagaagagaggaaagatagcttagtaaaagtgtcacaagagcagagacgcagtggacaagtatagatcatagctagaatttcagcttgtctgttgagaggttgtaataaagagaagaggaagaaaaaagtttgaaaaggtaatttaaatcagatcatgggagaccttgaatactgggttaatacattaccaccattcagtagaccattagtggatctcttgagagtcttgagaagagaattaggtgaacagttgggaggattaatctgggctacaatatgttaaataaattggggctgggacattgatggtaaggagagtattaagaggtggttccatcattcttggaaagatgcagtgaggaccattaaattggtgttttgtgtatttttaatcacatctggtgttttgatccttaaatattgcacttttgtgtgaaaggagagctttaacttattggtattaaaattaatcaacttcactgtagggaaaggggcttggcttcattttatctgttagacatacattgaacaattactctttcctagatactgtgcgaggcattatggatgtagaagtaaggaagatacgatcccagcactttaggtttttgtattttagcacaataggagatattgaattggaatcttagtaactccttgtgttcagagtttataagatatcagctataagagaggcaggttaagaggatgtttgatgctggaaagatagataggaaccacactgtgtaacacttctttggcttaattccttagacagtggacaaaggctttgaaggttctatggaatatgtagtaacagatttctccaagacttctgagaaaaataggatgtaatatggttttgtcacctgcgaaggaaacaaagaatgttcacttagaggaatagaggaagtactgattgtcatttagactactccatttgtgggtgaaaaagcacaaagatcatattatgttatgctgggttattgatagtaactaaagcaaaaataagatattttacactgccacttccaaaaaacaaacctctttattgggacatttaaaaggaattaacctactgctagtttagtttatgcatatataatgatatcctttggaattttaatgcagattttgataatttgtaaatttaagggtgccctgaacattaggatatattagttggtagtagtgatgtgagaccagattgataggcttacattcttaaatagggtggcctgaatttatcagtccaatgaaagtgcatgtctgtgaggcaacaaagattattatgtttgaga

SEQ ID NO: 12750 - DNA, 1032 bp, Homo sapiens
accaccatttatttgagcctctattattttaggtgctatgtagaatacagaaatgaattggaaacatttttgcatttcaggagctcagaacctagtagaagagagagtatatacacacagagcattgttaaagggtagaaagtaaagtctcctatgtggggcccatggtattactggagttttatgtgagaggctgagccttgaggacgagttgatttttgggcataataaccttaaagggtagatagaatttggatacatggctatgtcaggacaagcatgtgcgtgtaactgcacattcaaggatctacagtagggaagtttgagatgtgtattggggaagagttaaagatgagaaattgattgaaaatgaacatttgggcctcttggagcttaaacactaggctaagtagtttgggcttcataggtagttgggatcttagagggtttttgaataggacttagatagaagctcccagcagattataaactgtatggggataggacctgcatctgacttttgcccatcattgtaattccaggaccatcgtaatgcctggtacatgtgctcgctttggcagcacatacactaaaattggaacgtaattcctggtacatatttgttgaataaaccagtgagcagatttaatgaatgtaatagaagtttgtgtaaagattatcagtctagcaccattgcatgctaggaagacttcctggtgtcctggaacacataggaaaacatgatgacatgatgttgttataggatattgttttaaggagagatgtggccacatttgaaagattttcttgatgcattgaattcttttttaactgcattttgaaaaaacagtgatataattttcttctctttttgcagtatcttattttttattttatttttgagatggagttttgcttttgtcgcccaggctggagtgcaatggtgtgatctctgctcaccgcaacctccacctcccgggttcaggtgattctcctgcctcagcctcctgagctgctgggactacaggcacg

SEQ ID NO: 12751 - DNA, 1643 bp, Homo sapiens
ctcgctggttcaagcgattctcctgcctcagcctcccgagtagctaggactatagatgctcgccaccatgcccagctaattttttgtattttttttgagtagggctgcatgttggccaggctggtcttgaactcctgacctcaagtgatgctcctgccttggcctcccaaagtgctgggattacaggtgtgagccaccacgcccagctactttacctttcatatttgtcattattttgtggataataatgaagaatacatttgtatttcatgagaaacaagtactttcaggaaaaacacatatccagtgataaatggcagctaggtctaagtagtttataaagtatacttttatttttcttggatctgaattattcaagttttgatgtaaatttcctgattctttaaataattacattactgttctgtttttctgttttatttgaaagaatgagtttgccaaagctataaagtagtaagtttttcattgggtgattatctgaatgggtctagtgcatacttactaaatattagacttaatgtgtaattatatacttgaaaggaaaaataacatacttattaagactgataaataatacattcatattgtaaaattatggtaagatcataatctcagttctttcagatgaagaattgaaaaagatctagtgaattagataaaattattaaggtaaatatgcttgaaattgagagaacaagctaaagtctatcttttgagtgtaagtaaaatcgatgtgttaccacaggcaacttactgaaccatgtaattagtttttttctatgaaaaatgagacatactgagattgtgttaaagtagcatgtaaagggcttatgttctaatgatatgaaaattaaagaattggtaaaaaaaagttataattttcagtttgttggtaagtatagttattatggcctaatgttttgcgttgatatgaaatcacctacttatataaagtaaacctgagtaaaatcctcttaaatgagatgttagagtcaccattggaacaaatagtgttgaaaattgtcttaacactagattaactgttatttggtatattgttttttaaaatgtgagtaatttttatgattaatacattgtgactggtagataagtgtttagtctaacatttttaagtgtagccatgtttgatgcccccctcaccatttgtgtatattttatttcaaaagcttgtactttcatagaaaactttaagatttagaagaggctgttgtggcctggtgtgatggctcatgcctgtaatcccagcactatgggaggctgaggagggaggatcgcttgagcccagaactttgagaccagcctgggaaacatagtgcgataccatctctgttaaaaaaaaatttaaaaaagaggttgttgatcattaagatggcatagtgatataggtaaagggtttttttgtttgcttagcaaaatattttcttagttttatttcttagggaggctgaggtaagaatctgaatgtggaaaattgaagaaaaggtttaaatattggtagaatttagggcctaaataattcgagaaagaattatatattagaacattaacattgaatggagtagagctacacatttatagggaataacaccttctgcttataa

SEQ ID NO: 12752 - DNA, 1073 bp, Homo sapiens
attttttagggtatttggtctataaataagagaaccattgtgggtgacattgcttgcttagctgggtaatcagcaaagtcccagaacttaacattcatctcaaagcctgttctatgtagttagcagttaacttaggtaaaattagagtttcagaacatctggattctgtttatcagaattttaaaaataagatgtcacctagaagataattacaacatttttgtttgtccattaaaatatgaaaacatatttttactttttttccctatgtagtagagaggtataaagctttttaaaaagtgtctttcttatctttcatgattgtttctgactgtcatcttctgtttctctgtattaatctcttacgttttagctttttggtctgctctttgttagtgtggtacatataattttgtaatgatgaggaaaccaaacccaactgctaatgagggttatttagttgataatatagaataaatttatttatctatgccaacggagaaaatcgtcagtgttcttagaaatagcttattaaattattgtgttatttttcatgggctttgttactgagttaacaaaaaggagtagggcatttaaattttgggatagttgctttagattgcatgtgtaaattaatatcttaagtattttttggtaaagagttaagcaaagattgaattatttttagatatttttaaaattacagaaacactacatttaagttagaaaattaggaaaacagtcatcatatggagagaacaaagaaataaaaatactgaagtctgaaagagttttagatgttttatgtgtaaatgaaattggtaccatacagtttttctaattttctaattaaatgtagtattgtgaatattttctcttgggaatgattacttttctttggagtttgatagtggtataaactgtttatattttgtattctatcaggaaagtattacagtaatggaataattataatttcattgagtgcgtctcctctttttaatatgaattttgagcaagtttttagattcatttatatgaagtgtccatttttgtaggtaaaagtagttgaa

SEQ ID NO: 12753 - DNA, 1072 bp, Homo sapiens
atgtaaagagctatgtagaaatcttgatagaaagtttctcccaccttaaaattcgagaagattgacatacattcttcactgggaggaatcttatgatatgaagtttcgtgtaaatatttattttagcacaattgcttttctgtatggaagactgtttttagtggtctgtaagtaaaatgagaaaacgattacaattttttgtctttttccaggctgaactcacgggaatcaaatggcgtaggtacaattttggagggcatggggactgtggacccataatttcagccccagcccaagatgatccaattctgttaagtttcatccgctgtctgcaagctaacctgctttgtgtatggcgtcgtgatgtcaaaccagattgcaaagagttatggatattctggtggggagatgaacccaacctagtgggtgtaatacatcatgaactgcagggtaaggtttctgtttttttcttaaaaattatttgcatcatatttttttgaacattgataaatttcaaacagattattaagacttgtctaaaagaacgatcttaagtgtttcatggatgtctctctcaaaaggaacattctcacccctcttcctcccatccctgtttttttttcctaactcttgtccttttccagttatgctgagaatcagaaccttgtgaaccgctgctgttaaatgagagtattgtgtctcctgggtgcggtggggtggaaaccaggctaagatccactgtttttaaatgatagtgaattgtgagtaactaacaagacagtgaattgaacagttactgtttttttccttggactgtggttgttatggttcactgccagctgaactctttggtggaaaattggagagtgatacagaaatttagttttgagcctaattggacaaaattgtgagattacattgaatagtattttgaggaaagatgaatatatgggatctggtctgaattgggtgtagcaaattttcttttgcttttatttctgtttttcatgtaatttggtgattccaggaaacattggctccggtgttgcctgatttttagcttcagattgca

SEQ ID NO: 12754 - DNA, 1058 bp, Homo sapiens
gccattctcctgcctcagcctcccgagtagctgggactatgggcgcctgccaccatgctggctaatgttttatattttttttagtagagacggagtttcactgtgttagccaggatggtctcgatctcctgacctcgtgatatgcccatctcggcctcccaaagtgctgggattacaggcgtgagccacctcgtctggccagttgggccttactttaaaaaaaaaaaggatccctcacgcctgtaatcccagcactttgggagaccgaggcgggtggatcacgaggtcaggagatcgagaccatcgtggctaacacagtgaaaccccatctctagtaaaatacaaaaaaaaaaaaaaaaaaaaaaaaaaggatccatgatgagaatctctgccttctaattgtaagatttagagaatttatatttaatataattatgttgatttacttgggtttaagtacactgtcttgtttttgtttttgttttcctccctattggtcccatctgttcttagttcctttcatcctctgccttttttttttttaaacctactttggattattttgagtattttttatggctccatttattatttatccaataattggcttattagatatacctctttcctttactttttagggattgatcaagggtttataatgtgcatcttttacttaccacagcttaccttcaaataatattaaacttctttatttataatgtaaaaacctcccattttctccttctggcctttgtgctattgttgtcatactttttttcttctttctatatctgacatgtagtccacaaggcattatcatttttgctgtaaacagttaataagcctttaaagaaatttaaagatgagaaaacaaatttttttttttttttttttttttgaggaggagtctcgctctgtcactcaggctggagtgcagtggtgcgatctcagctcactgcaacctctgcctcctgggttcaagcgattcttctgcctcagcttcctgagtagctgggactacaggagcgtgccaccactcccggctaatttttttt

SEQ ID NO: 12755 - DNA, 1062 bp, Homo sapiens
cccctccaggcaactaccaatctgctgttactgtagaatcattttgccctttctagaatttttaataaatggaatcatatagtatgtaatccttatttctggtttcatattattgcttaagtagggtttttttttttttttgctaaatagtagtctcttttttggatatgccacaatttgctgttggctgtgaaaattaatgtactgctttttgtgtgggacatatgtttttatttctgtaaataactaggagtttcactttataaagaactgccaaacttgcaaaaaataaaatgtttgtatcatttaatatcccatgagttttataggagttctaattgctctgcattcttgcagcatgtagtacaatgaatttttacaaatttcagccatccttgtggcgtgtagtacatgttgtgaatcttttatctaaaatgcttggaaccacaagtgttttggattttggattttttcagatttgggcatatttgcattatactggctgagcgtccctactctgaaaatttaaaatttggaatttcctttgagtgtcatgttggcatgcaaaaagttttgattttggagcattttggatttttgaattagggatgtgcagtatgtagtaacttatttcagtttgtaattttttgataacagatgaagtttaacatcattgcatgtgcatattaagtcattcgtatatcttttgggaaatatctcttcacatcttttgcccaatttaaaaattaggttgttttcttactgaattggaagaattcttggaatatcctggatacaagttcattggcagatagatgtattacaaatgtattctcctaatttgtggtgtgccttttcattttctcactgtcttctttgaataacaaaagctttaaattttgattaagtcaagtattacttttataaatctatacttttcatgtcctaagacatctttgccatcccaaagcaggaaagtttttttcttatgatttcttccagaagttttacagcattagttaattaggtttaggcttgcaatccagtaacttattttaagtt

SEQ ID NO: 12756 - DNA, 1103 bp, Homo sapiens
tcagagcttttgctgtttgtaaagagtgcttgctgcaggcgtgcactgcttaactaccagctacatgcattttctcatgctcacaagatccttttgaggtagagtctactattctcatttttcagataagaaaactgaaacaagaaatttaagtagcttgtccaaggtcacacaggagctgaatctcttgattcaaagcctgaacttttaaccagtagtacatttgtattttatgtttttctttcttctatctaaattcttttaggacttcagtgaagctcctcgtagctattccaaacattattggtctctttctttttcgagccttttgaaaattagcagtgtagaccatataatttagtacaagtgctaaggtagaaatcactggagcatatagatttgcctgagattaatggagtgataatacagtttacgtttttttaaagtttcatcagagattaatggagtaatatacagcctacaatttcttcccagagatagggaaatagatttttttttgtcttagactgttccaaattgaggaatcatttggaaaatgaaaaattataaagatagcttattgttttgattgatgactggggcaaggttaaaaaacctacataaccatgtgatctaaaaaataaaaatgatcacctcgataaaagtctttcagttttttttaaagtaaaagccagttattaaaataatgtcaaaatgatttagtatcacaatcatatgcttatttaaaaatagacaaatagcttaaaaagtaatctctttttctgtacaggcagcttggaggcctgcattttacaactgatttggttgtcaagggatctgggctctttctgtcttgttactacactgttcttagtttatggcatatagttcaagatggctattcagactccagtcatcaaggttgcattctaggttaggaggaggtggaaatgtgggaaggacacaccgtcctttaaggaaacctccaggaagttgcctacaacacttctggccatacttcaaggccttacttaactgcagggaggctgggagatgtagttctttaagtgggcatgttgttatccacagcagtgtaaagtgta

SEQ ID NO: 12757 - DNA, 1094 bp, Homo sapiens
tatcagcctttgttacctagagcatctacttttaatagtggtaagcccagaaagcagatgcattttcctactgcagatctgctttgggatattctcgtttaattttttacatgaaggttttgtttatattaatttcaaatcagtgatatttttggtaagagggtgaaatagacattccatctgttttccttcatgcctttgtggaaatggccagatttggggaaccagtggatagaatagcgggggcatttgtagagaccacaaaccagtgtttatcattggtacttattgcttgttttgattttggtttctttcaaatttttgttcctatcattctattctttgtttccgtgacacttagctttctgagtgcacaatattttttttgttattgagagcgtaattgttatgccatgttgtattttttgcctcacatgttggagaaatttttccttcctcgttccatgcctctctctccatacccccttttcctcagcacattcctgggttcctcgtgttcaggagtgcaaccctgactgttggactttatgtgcatcaccagtgctcagttaagcgctaaaatggacatatgcgcttcagaaccttttgatgtaatctccttggtgtggtggggaccctttccagttgttctgagtgcacttattggcacagcgtgtactatccattgtagattggctgtaaattaattcagccttcgtatgtggggaggtttttcacttggctaccctgaaggtaaagagttggctttcccgcagttgtcatttttctttactttctctccaagtgaggtagtactaatgaaataccaaatatttccaagaaatacaacttccaagaaatgaaaactgtaaaacatttgtccatgttccagccgctccattagatcagatttaccccaattcttcttctgttcttgttaatgtgcacatttttgtacatagatgtaatcacagtgtaaatagaattctttattcagctgtactcactaacatttcccatgtgcttataattttcataattacaattttagtggaaaagtaatttcttttaaaaattttatacaattttatgta

SEQ ID NO: 12758 - DNA, 1057 bp, Homo sapiens
catttagaatttatatcagagcatgaatcttcatcttagcaactaaagagcacaaatatttgcctcctgagatacaagttcttaactaacatttaagttactaaaaacacagtgttcaaagtatgtcgctttaacttgaaaagtgtaatcatctgcacagattgaatcaggtttcatgatcccaaatagactacattctttagttgtctacaaattacttgagagagatatgtatgaagatgatattttgttgctatttggtgataaggttgtgaaactgagctttgcaacccagacagatggtgctattcttgaatctgcaagatcctataacatttaattaaacagcggaatgattctcatgagaatccatagtttgttatatataagctaataagctgactttagtaaattgtataaatttgatttgaagtagaagaattacctattctaggaaactattctaatgaatgttaagatgagtagcttgtgttagtggtttatatggtaaactcaaggaatattccagatggaaaaacaagtgggactcactaaggtaggcgtttatcttctaaagtaactttgattttgttgccaaactttctcatatggtaggtgtgatatgctgttaagaacccacagagctgactttaacaatttccagaaagctgtgagaaatttagttatatatgttaacacccattttagaaaatatctattgatttagattccttgtaatctatcttatattttaattttggaattgaaaatagaaataagtaaaacagcccagtctagttttagtatgttatgtgaacataactctttagccatttgtaaaagtttgagtttggtggtaatattgtatgatggagatgaatgaattttttagttatataaataattatgtaaataatacaataacagaccatacatttttagacatcattgcaaatattcttttattaaatttaccttttctttaatacctattttttaataggtagaagataatgtgatgtttgatggccaattgaaggacatgaaggaattggga

SEQ ID NO: 12759 - DNA, 1027 bp, Homo sapiens
tctagcgattctcctccctcagcctccggaatacctgggattacaggcatgtgccaccacgcccggctaattttgtatttttagtagagacggggtttctccatattggtcaggctggtctcaaactcccgacctcaggtgatccacctgcctcagcctcccaaagtgctgggattacaggcatgagccactacgcctggctatcattttctgtaatgaaaatatttacaatttgttaatgtatgttttcggtttagcattttgttgttagtagcacatggtgttacagtatttatatatttttaatagcaataattgccacccggtaatagttgccatattaacctccaattgctagtaaatatttttaagtacataatagacagcaatttaaggcatagtgtagcagtttactggactgttttaaagagccatttgtatgtgtgatgagttcataattttaaagagacaataatgtaccttaggcctgtatgctacaaatattttgctgtggatgttgcttgaagtactcactgggaagaagttaggtagggcctattctttgtgagaagaatgggcaagggggtgtgtttaggatagtatgtatttattgaatttatgccaggtgcttatatagcttatcattttttttttttgttttggtttttttttgagaccagagtcccactgtgtcacccaggctggtgaagtcttggctcactgcaacattcagctcccgggttcaagggattctcttgcctcagcctcccaggagctgggattacaggcgcctgccaccatgcctgtctaatttatttgtgtttttaatagaaatggggtttcgccatgttggtcaggctgctctggaactcctgaccttgtgatccgcctgcctcggcctcccaaagtgctgggattacaggcatgagccactgcgcccggccagcctggtttttaattgtattccttaccactttcagagatctctctcaccagtttgtactagtgctataaattgtgataacta

SEQ ID NO: 12760 - DNA, 1048 bp, Homo sapiens
ttacatttaattatgggtggcatagatgcctttttgctatgagactaatggagaaatgcaaattctcgccaacttttcaaatgaaagtgttactttattaaatgtgttacaatgcagaccaaaaaatcaacacgtgatttttacctacaaagacatagtatcattgctcccactctagtaaaatcaggtaaatttttttaaatgaaatattttaatccagatatttaatcttaaaattcatttataagttggaattctttctcttagtattgtgataattttcccttgattttttggtatgtgggagtaaaacccccttttgcctcaactttttccctcctcagtcttatcatttagtatcagtcaggttcagggacttccatagattagcaaacatattgatcaaggggtatttaaaatggtttttgtgtggttactggtgaccacattgacacttacaggtaattaaaataaccaagtagagcgatctcccaaattatcatatattatgctgactggtaatggctgtgtatatacggattctgtagacaaatgaaagtatatgtatagccagtctttagggtatatcatttcttttatcttttttttttttttttaaagcttaagtaaggatgataacgttacagagataaaatgcttgagattcttttggagaagcaattttgtaggagaggattctgtactttgattttgaatgactaaaggtttgtgtttgagatatttctcccctaaacctctttaaaccaagggattgatttttgaatatgcttttttaaaaagaattattttttaagtagcaactttgaactagagaaccatagaaatgcttagttgatttttttttttaaaggaacgtagaatgtcttcattctcttgtacgtggagtgtggataaggtgctattgaagaaatgtaaattaattaaactgctgacttgtacatttttctgattccaaattgagattttttttttttgaaaatgctatacagcagtagcaacctggaatattaaaaatatgttgcccaaa

SEQ ID NO: 12761 - DNA, 1028 bp, Homo sapiens
tcccccctttttttccccccgtaaatgtggaaggctttgccttgtgctgccgcgcctccgatcggcaacctcttcccccgttgttggatcagctgcctgcccgcccgcctgccttttgaatttttttaaattccataatgacacctgcaatttcgccctaaaatagttgattgaatgcgattgtgtcaggaaaggactcttgcacccgaagctcccgcgattgtaaacatcgacagccgcctgcctctcggggcttactatgctggagagccgtaaagccattgcaccgagccgacggaaggtggagaaagctttttcttctttctctcctcctgtgtcttttaaaaactgtttttctctatcctaacaacgaatccgcacacacacacacacacacacacacacacacacacacacacacaaaagcaacaagctggtcggtttgataacatcgcttttatctgccttcgcctctctcgcgctctctctttctgataattgacaacttttccttcggatttgaatcgcctgccttaatcttgaagcagttagggtgtcaattgttctcgtggaagcctggcacccgccgacggtgtctagattcatcgaaattaaaaatgtatagggctccagcaactcttttcctggcggtgtcagtgacatttggtggtaaatgccatctttgctttttattgggtcgtattacctacctctgaaaacattcacgttgttaaacctggcgtttaggctaataattgcagtgcgtggtctttaaatatgtgctttgtgcatgagttactgtatgtatagctatgtgcccaggagagtacgaatttgtttaaatattgagcaaagatttgtaaacagatgtaaggcaattacgtttcaagcgtagaatataattggaaaattggctgaacggtttatttaatttagccttaaaaacacccaacttgttttaagttgtgtaccctgttttttttgggggggaggtgagtcccttttggagagcatgcattttggaaatt

SEQ ID NO: 12762 - DNA, 1049 bp, Homo sapiens
agacacaaaagggcacctattacatgattccatttatatgaaacattcataataagtatattcatagagacagaaaaagcagatttgtggttgccaaggactgggggaaggggaggttggaagaatggggagtgactgcttaatgggtatttcttttcagggtgatgaaaatgtcttggaactagacagaggtggtggtggttgtgtgacattgtgaatccgctcaatgccatttaattatacactttaaaatagttactggaggccgggcgtggtggctcatgcctgtaatcccagcactttgggaggcagaggtgggcagatcacttgaggtcaggagttcaaaaccagcctggccaacatggtgaaaccctgtctctactaaatatacaaaaaattagctgggtatagtggtggatgcctgtagtcccagctattctggaggctgaggcaagagagtcacttgaacccaggagtggaggttgcagtgagccgagactgcgctaccgaactccagcctgggagacagagtgagactctatctcaaaaataaataaataaaataaaataaaaataaaacagttagtggttaatttcatgtcgtatgaattttccctcaattaaaataaataaataaataaatcagcatgggtattctaggttgcccaggagccccctgaggcctgactagtgaatggggccctccttaggccggccctccagccttggggccacctcaccttgcagaggctgtagagaacgatcaggaccccgcccaggaagtagctgttggaggagtcgtcacccatgatgtatttgtaccacagctggatggggacaagggatcggaacagctggctcagctcctcgatgaccagatagaactttccctgcaaccacacagagaacatcaattattattagcagtaaagacccaaaggacccagctggggggccccccgccccgggcagtgatgacattctaggtcacaggcaggccattaatcagctctggaaagcactcaggccagctcctaatggggctgcga

SEQ ID NO: 12763 - DNA, 1028 bp, Homo sapiens
ccttggggtctaggagggaggatggcattgagaggcttgctggttatgaggcagaaagctgacctcatgcatgacttggttgctatctcccccacccccacaaaagtgtcctcggagttcagcccacagcctcctccactccccaaggggatttcagggtttaggttttatggattaaagagccaagaaatggctacattctgttcaaagatgatttataaccgggggatgttgtgggagggagtgggccatttaaatgaaatgcaccagcatctcactgattgacagaggtctgatttttttccccccaaggataagctactattttcagaagtttctagaagggctaaaaaaagatgtgtgctggacggagacttggctgcaaagactcttcagggagcagtgattattttttgctttcattttcgaaaaatccaacataagcaggtattcttcctctgtgcaggataccacacactgccattttcaaagccgaggtggcgaggtgtcaggctgcagattcggacggtcattctccaaggctggatttgcaggtcaccacccggtacctatagacagagggtccagcaggctggttagcagacaccgctccagttctaagacgccagcagtgggatccatgtttaaggtggatgcggctgaaatgggaattatccccccacaggctttgctgtacagttctaagaagccagcagtgggatccacatttgttaaggtggatgcggctgaaatgggaattatccctccataggctttgctgtaaatgaccaggtcctttagaatgtacaacctctcagtgctgctgcaagctgggagctggatttctttctgtcttccttttaaaatccgttccttgtgttttcctaaatagccctttaaagagaaatgcaaccccagggctgctgaatgccagggaagactcccccaccccgcagctttgaactcagcaaaccaaaaaaaaaaaaagaagaataatgcttattttgggagaacgtgtttctcctcat

SEQ ID NO: 12764 - DNA, 1106 bp, Homo sapiens
tgaaaaagaaaattgtagtcttgcctctggagaaaggaggttcagctttgagcagaaggtctgagtagcagaagattgcagtcctttcccatgtaaagaccagacagattctaagcctttctacctttccattgcattagatttgaccctttagtgatgtgattttctttccttctttctgccatttctctttcctttctttcttcctttctctttttctctctttctttccctccctccctccctgcctgcctccctccctccctctcttccttccttccttccgtccctccttcttcctgtctctctctgtttctgtctctgtctctctctctctttgtttttttgagacggggtcttactctgtcacccaggctggagtgcagtagcaggatcgtagctcactgcagccttaacctcctgggctcaagcgactctcccacctcagccttctgagtagctgagactacaggtgcacgccaccacacctggctaatttttgtattttttgtagagacagggttttgctatgttgcccaggctggtcttgaactcctgagctcaagacctcctgccttggttttccaaagtgttgggattataggtgtgcaccaccattcctggctggataggtactttaagacttggaatcactataaatatattatctgtaacctgaccttttccatatatcacaggcatttgttcaacagcttaatatttttctatgagacacttctttttgtttgtttgttttgagatgaagtctcacactgtcgcctgagctggagtgcaatggcgcaatctctctgcaacctccacctcccaggttcaagagattctcctgccttagcctcccgagtagctgggattacaggtgcctgccaccacacctggcttaatttttgtatttttagtagagacagagtttcactacattggccatcctggtctcgaactcctgaccttgtgatccacctgccttggcctcccaaagtgctgggattacaggcgtgagccaccatgcttagaagttggttggtattgctttatttggttagtccatcatttacattccccatccatcattgtgaagtcacttgagc

SEQ ID NO: 12765 - DNA, 1048 bp, Homo sapiens
aaagaaactatgcaacatagtcactattgtttcccaaattcaggttcttccacttatacaactgctaattattgagtaccttctgtgtatagggcactgtggatacaggaaggaccaagacataagagttccctgctttcatggagcccacattttagtgggaagagacagacaataagtaaatattgttcttgttactacttctgtgtaacaaattactccaaaactactaagttttgcttcaaacaactagagccatccctctgtctctgggcgggagtggttccaggatcccactttggatcccaaaatccaaggatgccaagtccttgatataaaatggtgtagtgtttgcatataacccacacactgtaggctttaaatcatctttagattacttataatacccaatacaatgtaagtgctatgtaactaattatactgtattgtttttatgtgtgttttttatacttgtgttatttttaaatttttttttccaatagttttgatctgaggttggttgaatccatggatgtggaactcacctatatggaaggctgacatatttgaccatgctcacacattctgtgggttaggaatttggtcagggcatagtgggggtgacttgtctctgctccaggatggctggggactggagtcatgggtggggaggcaaccttatttacatgtctggctgttaatactgggagtcagctggggctgtcaattggagcagctatactcagcctcttcgtgtggcttgggcttcctcacagcatggcagccggattctgacacagtgactgagagctccaaaagcaagtaccccagggaactaggtggaagctgctttgctttttctgtcccagcttccaaagtcacttgggtcagaagcaagtcacaagctgatacagattcaaggtggggcggaattagactccacctcatgggggagtggtgaggttctagaatagcatgtggaatgggagatattttagtggccacctttggattatgcaatctaacacagagataattttagaaactc

SEQ ID NO: 12766 - DNA, 1050 bp, Homo sapiens
tcatgtctatttaatgtttaatattagaagtgtttggtttaaagttctaaagtttggtgaagtttttatggccagcaatatgccgtgggaacttaactcttgtttacatccattagcctatagtaaaattagtttcattatatatcattttgcttaaagttgccatttctttttttgagacgaagtctcgctctgtcgcccaggctggagtgcagtggtgcgatctcagctcactgcaacctctgcctcttggctgcaagcgattctcctgcctcagcctcccgagtagttgtgattacaggcacacgccaccaggcctggctaatttttgtatttttagtagagatggggttttgccatgttggccaggctggtcttgagctcctgacctcaggtgatacgcctgcctcggtctcccaaagtgcagggattacaggcctgagccaccttgcccagccaaaattagtttcattatacctcattttgcttaaagttgtagtttctaagaaaacctattgatgacggttggtgaagagttactgtaccatgttgcgggtctcctggatcctgggctgggagcgcctgtaggggaggttctgggcaaatccaattgactgtgggtttacaaaaccaccacggtgggaggtaagatttcaagggggtgggaagagctggaatcgtggcatgccaggggattatcactgtatgccttgcccaagttaaaataacttgaccaataaagaaattcaaagcatttaatattagaacaactacggacatcataaagcagaaagcaagtccgacagtgttttgagaggcgatatgagatcttcaggtgtttcaccatccagctcccctggcagcatgctcgagtatcttctacctttaggggagccggggatggaggcgtccctgagagggactaaagaaggaaagtagaggatcaattggctaaaaactcagaacttgtttgtgaaagggtctggataaaggtaagggggcttaatttggatacatgttggcttataaaggagcatttatcctttccct

SEQ ID NO: 12767 - DNA, 1088 bp, Homo sapiens
tttctcaggatttttcagaacttttaagtggtgcctggttcatgttttactcaattaagttttgtgttacttagatttatcatttttcttacaagtaaactttgggaaaatcttcttagtggattggcatttatttttctttcataatacatagttgccaacttcattatgttgttaattttttcctgttctgcttcttagcaagctaggagctcaggccagtaaatgcaccaaatccagtccttgctcctctctaacagccaggagtggggctgggagcaccctcgaggactgtcatttacttcttgcctggtttcccaccgttcctgcctggacttctcatgcatcttgttctgggcccatgttcagaattctgtgtagtagctgttgggtcctgttgccctggcacatctgtgtttgataacctgagtttccgcttctttcctcctcccaacagaagccgaatgttaccaacaccaggctgtccctcgataatacatagaaaggaaaaagtggaggagaagggaacaatgctgaaacacagggctgggtctctggagcagggcttgtcagcccagcactagtcacatgttggtcaagataaccgtttgtggggggccgtcctgtgcgttgtagggtacttagcagcacccctggcctccacccactgcaagctggcagcagctctcagttacaaccaaacatgtctgcaggccttaccagatgtccctttagtagcaaaagagcccccagatgagaactgctccagacgaactggcaacaaagcagttattctaaactacctgcttgaattctgtgtacttcagatacctatgtcctgtttaccaatgacaggtaacagtggttcccttagagcaaaggggatttttgtctcgatggtattcccagcttctttaccctctactatttctgtgcagctctgcaagaaaatccaaacatggccaggcgtggtggctcacacttgtaatcccaacactttgggaggccaagacaggaggatcatttgagcccaggagtttgaaaacaacctgggcaacgtagcaagaccctgtctctacaaaaaagaa

SEQ ID NO: 12768 - DNA, 1062 bp, Homo sapiens
aatcagtatccaaccagaattcattcactgcatttggttgttttttttctctttagtctctcttattaaagacagttcctcattcttcattttttttcccccctttttcatatgactttgactttttgaagaatccagactggttgtcttgtaaatttttttttttttttgagacagggtgctctgtcacccaggctggagtgcagtggtacaaacatgagtcactgcagcctcaacctcctgggctcaattgatcctcctatctcagcctcccaagtagctgggactgcaggcatgcaccaccacacctggctattttttgtgtttttgtagaaatggggtttcaccatgtagcccaggctggtctcgaagtcctggactcaagcattctgcccgcttcagcctctcaaagtgttgagatcacaggtgtgagccaccgtgcctggccattgtcttgtaaattgtataacattttggatttgcctcattggttccttaactgtatgatgtctgccagctgggagtgaagtctgagtcctgattagatcgggataagaattcttggggaggatacttcacatccctcgccccgtgcttcccactgggtctcatcaggggccccctgtgagtgatactgagtttggtcacttggctaagatagtgactcactatttcaattaagaaatccacgtggtcactctgtagcatcctgtaaagatcctgttccccagtgaccttgaacatcatggttttagcactttttgaatatccttgcctaaatctttgtatgagaattgccgagtggtgatttttccaccactgttattctctctacttcaatgaacaagagccgccttcttcctccctgcctctcccttccccctccctctctcctcccctgcccttgtctctgccatagattcctggatttttatttattcaatgtgttataatcacgtgggacaattttatgctcacatttgcccatttttagccagtgagaggccaaattttaaaaacacatattaaatattttttgaacatttctgggttaatgtgttt

SEQ ID NO: 12769 - DNA, 1082 bp, Homo sapiens
ctcccaggtagctgggactacaggcgcacaccaccacgcctggctaattttttgtgttttagtaaagacagggtttcaccatgttggccaggcacgtcactaactcctgacctcaagtgatctgccgtctcaggctcccaaagtactaggattacaggcgtgagccaccacacccagcccatttcgtgtatttttttctattgagttattagtcctccctaatatgatatgtagttgttcttctgtgtatcagtatctacatgacgataagttgcaaatatcttttcccagtttttggctggtggttttcattctttattgcatttttttaaacttttaaatggaaatttgcaaagatttataagagagaaaggactataaggaaccaggtggtgttcctgtcatccagcctcaacagctgccatacggggtgaatcttactgtcccctgcaccctccagaccttcctccctgggttaattgacgcaagtgccagatgccatttcacctgtagcgatttcagtatgtacctctaaaaggcaggggtgctctctccttctctgtcttttcatatttaacatcttattatcacatctagaaaaccccagttccttaacttcatgcagtatctaatgagagttcctatttccccagttgtctcatatttttacatgtttggatcaggatttgttagtctcttggttttagtgatgtcagattggttagtcttttcctttacggctgtatttttagtgccttgttttaacaaaccttccctatcttgagtcatgaagatactttctattttagaagttctgcatttaacacctgagtctttgctgtactgagaattgaatttggtgtgctgttgtcaggccaggtccccatacctttttcttttgggtaaccagttgtcatctaatcactttttgttgaaaagtttattcttttccagataaagtgctatgttgataataagaggtgtttataaaaggggttaggggtgtcctgaaaaatgattcaccgtggagtaaagcaggtaactgaggatgtgagctgagaagccacgcggttgtctggagg

SEQ ID NO: 12770 - DNA, 1049 bp, Homo sapiens
gggcccctgagacagccaaggaaaactctgggactcccagtgcggaagaagccagggggtgctgaagaaatcggacaaggttcctctccagaggaagggtttcaggtgtgaccttgaaaaatgaaaaacaacttcagagggcagaaaagtacgtgactccagtcagtgggaacagcctgcacgtggtccaggggtgggagggtgtggcgcctgcagatgtcagcctagcacggatttctatgctgatgagtgtgcagtttgaggtgtatttttacatatgtgtgtataaaattgttacggagtgtgagaccagtttgtggaaggctttgagtttatcaagtgaaagggagacattcctgagctgggaaggcctgaaggttgtcttgttattgattgaattaaatcaggaagagctaagaaacatcagccgccttggtcactgtcacagtaatgcagggttatgacggctgtatggacatagagagggcgggatggtgagattttaagtcgggagtactgactgaacgcctccttccatcttcttagcagccctatagggtagatattatttttctttttgccatatgggaaataatgaaactgaggcagggagaagttaaataacttagccaggtctcctgcacatgccgtgacggcactaggagttcagtgcaggcaagctgatgccctagcccaccccatgcggcatcccgtggtacagtgggccaaggccagagcgcttctgaagaagccagcacacaggcaccttctccttcctgctgccagaccttcgtcctcatcatgatccatagttctcctttccctctttctcttcctttcagtggaaaaggtatccctccaattttccaaggcaaacacccctctcttctattagaagaaaaacaaaaagcactccctgtctgccctgcaggaatttccctgggttgccacctttcctcctccccaagagctgaagctcttagtctgcctcccactcactccccaggacatcaggacccgttcccatgcctcctccataggcactgttc

SEQ ID NO: 12771 - DNA, 1337 bp, Homo sapiens
agcctccctagtagctgggaccacaggcatgtaccaccaccacctggctaatttttttgtagagacggggtcttgccatgttgcccaggctagtcttgaacgcctgagttcaagtgatccgcctgcctcagcctcccaaggtgctgggattacaggcgtgagccaccgcgcctggctgtgtttatttccatgcaaatgttgatggttcattacttctgtgtgttgccttaaatacccatacaggcttcccttgtgttccagatatgtgtttctgaggatgtactgcatggtttaatttttggatagtggggacccaatttccattattttaagtgggaaaaatgatttttcatcccattccctctccccaaataacccaaccaatctccccaagtatctccaaaatattcttaaatgcctatgtaataatccaccaaagatttctgtacactataaaacatttaagacaccaattaccatgtcatttgccacgataacttactacagggtaggattgtatgcagttaacatcatttttccttcgtgtgctacagcagacatacactataatgcaaatgaacaatgaaataatttaataccccctagacatgtgacagaaacaagcactgagccccataagggactcagccctcagggacaaggcaggagctgctgggctatggccctttctgtccttttctcttctctctgcctttggccacttttctctgtccctgtaccaagaccatattttcttaagcactgtaactttataattatccctgatatctggtaggatgaaactccagctagttcttcaaaattgccttggctgtttttagcttttgctctccgtatagatttagaatcagttttgtcaggttctttggaaaccctatgtgtctgttgattggagccagggattactttgaattggagttctagattaatagggggacatcgccaatgtctcactatcagtctttctgtgaacatggaccactctgtttaggttgtcattactggccttaaaaagatgttatctttttcttcatcaagctaacatcttgttagatttattctttggtaccttccttttttttttttttttttcagttgtaaatggtaatttttaagattacatttttttaagtattaatgatatacagagatgtggttgctatctagatacagtttggatcttcagtgccttggctgaataaatcgttagtgctaataatttgtccattcctggcttttctctgtggataatcatagtatctgtgaatagtgacaatttggtttcttcttttttgtaactatatatatttgtttct

SEQ ID NO: 12772 - DNA, 1051 bp, Homo sapiens
tatagtaactttttttttctgtttttagagacagggtctcgctctgttgctcaggctggaatgcagtggcgcgatcatagcttaccgcaacctcaaactcctgggctcaggcgatcttgccgccgcaccctcctgagtagctaggactacatgccaccacacccggctaattttttattttttgtagaaatgaggtcttgctatgttgcccagcctggtctcaaactcctggcctcaagtgatcctcctgccttggcctcccaaagcgctgggattataggtgtgagccactgtgcccatcctatatgtatttttttaagcttctctctgatggaccgtacattcttgaaggtcagtactatgccttccatctctgagtgctcgatgaaacttatttttccttctgctgtaaggatattgttgtggagtttatctgtttcctcatggagtatcctccatatgcaaacccttgagataaatttttgactaaaaatagatatttctctgactctgtttggtcagtttgtatcttgtgaacactaaactgtaaaactaatcagggtcctctttgcactggcctctagccatttgggagaacctgtggcccagctgtgtcaagtttgcatctgttatatttattttttatttgctttctgcctagttccattttcatatttagtttgttgccctgtctgctactttcattttattttgttatatcgtacacacttttccttggaacagtcttaaatactttctggaagaaggagggcctaaatcagggcttgaccaacttttcctgtaacaggccaggcagtaaattatttcagctttggccaggcatgatggcttacattgtaatcccagcagtttgggaggccgaggtgggcggatcacctgaggtcaggagttcgagaccagcctggccaacatggcgaaaccctgtttctactaaaaatgcaaaaaaattagccaggcatggtggcggttgcctgtaaacccagctactcgggaggctgaggcaagagaattgcttgtacccgaaaggttg

SEQ ID NO: 12773 - DNA, 1035 bp, Homo sapiens
agtgagtgcccaggcccaagtggcccaagcagggggaccagcaaaaggttctagatgcctccccatcttctgaacctcccccagctcaattcctttttcaggctgctcttccatttccttttatgaaagatacaggcaagtaagtctgaagccaggcagataactgttcctcagatttcagtacaactaatttagtattatattacaattcaaagactgctatttccattataattattataagagaatgaaccaattatatttttcttgttaagcaaactacatggtatgttagtgtaatgtgaaaaatagataactgaaagttttcaaatcttaattcttactgactttttgtttccagaaaagctttgacctggaaatactacgcaaaaaaaattctttactacctgcggcaacagaagatcttaaataatcttaaggcctttcttcagcagccagatgactatgagtcgtatcttgaaggtgggtcttttcccatatatgtggacagtagtatttctgtaggtaactgattagttttttaagaccagcagagggaattgtgttccttgtggtaaagaagtgaaaaagcaaatcatgttgcgtgggcttctgcaggttggattatagggcctgatcaatgaggtagttcaaactattaaatttagagctaagattttatcaaagtccactaaagaaatagtgttttttaaagatgcatcattggcttaaaatgtgagagtgatactttagctaatgaagtaaattcctgtttttccgagctttaatgatcatttccaaatcagaagtaaatgtatccaattttgtctccctgtgaccttgagtaaatcccttaacctctcaggttggagtttattgaggacagaatgttcttgggcatcagtgagtctgcttgtccgtaatgaaaggtgagaaggaagaagttgagtggacaggcaagatgaagggagtggagaatctttttgttcttattaagttgaacaggaacaaagtgagacttccattttttttaaa

SEQ ID NO: 12774 - DNA, 1099 bp, Homo sapiens
accctgtttgttttcattcctggcaaatgcttatggtttggatatggaaagcatgggaaggaaaaagtgtagtttccataaatgccaaagtatcagcttgaaatcagtttgtgtttatgatgtgctatgtggtcttaaaaacgagtatgtcctacaataaagattagaaacagcatattaaaagggcatacactgggccaggcacagtggctcacacctgtaatcccatgactttgggaggctgaggtgggcagatcacctgaggtcaggagttcgagaccagcctggccaacatggagaaacgccgtctctactgaaaatacaaaaaattagccgggcatggtggcaggcacctgtaatcccagctactcaagaggctgaaacaagagaatcgcttgaacctgggaagtggaggttgcagtgagctgacattatgccgctgcactccagcctgggtggcaaagtgagactctgtctcagatagatagatagctagattagatagatagatagatagatagatagatagatagatagatagatagactgtctcagatagatagatcgatcgatcgatagactgtctcagatagatagatagatataaatagatagatagataaattcatacattgtacctgagaaaagtgtcacagaatgaccaatactgagacatactttagtaaaattgctggattttaaagacaggaaagtcctttgagcatccaagcaaaaaaggtaaagtcatttataaggaaaagaaaataagaatatcatcagacttttcaacagaattttttgtgccaaaggaaaaaatagcttaagatactcaatgatctaaggaaatgtcaaccaaggatttttatatccagccaaactgacttccagatacaaagactgcacagaaacttaacaacttaacaagaattcagtgacttttcagtccttcctgagagatctcctggaaaatgaatttcaaatgaccaaaaaccactccccgccccaaaaaaaacaaaacagagaaacactgatataaggactggcagtgagcactaaacatgtatttatttttagatttaaattcaaatgagggctctag

SEQ ID NO: 12775 - DNA, 1034 bp, Homo sapiens
tttttttttttttttttttttttttgagacagagtttcactcttgttgcccaggctggagtgcaatggtgtgatctcagcttaccgcaacctctgcctcccaggttcaagtgattctcctgcctcagcctcccgagtagctgggattactggcatgcgccactacgcctggctaattttgtatttttagtagagatggggtttctctatgttggtcaggctggtctcgagctcctgacctcaggtgatccgcccacctcagcctcccgaagtgctgggattacaggcgtgagccactgcacctgccgccgccgcctttttattttttttaaaacggagtttcattcttgttgcccaggctggagtgcaatggcgcaatcttggctcactgtaacctccgcctcccgggttcaagtgattctcctgcctcagcctcccaagtagctgggattacaggcatgcctggctaattttgtatttttagtagacatggggtttcaccacgttgatcaggctggtctcaaactccttacctcaggttatctgcctgccttggcctcccaaagttctgggattacagtcatgaaccactatggccggccagagctagttttctttacgttagaactgtgagttgtcagtttcagaaattccagtctatgaaaacatcattgattacaaacaacaacaaaacctcagtaaattattgttactttatgttattttctacccatgactggtagtgcaaggtagtgtagaataactgttagcactgtctttagtagtggacatctttatttcagctcaaatttgtgagagtgagagttgcatcaatactcataattgaggcctacttgtatatgtcttcttcataggttccttgtaatggcttcagtgacattgagaaccttgaaggaccagagattttttttgaggatgaactggtgtgtatcctaaatatggaaggaaggtaagccatagctttagcagggatttgtttgctttaataagtccagagtaaattgctgtaatttc

SEQ ID NO: 12776 - DNA, 1145 bp, Homo sapiens
ccagccttatctcaccttccaccattcccatccccacctacagctgatcatcaaaggtacacggaggaagtagtagacacggagctcaggccaatcattatcttgagaaatctaaacccagggctgtcaggctatgccccataggccatacccagcctgccaaatggtttttacatgttttaattgaggaaaaatcaaaagaataatatttcatgacatgaaaattctataacattcaaatttcatgtcaataaacaaaatgttattggagcacagtcacctctccatttacacaaccacggctgctcctatgcaactgtgacagagccagctatttgcaacagagacgatgtggcccacacagtcaaaaacttttacaatctggccctttcctaactttgctagcctttgatagagaggattggatatggctgtcaggggaggaacaggagcctttgatagagagggttggatatggctctcaggggaggaacaggaagttggagggggagagaacttgtttcagcggaagaaggccagcttgccccaagatgcagcgggctgcctccggaagtagagaactccctgtccttggatagggtggagcagatgttgactgcttggcctgtgtgatatggaggcaattcaggccctgaaggctggaccaactccctggactttaaaactcttcgtttgctaaggggggccataataacaaaatgtcacacactgagtggcttaaacaacacgaatttattcctcacaattcttgaggctggaagtcccaagatcaaggtgtcagcagggttggtttctggtgaggcctctttctttggcttgcagacagctgccctctgatcgtgacctcacgtggcctttcctctgtgactgcacatccccagtatctcctcctcttctgataaagacaacaatcttattagattagggttccaacgctctgtgattttattcccatccccggctttctttccccacactggttctcaatcttgagtcccgaaatatgccctccctatcctcatcctgtgcctaccttcacttcacccatccatcccctgcaggctggtcttgttccactgtgccaccatatccccaagcccccctcacctccgtgaggctcctag

SEQ ID NO: 12777 - DNA, 1045 bp, Homo sapiens
tcaccatgttggccaggctggtctttaactcctgacctcaggtgatccaccctgctcagcctcccaaagtgctgggattacagacgtgagccactgcacctggcctttgccattacttttaaaatggcaaaaactccaattacttttgcaccaacctaatacattttggtatatagtgtgagtttaaattgaaattcattttttgtgtgtgtgcatttaaatgtacaatttttttctacaccattcattgaaatggtgatttctttctccactgaattgcctttacacctttgtaagaaattaattgtctgtatttatagtctacttctggactctatcctgtcccactgatctatgtgtgtattcctttgtcaatatcacatttttgtggtaactgtagctttattataattttttttttttttttgagacggagtcttgctctgtcaccctgcctggagtgcaatggcgcgatctgggctcactgcaacctctgccttctgggttcaagcagttctcctgcctcagcctcccgagtagctggggttacaggcacacgccaacacgcccagctaatttttttgtatttttagtagagagggggtttcactatgttggccaggctggtctcgaactcctgacctcaggtgatccacctgcagctggtctcgaactcctgacctcaggtgatccacctgcatcagcctcccaaagtactgggattacaggcataagccactgtgcctggcctattgtaattcttaaaattgaccagtcaaatctaggtaaggaaagaaaaaaactgaatagtgtgagttccacctttattattctttttcaaaaattattttagctatttagttattttgtctttttatataaattttaggatcagcctgtctatatttataataaatatctgatttttattgccactacattaaatctgtctctcaactcagggaggattgacatattaactatattaactaactaaagtcttccaaactatgaacgtggtatgtctctccatttatttaagtct

SEQ ID NO: 12778 - DNA, 1032 bp, Homo sapiens
ctgtaatcccagctacttgggaggctgaggcaggagaatcgcttgaacccaggaggcgcaggttgcagcgagctgagattgcatcactgtactccagcctgggcaacagagtgagactcagtttaaaaaaaaaaaaaaaaaaaggtggtcagcctgtgaggacttggccctttccttttgccttgtgttcataaaggtgtgcgtgtgtgtgtgtgtgtgtgtgtgtaactcacaattctaagtcatgataaatgttatgtctgaagggttcactcctccctctgggttttgagagtggattctaccaggcaatttgtaatccatcacctttcaatgagtagaaaactaggaagtctttccacccccagagaatgggtcatttcctgggcttccacccatgtggtcccaactgttgggaagagggatagggcctggccttccttcttgcccaccgtgtgctgctctgggtgtggggacaggggaggtgttgagaggctgaggaggacaggagacacatggtggccaggaaggaggatggagaagctgaaagatgggaagggaaaagggacaaaaataggagaagaaagtaaaaaaatagaacgattttcttcagcagggcttctgtgatgcttggaatgtccttccaatgggtcgtgaccacaaccgtggttgttgctcctttacaggcaggtttattgaggtttagagtcaccaatttgacccaaactgaccgagtaaggcagccgcagacacaggaacagacagaggtttactgctctcctgtggactccccaaaggtgaaatctcctggaagagaagaaagaaagatgaggagaaacagagggcgaaggggaagtgtagacgttaatggtaatgatgtgattagaggtggcagccataggattaatgacaatcacgatgatggaatacttaatctgtctctaaaatgctttccttggtgactattatggatgacaattatttgagagaaatagaggactgatagaaacaaagtagaaacatagagacagg

SEQ ID NO: 12779 - DNA, 1038 bp, Homo sapiens
atggtgatagagctgtaaagaaaataaagtgaggggttgtgaaggagattgactaggggtcagaagagttctctaagcagttgtcatttgagccagacctgaataagagtagatgccagccgaggagaggcattccaggtgaagggcatggttggtgcaaaggcctagggtcagaactaattgagcattggcagagggtagagagaagggcaatgtgttggagccaggggcagggagagaagtacaagcccagggaagttcagattatgctggattttgagggcagggtgaggagctagagttttattctaacagtgtttgaaactgaccactctggaggcaaggagaaccgatggtgcggggctagaggggaagccgggagagcagctggaaggttgcctactgggccaggcgggagatgatgctgcatagatgagagtagagatggagaggggttagatttggcaagtcttttgtaaacagacttgatagaacttgctaatggatttggtttgggagatttaaaaaaaaaaaaacagacgtggtggtttacacctgtaatcccagcactttgggagtccgaggtgggcggattgcttcagtctaggagtttgagaccagcctggccaagatagcaaaaacctgtctctactaaaaatacaaaaattagctgggtgtggtggtgcacgcctgtaatcccagcttcttggaaggctgaggcataagaatttcttgaacccaggaggccgaggttgcagtgagccgagattgtgccattgcagtccagcctgggtgacagagtgagactccatctcaaaaaaaaaaaaaaaaaaaaaaaaaggataatgtagaggaagtgaaccaattgtgaatgttatcaggatggaaaaaaaaaagacattttcatcctggtcatttgatccggaattcctggtctcaagcaattcttccacctctgcctcccagagcactgggattacaggcatgagccactaccccaggccatccaggtcatttgaaaatgtttctctagatcag

SEQ ID NO: 12780 - DNA, 1075 bp, Homo sapiens
cttgctgttttggaatctctgtcattagatggcattctccacctttcagcaagtggcttagtttttaaaatttggtgttttgtttgtttgttcgtttgttttcatcctgacttggctgaaaagtcttgggaatggtgtggccaaaatggtgagagaatcagaacttcctggggctccaggctggcttcagatctttaaaagggagccccttctaaccagacaagaggccaaatacagataatgattactctttcacttaaatgggaaggattgccaggggcaagtggcagtttattttttctataacagctttattcagatataatttacatgccacaaaattcaccctttttaagtgtaccacccaggggattttagtgtagtccagggttatacagccatcaccactaattcatcatttttatcaccccaacaggttctgcccatcttcctattcctgcagcctctttgtattgggtcttgattgtggagggggctggacaattgtgaaacttctcagcaaaatgggttgcatttgcttcttgttacctagtgacagtctaatgcccgttagcacctgtcggtctttttttatgagtcagggttggctgggcgtggcagctcacgcctgtaatcccaccactttgcgagcccgaggtgggtctgagtggaatgcttgagtccaggagttcaaagaccagcctgggcaacatagtgagaccccccaccccaacccgccgcccctccaccatctctaaaaaagaaaaaaacagttttttaccttaaacaaacaaaaagagagacagggtatctctgctgcccaggctggagtgcagtgtcacaattgtggctcactgcagcttcagtctcctggattcaagtgatccgcccacctcagcctcccaaagccctgggattacaggcctgagcaggcacactcacacccggacacctgtcagtcttgaatgggcgtcagaatcacctggagggctcgctaacacacagatgctgggccaggtataatgaatcattcctgtaatcccagcactttgggaggctgaggtgggaggatcac

SEQ ID NO: 12781 - DNA, 1022 bp, Homo sapiens
tcaagaccagcctggccaatatggtaaaaccccatctctaattaaaaaatacaaaaattagccgggtgtggtgttgagcacctgtaatcccaggtactcgggaggctgaggcaggagaatcacttgaacctgggaagcggagattgcagtaagccaagattgagccactgcactccagcctgggctacgaaggaagactctgtctcaaaataaaataaaataaaaataaagctgctatcaaaaaaacttttactgaatgttacaaatctggataatcacaatagagggatctttattgttacataaactttaaaaatacaaattgccaggcgcagtggctcatgcctgtaatcccaacactttgggaggctgaggtaagattattgcttgacccaggagtttgagaccagcctgggcaacatactgagactccatctctacaaattttaaaaattggccaggcatggtggtgagggtctgtagtctcaactactcaggaggctgacgtgggaagatcatttgagcccaggagtttgataagtgtgccgtggcactccagcctaggcaacagagtgagaccccagctctctaaaaaaaaaaaaaactggaaaacacaagtgttaatggctgtatgatattccgacaggggcatattaggtaaacagtaaagactgtagtctatggaagttggtgagacagctcgtcactggggaagaagactaggggtttggggtggacaaaagggtttctttctctattttttttttcttttttttgagacagagtttcactcttgtcacccaggctggagcacaatgatgcattcttggctcactgcaacctccggctctcaggttgaagtgattctcctgcctcaccctcccgagtagctgggattacaggcacccgccaccacgcccagctaatttttttgtatttttagtagagacagcgtttcaccatgttggccaggctggtctcgaactcctggacctcaggtgatcctcccaccatagcctccc

SEQ ID NO: 12782 - DNA, 1084 bp, Homo sapiens
tgatatttaatgtttcacactcccttgaggtgtgggtaattcctctgtagtttcccctcttgttcacgttaataaatctagatgccttttctccaattaatctgccttttgttgagttgatctttctttctttttatttatttatttatttttaacctaaagctggcatctggttccaggcttctttcctcaaaaaatttctaactaggatttcttttcttctcttctctttttttttttttttttttgagatggcgtctagctctgtcacccaggctggagtgcagtagcacaatctcggctgactgcaacctcggtctcctgggttcaagcgattctcctgcctcagcctcccaagtagctgggaatacaggcgtgtaccgccatgcccagctaatttttatatttttagtagagacggggtttcaccatgttggccaggctggtctcctgacctcaagtgatccgcccacctcggcctcccaaagcgctgtgattacaggcatgagccaacgcgcctggtctgtaacaagaattcctatacatctctgaaatgcatgcatatcaaaactcattgtgcaaaccctggctgacattaagggaccaaaatgtctacaaatgtaatcacgtatcgtggcctacacagctaatatggtccaaattacccttaagctcctgctttaaggtccataaatacctggaaggaaaattcaccgcagggcactcagtcctctcatgctgaggagtcccgcagcgcttttatgcagtgttctttctaatatatttttttctttttcaaacctatgctgacatcagtaaattctttgtactaacctacgacctgcgagcccaccacttgccagtgccgggccctgacatctcgtccagcagagacggtcttgttctgttgcccagctagagggcagtggtgtgatcatagctcactgcagcctcgaattcctgggctcaagtgatcctcccaccttagcctcctgaatagctgggaccacaggaacgcaccaccacacccagctaattttataatttattgtaaagatgggtctaaccatgttgcccaggctta

SEQ ID NO: 12783 - DNA, 1008 bp, Homo sapiens
cttgaaactgggaggcggatgttgcaatgaactggggtcacaccactggactccagcctgggcgagagagcaagaccctgtctgaaaaaaaaaattataaataaataattaaaaataaaaattaaattaaaattaaaataaatccaggaagcacaatgtttagccaaaagaataaatctatggctgcagaattttgaacagaaacaggccagcaacaaaaattatttgcggccgagcgtggtgactcatgcctgtaatcccagcagtttgggaggccgaggcgggtggatcacaaggtcaggagtttgagaccagcctggccaatatggtgaaaccccatctctactaaaaatataaaaattagccgggcatggtggtgggtgcctgtagtcccagctactcaggaggctgaggcaggagaatcccttgaacccaggaggcagaggttgcagtgagccgagatcgcgccactgcactccagcctggtgacagagcttttttcaaaatgggggactcactgtgttgcccaggctgttctcaaactcctggcctcaaaccatcctcccaccccaacctcccaaagtgccaggattacaggcgtgagccagccagccttattgtggttttgatttacatttctctgatgatgaatgatgttgagcattttttcctgtttgttggctgctaatatgtcaagaagtgtatttatattaataattatcaattatttattatctcctccctgctggcaacttttactgactgccataaactgaagctcagagaatggaaaaatatctcttcctaaagacacagagaaacataaacaaacctgaccaatagaaggaccaaaacctctgcacagtgcctcacccctcggaggaattaacaaaaatgtaggtagctgttggaacaaagaaacagtagtccagagcattttgtgtgtgggataaaggtcctctaatctatctagttcccacagatagcacaggacagacaccaatgttc

SEQ ID NO: 12784 - DNA, 1088 bp, Homo sapiens
atattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcacatcgccttgctgtgttattgtagcaggaagtttcccttctaggttcaccagttcacaactcagagggacagccaccctcctgaaactgttctccatagcctcggtcgctccaagaagagccattcaagcctttcaggtaaagctctgtcttccaagttcttctatggggctgaagatagtgttgcaccattcgatgtgggcacgtggtcaactgcacctttctgtcctaaa

SEQ ID NO: 12785 - DNA, 1035 bp, Homo sapiens
caaccctcattgggagccagtaaatcctttggcatttacctgtgagtctgttcctgccaaagactatgtattgtgtctagtgtctcttatcccttcattccttactgggaaaatgagaactgtctgtcctctttaagggttttaatgaaacctggttaggattaatttttagaaggtaccttggaaatatgattatgtaatttattttgttcctttaatctctatagtatgtttctccagaagtactaaaagaagatacatgcaaataactaaaactattttaatataacatttcaaaaagtaatttttcaatcaagatatgtatattgtcacaaattgtacataaggtggagaataagtatcttggaaaagtggtcaataaggaaacacagataagctcagggtaaatggactgattcaagggttctaatctcatagttctcagccaaactgtgggcctgccaaaattggaccaaaccaagcctgcaacccagggtcatcattcctaaacactgtcctgctgatggtccgaaaccttctactctgctttgagaagttggcgcttctacttggttcattctccacgcaggatctgggtatcttgtataagacaaagttcaggcactgcttcaaagcagttatgcctcttaaaattgtcaagcctacctaccctctgagaggaagagattttttttttatgagacaaagtctctgtctgccaagctggagtgcattggtgtgatcatagcccactgcagcctcgaactcctgggttcaagagattcttctgcctcagcctcccaaagtagctgggactacaggcacatgccaccatgcctggctaattttttaaaaaatctttgtatagatgggggtctcacaatatttcccaagctagtattgaatgccaggcctcaagcaatcctcacaccctggcctcccaaagcgctgagataacagaggtgagccaccagccagggaagagattttgaaccatttggagttttggattggctggctagcaatgtaactttt

SEQ ID NO: 12786 - DNA, 1048 bp, Homo sapiens
agtgatactctcctgtttctgatgattcaacatgcaactgtggacaattaatttcctttagctttgctttcatttcttcatgtgtaaaatcaggctaacataagctgttttgtggattttgtgaataattctattataaaacatttgtaggttgtgatgcttattgaattagatattagtaataagcctttaataagtaatttcaagaaacatcccttgctaccgtctacttccccagaccaagaaaaatcttaatttattttagttgtccaaggtatggttagttacaggttataggaacattatgggtaactattatctaaaatcttagcattgtttattttcagaattacacttgcttatataatttagccatattttttctataggctttaaagtagtcttaaattaagggactagatttttttttaatgtcaagcccttattttaatctttggaatttagtagcttaataaagctatgtctcaatgtttaattattctgtgcctgtttcccctggcttctgtgtgccttttcagtctgtagcttcaagtttattttcatttgtagaaagttttttaaaattatagatttacaattatatttctatttttcaaggaaactgattttgaatatattatctttcaaatctataatttactctagtttttaaaaactttattcaaggtgctgttgttttgctactttcctcaattctccacccatgtcccttaccacgtctccaccattgccagttctttgtgctgcttcttgccagcttcatttcattagtggttttatttttctccccacatctctcttgacttctgccaaatcatgttttattccctgttttggctcacgatatcttccattaactcttacatccctgctgtgagctcctgttttatataacagtaacttcattgagttccttttttcttaaagtttattggcagtatgttctgacacagcatccattgctatatgacaacttttattctctgaaaagagttcttcacctgccatttctttttcccatttctta

SEQ ID NO: 12787 - DNA, 1028 bp, Homo sapiens
gggaggctaaggcaggagaatcgcttgaacccaggaggcggaggttgcagtgagccaagatcgcgtcattgcgctccagcctggtgacagagcaagactccatctaaaaaaaaaaaaaaaaaaagttttatagctttatatcttatttaggtctcggatctattctgagttattgtttgtatatagtataaagtaagggcccaacttcatttttttggcctatggatatccagttatcccagtaccatttggtgaaaagactgacctttccctgttgtcttggcacccttgttgaaaatcaatttgctgtagatatgaatgtttatttctgggctgtcagttctattccattggtctatatatgtctgtccttaggccagtactgcagtgttttgattactgagctttgtaataagctgcaggaaatgtgagtcctccaactggtttttgttttttttgtttgtttgtcttttttagattatttttgctattctgggtcctttgaaatcatatggattttaggacaggtttttccatttctgtacaaaacaccattgggattttgatacaaattgtattggatctgtatattgtttggagtcatattgtcaccttgacaatattaagttttctagctcctgaacacataatgtctttctatttatttaggtctttaaaaatttctggctgggtgcagtaatcccacacctgtaatcctagcactttgggaggccgaggcaggtggatcacgaggtcaggagatcgagaccatcctggctaacacggtgaaacccgtctctactaaaaatacaaaaaattagcttggcgtggtggcaggcgcctgtagtcccagctactctggaggctgaggcaggagaatggcgtgaacccagaaggcggagcttgtagtgagccaagatcgcgccactgcactccagcctgggcaacagagcaagactgtctaaaaaaaaaaaaaaaaaaaaattctcccagcgatttttttttttttttttttttgagacaaactt

SEQ ID NO: 12788 - DNA, 1045 bp, Homo sapiens
tagatgtctttattccttgtaaaatgacataaaagcattacctacaataaattccaccccattttcttttcataaaaaatttttcttctcataatccatattccttattctctgctgtgagaaaagagctcttaaaattgtcacatgatgtcaaaagaaaacaagggggagaaggagtcactttactgtgcctacaatgaattttatataacacctttacttttcttccctttccaacctgattaaaaatttttttgctcttgggagggaaggtggggtgtccacaggcaagttattgttacattatagttaacattcaactgtatctgcatcttatcacaaacaaatacatgtatatatacacagaaatatgtggaaagtacttagtcactctccatatttcaggcatatggtttattctctccagagatcaatatcttagttactgaagctgtatctaattttttgctaaaatagttattttgtgttttaagagaaataagtgtaattcctcagtagcaggaatggtatgtggaagtgatcgttttttggtggttaagatattaataatttgacaacatgcaagattttgtgaaatatgaatagtagtttattatttcaaacttttaaaagttgggaaaagaggaatttcaaattaaaatctataaagtattggaagaatctatagaaaagagcaactaaagccgggcgcggtggctcacttctgtaatcccagcgctttgggaagccgaggcgggactatcctggccaacatggtgaaaccccgtctctactaaaaatacaaaaattagctgggcatggtggcgcgcctgtagtcccagctactcgggaggctgaggcagaatcgcttgaacccgggaggtggaggttgcagtgagccgagatcgcaccactgcattccagcctgggcgacagagtaagaccccgtctcgaaaaaaaaaaagagcaactaaaatgcttaataaatatctctctttcaaagccctctgatatgattcattacacagatttaaagataacaatg

SEQ ID NO: 12789 - DNA, 1032 bp, Homo sapiens
cacaaagccaaaccatatcaccttggtatgtgagaataaaaattttactggcatcagtaatattcaaagattgaagtaaatgcatcaatgctttcagtattcatagtaaatgttattttcaatgttcaattatatatctagggaaactgtctgttgagttcaaggatggaagaaggatattttaagatctgcaaagtatccaatatttcctaagtacctttctcaaaatgttgctaaaggaagtgttccaggaaaacaagtgggaaatccaaaaaagtgacaggatatttggataggagatccaggagagaagtgaaagcctcaggacaattacaaaggaaaatccgaagacaatagtcatgcttcaggccttaaatgaaaccaattcattttgaagcaggagaatggagagtccaggaaaagagaaggagagcaagaggaacaagggacactgaggagaaggaggaagaggaggagaaaggaaaaaagaaaaggaaagaagaagaatgaggaaagaaagacaaagaggtagggaggatgtgagaaagggaggaagagagaaggggatggggcagggtgaagagaaaggaaggaaggatggcaagaagggagggaggaaagtaggagctggtagattttatgatgcttttgagcaggtggaaaaatagtattgagatttttgcattgtagattttaggagtaactaataataagtacatagtaaataaaagcaagaggaaattattattattgttttagattcagggagtacatgtgcaggtttgttacatgagtatataatgcaatgctaaagtttgggcttctaatgatcccagcatccacatagtgaacatagtgcccagtaggtagtatttttggcccttgcctccctctctgcctccccacttttggcatccccagggtttattgttcccacctttatgtctgtgtgtacccaatgcgtagctcccatttttaagtgagaacttgtggcatctagttttctgttcttctgtgaatttgcttaggaca

SEQ ID NO: 12790 - DNA, 1029 bp, Homo sapiens
gtacacacacggctttgggattttccagtgagtttcactccctggcttccccaggctctggagcgggtgctgccctgccaagcactcactgctagctgctgaaggggatagcccaggggctgcagattcccatttgcatcatgcaaggtgagcacagcaacttctggcctcggatggctaacactcctccttatttcactcctaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtca

SEQ ID NO: 12791 - DNA, 1043 bp, Homo sapiens
gtcttgaactcctgggctcaagcaattctccttccttagccttcctaatagctaggactacaggcatgcatcactgtgcccggctttttcaaatatttttgaagagccttctttaggatccactgcaaaagtccaatgtgtccaacgttggtgtcagagcatgttagcagcaattttgttgagacaattagcacaaaacaaatcattctgtgattcatgcttggttcatttttggaatcagcatgtaattgcattgtaatttaaatactaaaaatatctagcataaaataagtttatattccaagataaagcctcaatcaaacaaaatatgttttcaagtaatattcactgtaatttttttcctccattttaagtagggccttttccaagcacaaattatgctgagataatagggaccctagtacttttagagctgatcaagggtgggaaagaattgactcagaaggccacatttcagttctctctgtgtttgtaggtcttactacatcttcagagagggagtttggcccctgggtctgctgaaatcttcatttgaaatatccaggccaggagtgggtggaggattgggttgggttgtacaaaaaggccgcagtgttttcaactgcttggttactaattatcaacctttgaggcctgggacgttttctgagcccgctttactttgtctgccctgctcagtttcctgactctatcaggcctgatccctacacctctcggtcgtcttattgtcatgactgagaaccatccaccttctgagcatctgcatttgcatcaggtgtcagagactcttggaaagccacatgggggcagaggtgaccaaacacgaggcccaggagtgggacagacatggcagttaacagtgatcagtacagggtttctccaaactgcttccttgcactgagggcctttgtgggtccctgacttctgggtcttagtaggctgacctcctagttgatgacttccttctgtgccttctaggctctgggaaatagtaggtcagtaggatattatatggggcttat

SEQ ID NO: 12792 - DNA, 1078 bp, Homo sapiens
ctcttccttattttattctttagagcagttttagattcacagcaaaattgaaaggtacagagagttcccatatacccccgttctcatatatgcatagcctcccccactaccaacatcccccaccagagtgatacgttcgttagagtcagtgaacctacattgacacattgacagtgacacatcattgtcaccccaagtctacagtttacattatagagttctttcttggtggtatacattctatgggttttgaaaaacatataatgacatgtatccacacatagagtatcatatagaatagtttcacatactataatttctgcatttaggaaatttacccttactataatacaagtatccgctatgctgcccataattggattttacctgtggcttctataatgtcccagaatttgcattgcatttaatcatgtctctctagtctcctttaatctgaacggttcctcagccttttgtctctcctgacatccacatatttggatagtccaagtctgttttttcatagaatgcctcctcattcctccctcacacattcgttctttactttgctggggagcatgtttgaaagtacagttcacattctccaattttatgtctgcagaattccaccctcctcagaatcttgactaaaaggccaaatgttattgtcttagatttaaatcatggacttgggccgggcgtggtggctcacgcctgtaatctcagcactttgggaggctgaggcgggcagatcacaaggtcaggagtttgagaccagcctgaccaacatggcgaaaccccatctctactaaaaatacaaaaaaaaattagccaggcgtggtagcatgcacctgtaatcccagctactcaggaggctgaggcaggagaattgcttgaacccaggaggcagaggttttagtgagccgagattgtaccattgcactccagtgtgggcaacagagcaagactctgtctcaaaaatttaaaaaaaaaaaataaataaatcatggacctaaaatgtgtttatatggatttgtggaaaactcagatcatctgtgtggcctcttgtgacttttac

SEQ ID NO: 12793 - DNA, 1047 bp, Homo sapiens
ttgaaaccagactgggcaagatagcaagatcccatctcttaaaaaaagagaaagaaagaaagttagccaggtgtggtgacatgcacctgtagttccagctagtagggaggctgaggccggcggattgcccaggagtttgaggctgcagtgagctacgattgtgccactgtactccagcctgggcaacagagcgaggcatggactgtaaaagcaaaggaaaaagaatgggggaatcggcatcagtagcctactctggtggcattgtagaccttggttgtggtgatgcagcagcaaatgtacttataaggaaatcctctctcctgtttactcaaatgagtttgtctggtttgaaggcttgagttagaagcactttggccacgaagcagcacaataggctgccggcagctgtgtcccctccaggaaggcttttcataagcatctcagttgtttttgcagtatttgctcttccgtaggcaggtttggagtcctacttatccttaagctgttagaaacgtaggtgtgctgtgattggcatcaccccacctaaaatgttccaggatacaaacagtgctcattgctcattgacgtttgctccagcgaagaccaaacagctcttttcagactcttcactcctaataaacactttatgtgttagcaattggcagattcttaaccacaagcctcctgaaaagggctttactcagtggttagacctgtttggatgacttgttggtcgtttcacacgtgagcttttactgaaatccttgttaatatgtgtacaataggcccgcgactgtgtttcttacgagcttctgcctgcctgggttcaggtaaagagatgcagaggcgtgctggctcgctgctaacacggcgcctttgcacttctgctgcagccttatgggggaaggagtctttcatgtgtcttattaaccctgcgcaggtgaaatctccttagcttcagcttatttcttattacagaatagctttccatgtctactaccctcccttatttctgcatcccagccaaattataactcagatgctaat

SEQ ID NO: 12794 - DNA, 1030 bp, Homo sapiens
caacactctgtactataactgggatcttcttcttttcccccaacgttgtagaaatatgtctcatgattgtggttattcatgtacttgttggggtctcttaccctaatgggacctttattaagtaagggatgatatgatttctctttgtgtatcccacactgcctgcatggagtaatttctcatagcaacaattaagatcttgaaaacagaaaataaagacattggaacttagttgtcatggcactgagtcgaactgccttagatgtcaactcagatggctcatgccatccaaaatatcctcaccttaatgtaccaaaatatcctcaattggaactctgtctgggaaggccatccctgcagcctggacttcctgtgacggtagggatcctcggacttgttggccagcagaggtttctgtgcaaattcattttaactgtgcttgcatccttttggaatagatgacaattggtaattctgaattgagatgatttcaaaagctgtacttctggtgccatgcctgaaattagtttgaaataggaacagcaggggaacaaattgtattgtgtgcagtatcaagcatttccctggcccttctccccactagcaagccaaattacagcagcagatggacctgcagaaaaatcacattttccgtctgactcaaggactgcaagaagctctagatcgggctgatctactgaagacagaaagaagtgacttggagtatcagctggaaaacattcaggtgaggactggcagagggaatctgcttaaaaatggtctgcacggctgggcgcagtggctcatgcctgtaatcccagcacttcgggaggctgaggagggcagattacttgaggtcaggagttcgagaccagcctggccaacatggtgaaaccccatctctactaaaaatacaaaaattagcctggcgtggtggcgggtgcctgtagtcccagctactcgggagactgaggaaggagaatggcttgaacccgggaggtggaggttgcagtgggctgagatcacacca

SEQ ID NO: 12795 - DNA, 1099 bp, Homo sapiens
tttggttgtctttggggtggggttatggtgaaattagtcttggagagtgagtagctgtctgatgcttcttttcctttttaaccagcaagagcccaaaccaaatccccaagctctgaatgcctggctgttcctctcagcctttctttgcttgaacttgacaatagtagggtagtaacaggaaacagcatgttaaagttttaaaaataaaatagatctcagctcttttccttcccattagcaaggggtacatttatttaggtttttccttctagattgaggcactgcctcatttaagttcttggtgaagccgtgcatttctgcaaaccataagtataaactctagaacgggggtgtccaatcttttggcttccttgggccacatgggaagaagaagaattgtcttgaggcacacataaaatacactaatgatagctgatgagctaaaaaaaaaaaaactcataaagttttaagaaagcttacaaacttgtaagttttgagccacattaaaaaccatcctgggctgcatgcagcccccggggccttgggttggacaagcttgctgtagaaggtaaaaatcagttggttttatgtttttgttttaaacatgctggttgtatgcttttggaagagttggggaacactgagggtaatgggatcttgatggggctggaatttgtgggaagatggtgtctgggtaggctgtttttaggaaggggcactctcttccttttgattcagagatttttcctttcttttcgggtggttctgaaaacacagcgatggatccaggcattcaaacaccatggaggaaggaagagtggctgttgccattgcttcccgagttttctgggaaccagtttttggtgcctcttccttgctctactggggcttctctgcatgtcagtttcttcaactgcgaagtggaaggacagcgatacttttcttacaggacttttgcggggatggatgaaatacgtaaaacacttggtctagtacctggcacatggaaaagccttggtaaatgttcactgttgttatttttgttattactaatacactagtccatgtatgtatagtgtcctcctatacacaccaagag

SEQ ID NO: 12796 - DNA, 1025 bp, Homo sapiens
gcagtgctcttctcaaatgaaaaccccttatggcttttttttttttttaaacaaggccacaggtgatatcatgattttgacattattttttcatttattttgtttagtgtcctgcctttagaattgcattatctcaatggcttgtgcatttagtgtgtgtgtgtgtgtgtgtgtgtgtgttgtgtgtgtgtgtgtgtggtatgtgagcacgcacatattcgttttgggccctttttttttttttttttgagacagagtcttcctctgtcagccaggctggagtgcagtggcacgatctcggctcactgcaacttctgcctcctgggttcaagcaattctcctgcctcagcctcccacgcagctgggattacaggcatgcgccaccacgcctggctaatttttttgtatttttagtagagacgggtttcaccgtgttggccaggctggtctcgaactcctgacctcaggtaatccgcccgcctcggcctcccaaagtgctgggattacaggcgtgatgttttgggccttttaaagttcatcttgtttgtgtattcatttgtttggggccttttaaagttcttcttgtttgaggcttcctgtcatttgaagggttatctggtcatgttttgttttctaagctagttccatgaggatcatagatatgcttctctgttaggcttggttggcccttaaacttgtcttccttttggacactcacttacttcaggggcaggaggaagtgaggaagaggagttgggtctgtttggagtatcagcatggacgggaaggggagcaagagggatgggatggtaaagtagtgatggtagaaattcaacttactagaccaggagcgtgtgggcgccacctactaaaacaaaaaaggaataatgaagagctatagtcagtagctcttataatctcttatgggatatgtaggcaaatatttatgtgtctcttgggggctgttctgtttttagaaggtaaatgattggtaagaaaaaataggccaaaaagagctaaatgct

SEQ ID NO: 12797 - DNA, 1047 bp, Homo sapiens
agctgcaacaataactatgatgttgcctgcagagggttagtttgcaacatgttttcacatatattctcccagttttcataaccaacctgtaggtgaaaggaatatttgtcatccccacctcacggataaagaaacagaagttgaggccgggtgtggtggctcatgcctgtaatcccagcactttgggaggccgaggcgggtggatcacctgagatcgagggttcgagaccagcctgaccaacatggagaaaccctgtctctactaaaaatacaaaattagccaggcgtggtggcacatgcctgtaatcccagttactcgggctgaggcaggagaattgcttgaacccaggagaaggaggttgcagtgagccgagattgcaccattgcactccatcctgggcaaaaagagcagaactccgtcacacacacacacaccacacacacacacacgttgaaagagcagaactccgtcacacacacacgccacacacacgttgaaagagcagaactccgtcacaccccacacacacacacatacacacacacacacacacgttgaaaaaggacaatactaaaataaggactggaacccagaggggatcaaaagcctcacacagcataaaggagctactcatcctttcccaaaatggcccattccccactggaaggcaggaaccttgtcctgctggtatagaagggattccttgtagttagcaatcccccttaggggaactgtcctgaagatacagaggtgtgcgaagatagccacacagtggtgatcactatagcttagctagtcagagtagccaagtggtcatgaatgatgggatggaatacagtcaccagtaaaaaccataaagtaggccgggtgcggtggctcacccctgtaattccagcactttgggaggccaaggcgggcggatcacgaggtcaggagattgagaccatcctggctaacagtgaaaccccgtctctactaaaaataccaaaaattagccaggcatggcggcaggtgcctgtagtcccagctactggcgaggctgaggc

SEQ ID NO: 12798 - DNA, 1049 bp, Homo sapiens
ttcctcttggtaggtgtcagttatggcagctggagttggcctgtgcaggctcccgtcacctgcactgatgccttggaagtgacgctgtctagagacgaacacggtgcatgtcagcaggcccttccctacccttaaagctgttcctgggaaatccggccgcccaccggttgcccacctttgtggctgagctgcaggccggggggaagctgggctcctgcgcagatgggcagtgtccttcggagcggctcctggttattgggttgttagtggagcaggttttaggaaagagcagggtctgaaggggccgatttggagctgttgggctgtgtgtccttaggcaagttgccgaagctctctgcgctcgtttcctggagggcctgcctctgggattggcttccatgtggagggtgccaggtgctctgctgcaggcgtcaacgtgcgtgccggggtgtggtgtctggcagctctgtgtgcttggtgctgctgtcatcccatttgacagagggcgccctggaggggtccctcccagcggccaagcctgtgctccacacagtggcctgtgcagagtgaggggcggctgtctggctccacgggcacctccttggctctctcgagcagctcctctggaagtgacctcaggaaggcgaatgaggaagtcccagccagcggcccccttccttcccacagcatgaaagcccggcactccccaggctggctgcccctgcccccgggcccctcggcatctcccgagggtgggaagtgtggggtgcagcgcccccatggatggctgggagtatgggggagagcagggctgctggagagggacaggtgtgctgggcgagcagctcctggggctggagccaaggcggagggcttgtcactgggttcaccctatgctgagcacatttgtgctgtggcccgtgatgcccggaatccctgggagctcccagtcccggggtcgccctggtgtggtgctgtgtggtgaccgttgatgagccctgtgagcgagggctctgtggcctgcatgtcttggcagctgccagtgagaa

SEQ ID NO: 12799 - DNA, 1030 bp, Homo sapiens
aaggttagagtgagttatgatcgcaccactgccctccagcctgagagacagagtaaggccctatctctccaaaaaaaaaaaaaatgctgtgggcttctcccatgaacagacacctaggctcaaatctgcactttgtttcagggggtttcatagctttcgtggcattttcattaaaaatctaacaggagtgagatgttggagcccccacaggtcattttttccaaacttcctgaaccagacgcaagactcccagcaatgtgtattgggaggagtgttagcactctggaggagtccggcctggatgcagatctcagctttactgctgctcacagaggcacttaggccggccactctgggcctgaggttcctcatctcaagagatgtggccagaattataatcaaagaggcatccaagggctcaccacacacacagcccgatgcatgtgaattctttgtggtcaattaacttggctggcctcaggggtgttggagattggggacaggataggaggacatggaacaggtgtacttggcaggctgaaagcactgtgagttgaagtcaaggggagaggtccaggcgcagtggctcatgcctgtaatcccagcgctttgggaggcccaggcgggagggttgcttgaggccagaagtttgagaccaacttgggcaacatagcaagacctcgtctctacaaaagattaaaaaaaaaaaaaaaaaaagcctgggcaacgtagccagactctgtccctactaaaaataaaaaaattagctgggcatgatggtatgcacatgtggtcccagctactcgggaggctgaggtcagaggatcacttgagcctaggagttggaggctgtggtgagacatgattgcaccattgtactccagcctgagtgactgaatgaaaccccatttttttttttttgagacagagtttcgctcttgttgcccaggctggagtgcagtggcatgatctcagctcactgcaacctccgcctcccgggttcaagtgcttctcctgcctcagtctcccg

SEQ ID NO: 12800 - DNA, 1003 bp, Homo sapiens
tttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctgacccctgtcagatgaaaatgattcacagctctggcagttcccaagtctggggaggggtataggtttgaaaggctgtttgaaagaggaatgtttaataaaggctttgatttaatcttgatataaacagatttttaaaaatctccacccattaaacatgaagcttcctgcatcaggaataaggaaaggtttgtacctgtttttgtaagtattcacagttctctgatttctggacatatctctctcctgctttcgaaagtcttagcattccctgtagacgtctgtcctgaggttgggttttgagaggtgtgcagcctggcctgtgatctcccccagtgtggagaatgcaaaggtcgaattagccactttcctgttctgttctgacttggaaaggtagggagcttctggtactcaggttgtaaagagaaatccagcccctctgtgaataagaaagggccacattcctatagttgaaggacttggaagaggaagccaaagttgcatttcagcatctgcctcctttatgaatgacttccttcctcctgattcttagaaggctcgtgacacacacattctgtctgatggagcacac

SEQ ID NO: 12801 - DNA, 1049 bp, Homo sapiens
ttttaatttttttaaaatttttagtttaagacaatctcactctgctgcccaggcaggagtacaggggcaccatctcttttggctacagcctctgcttcctgggttcaagcgattcttgtgcctcagcctcctgtgtagctgggattacaggtgtgcaccaccacacccagctaatttttgtatttttagtagagatagggttttgccatgttgaccaggctggtctcgaactcctggcctcaagtcatccgcccaccttggcctcccaaagtgctgggattacaggtgtgagccaccgtgcccggccccttctctccttttttttatttcacagtaaagagttaagttaaaagacaagtcaggcaaagagagttagggtggcctagctgggtcagagtcccctgcctgtgcttcttgtctgcttctgctccttctttgcctttcctgcatctggtacagttgtagcttgccattgcaggtgctgtatttctctgaatccctcgtgcccacggcaaggaaggctttgtgtgacccactggaggaggtcagagaggcggcagccaagactttcgagcagctgcattccaccatcggccaccaggctctggaggacattctcccatttttactaaagcagctggtgagtggatctaccacacacctacctaccagtttggcttttgccgtctttgtagatggaaaatacagggcgattattctgccaaggcagtcgcaatgtgggccctccagagggagtgggtatagcaagatcagacttggctttgtgcttcgccttcggcagtgaggaaatgtgggtgcaacaggagggagggaaacaagtggagaaggaagttggcggtggctggttgagacagcagagatgcagattcctcagggttgtccccaacaccctctgcaggatgacgaggaggtgtcagagtttgccttggatggtctgaagcaagtcatggctattaagagtcgtgtggtgctgccctaccttgtgcccaaggtaaatcccaacatgtggtcaacaccctctggctcca

SEQ ID NO: 12802 - DNA, 1640 bp, Homo sapiens
tttcagcacgttagccaggacggtctcgatctcctgacctcgtgatgcgcccgtctcggcctcccaaagtgctgggattacaggcttgagccaccacgcctggcctctgcaaatatttattagcatctcctgtgcactaagcaggggcctagcacctggggacacaatggagaagaaaggcagcttcattccttatcctcatgagaggtagtctagtcgaggagatggatattaatcaaataaccacacaaagagatgtaaaatgcgactgtggccagtgctgcatggcactgcaaatgcttataatagctgcatttgacctgctggggagggatgggcctgtgttagtgaacacttctcagaagaaatgatgctggaagatgaaagataagtaagcactaaccaggtgaggaggtggcgaaagaccattccagacagagggaataaataatgtttcagatacaaagacaggatatgcagaggtcccgtggtgggcaggaacatagcaccagtaggggctgagcaaggccagtgtggctggagtgaggaggcagggaggagcagtgcggcatgagatcaggctggcgcgctggcaggggcagacagatcagtgggcctggaggaggtgcccagatgggctggtgatcatttctgcccatctcctttggtctacttccaaccccccatccttggcaagcaaattgtgtatttggctctaaagaagggtttgcatgaggtctcagaaagtagatgtttttttttccttaaagctttgttccagattcggctcctgctcagccatagcacagtgttaaggcttcagtcatccagggaaattggcccttgactgtgcagcagatgatgaattttttgtacatgtgtaaggtgctgctggctcttaatgttaggttgtgtaggtgtgtgtgaaacagataattttttggtagtgttttgcaagcactacagagagtatttgggggctctttaggggtaagagcatttggggaagttaagtcagtgattcagataaagcctgggaggtttcagggccctcattctggagtcctcctctgggtgccctgggctttgcagggactttacttcctggattggtctctgttgacagattgcagcgagaacattgggagatcttgtgcggaagttaggggagaaaatcctccccgagatcatccccatccttgaggaaggcctgaggtctcagaagagcgatgagaggcagggtgtgtgcattggcctaagtgagatcatgaagtccaccagccgggatgccgtgagtatcttccaaggatcccgccagctgtgcactgcagacgacctgactcagagggcgggggagggctactgaaggaggttcacctctagggggtttgtgctgccctcagggatgagccagtctcactctggggaggtgctggctgggccacatggacttgaggctccgtcttctcagctttcctgtcagttttgcaggctaagagctaagtgatttggatgcctccttgagtggcctttggaaactggagatgatcgctctcttacaactgtggaggttgctcaggatcagtctcttttgtgatgctatataagtccagttaaaatgtgtgcacctccttctggga

SEQ ID NO: 12803 - DNA, 1053 bp, Homo sapiens
atagcttcttccacccacaactcaaaaccggtttctttctctgctgggtgctggcgacagtgcacgtgtctcctctgctaagtggtgttgctggattccatgtctgtccctccacttccttgaagactgggacccatctagactcctgatagcaggcacagcgcctggtacagtgggacttctggggaatcatgacttgattgctgaattcagctttgggcagagcaggttctgacaggagcagagcacacaggactctttccttctcagcgtttgctcttctctctgtctttacaaggcaggattcttcttgtctttctcatctcagtccacatgtgtgcttctcagagaggtggccagcttgtccaccctatccaaagtagaccccacccttcctcccttttactaaacatcatatttgtttctttactaacatttatcataacccaaaagcatcttgtttatgtgcttgttgacttgtttattatctatcttcgcctgctagattgtgagctccgtgagggcagggactttatcttgttcctacgatattcctgccatctggaacagtgcctggcacaatccaggtgctcactaaatgtttgctgaatgagtgagtgagttctgtggcttgttgtctcaggccactatagcaggccttttctaagcttcagcttatcctgtgggagagcttatgtaggaaggggttggagaggaggaggctaaagttttgattctgaatccatttggctgtcagaatacccttttgagtacattgaggaacctttatttctctaacataaaaagccctcttagcctttgtcagtagagaatccagtaaaacaactacttctctattgctgtctccattctatagaaaccaggtggctgtggactttgtgggaggttgggggtgcacatggtgggttcaggggcccaactcacacttagagctggtatggtgctgtttgtgtggaagcaagctcaccttcctctgttggggagggaggtctgttccctggagatgggattggttggtttgcccatcctctt

SEQ ID NO: 12804 - DNA, 1062 bp, Homo sapiens
tctccacacaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttaggtccgtggctgcggtgggtgtgggagagcccagagctttaggggatggggtaagagcaggccaggcagaaggcctcaaagagctcccttccccttcagttgccgtgcagtctggactttggccagcacttcttgccaggatgaagatcgatcctgaagcctttatcaccaggcacctggatcagatcattcccaggatgaccacacagagtcccctaaaccaggtgacgggcacatgagctggtctggcctcaggtccgggagggggccctctcatcacagtgtacaggaagagaggattcaaagaagcaggtgaagatggatgaaatgtaggcttggacccttggttgcacgtgacagaaatgtaaactggtttaagcacaaaagggaacttactgcctcatttacctgcaaagtccaaggatatgactggctacaggggttcacatgttgcccttggaacattgtaggtgatgtctctcttactctgtcccatccatctttgtctgttgtctctgttttccacgatgtgggctccattctcaggctttccctttctggtagcacaagagctgctagagttccaggctttgtcttgccatcagctcctaggggaatagcttgcatatttcaataatgtctactggcttggggtcgctttgaccctgattaatctgacttgggtgccatgctcatctctgcacccatccttctgttctgggtcacatgcctacctctggaaaaagtgagggcagctccacctgaaccacggagattgagaattgggaaggagtgtatcacctcacgtcaggtgctgtgtcagacagaggagcactgcttggtgaggaaagcagacgcagac

SEQ ID NO: 12805 - DNA, 1064 bp, Homo sapiens
tatttcaggctttcttttcttttttttttttctttttttttttttttttttgagacggagtttcgctctgtcgcccaggctggagtgcagtggcgcgatctcgactcactgcaagctccgcctcctgcctcagccttccgagtggctgggactacaggcgctacgccgccacgcgcggctaattttttatatttttagtagagacagggtttcatcgtgttagccaggatggtctcaatctcctcaccttgtgatccacccacctcagcctcccaatgtgctgggattacaggcgtgagccactgcgcccggccaggctttctttatttcatctcccaatctctgcactgggacacacctgaacttaactcctttggttaggaatggagctcagctctcctcatgtaatatcgtgtgctcactgtggccatgcaaggcactgggctacctgggggaatgctaagatgaacatgaccttcttcagcaaatttcagggtgcttacttcacagtaggcgcgaggaaatacagaaatatatccgtagcttaagacaaaatgcggcattagagcagttttgaaggagagattgcttttagttgggggggtgggtattgggaagggcttcatggaggaagcatttgaactggtaccctgaagcctctgaaggatttcattatcctgaagggatggcccagtgtgagtccaaacagccccagtcagggaagggcagggaaagccagagtctgtaaacctcaggtattccagcttggcgcctggggtggatgggaattccggatgagaagcagttcacctaggatcctgtaggcagcagagagccaccgaagagtttcgtacaggaggtgataccagaaggactgaggtcagttccccaaatggaagagcactgagcctcctgctgcagaggagggtttgtcagcaaagcccaccccagcagcttcaggatggagtagatcagctctgggggatgtggtgagctgcgtcgtggggtaaccttttgtttcttgcagaggccaaactgagcagtttctggcagttgattgtgga

SEQ ID NO: 12806 - DNA, 1473 bp, Homo sapiens
ctatagttttttttttgagatggagtttctctctgtcacccaggctgtagtgtagtggtgcgatctcagctcactgaaacctccgcctcctgggtttaagcgattctccaacctcagcctcctgagtagctgggattacagatgcccaccaccatgcctggctaatttttgtattttttaatagagacagggttttgccatgttggccaggctggtcttgaactcctgacctcgggtgatctgctcgcctcagcctcccagagtgttgggattataggcatgagccaccgtgcccagccaaactatagttttaactggtttctctttttttttttttttttggagatggggtctcgttctgtcacccaggctggagtgcaatggcacaatctcggctcactgcaacctccgcctcctgggttcaagcgattctcctgctgcagcctcctgagtagctgggattacaggcgtgcaccaccccacccggctaagacagggtttcaccatattggtcaggctggtctggaattcctgacctcatgatcccccccgcctcagcctgccaaagtgctgggattacaggcatgagccactgtgcttggcttccttttttttttaaaagagtttagttcagaggtcagcagatttggacccaaatttagaatttgggtccgaaggtcatctgtatgggggaagagtaccagatgggaattgacaggattgagggtggctctgacttgcctcaactagccgtgtgaccttgagcaacacacctaatgtctctgcttatccatcaattgaataactggaccacgcccagctaattttgtatttttaatagagacggggtttctccatgttggtcaggctgatctcgaactcccagcctcaggtgatccacccgcctcggcctcccaaagtgctgggattacagacgtgagctaccgcacctggccataaggattatctttctccctctaattttgtggctgtagagtttgatttaagttttgatttcacttcacttctttttgagatatttgaaaaattaactgaagggttttagtcgtctggttcacagctggttagataaatcctttctcagtcctgtcatttccaaggatcaggatgtcctttaaggtgcttgtcctctctccacaggtgacacgctgttgcaggccctggacttactgcccttgctcatccagacagtggagaaggcagcctcccaaagcactcaggttcccaccatcactgaaggggttgccgcagccttgttgctcttaaagttgtcagtggctgactcacaggctggtatgagtccagaggtgtctaggatggtagagacaggggcctctgacaagagtccttgggaggtgtgtcttgatgttcaggattagcttggtcctgaccacactggatcagccacaggtttgcttgtcatctgcaggatgaacctcatggttgcatggg

SEQ ID NO: 12807 - DNA, 1230 bp, Homo sapiens
ataataatgttgctatatttgcttaacgtggtgcttttaatgctgtgaatctagccctcctcttgaccaacttacttggaacattccttttttatcctgttaaccattttagtgaatcagaagcatgcctggtaattgggaaaaattaaaaactaagtaaaaaaagaaaaaactccttgattgaatgtagaaacctaattttcagcgttcatacccagctagccaatcatccagtttggcagtgttacaacgtagctcccaatctccctctgacttcaaaagcttagaagaaagggagtgggatggaaacaaattgtggggttcagtttcttctggcattttttccctctctcttcctgttaaacttggctcctctggcttgttttttgtagcaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaagtcagttcccctggcagttttgtcctttctccccagtgcccgtctccctcttcctggagaatggtgctgaaaggtgattgtctcccataaacttctctttgcagactgctgcctcatatccgggggaatgtgggctttgtgttcaccaaggaggacctcactgagatcagggacatgttgctggccaataaggtaaggggacaattgggttggctaaagagactttgttgttgctccttaaagcaaaatggaccattctcaggttgtgtgagtggagaggcttttctcactgtttgttgtctttgtcaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctggtgagtggacctggtttgcctgtgctaaccaggcaaatggggagctgcttttagtggccatggatctgctggttgtccaacaggtgtttactgccccactattatctggttcagagtgatgtgcagctgatcaagactggagacaaagtgggagccagcgaagccacgctgctgaacatgctcaacatctcccccttctcctttgg

SEQ ID NO: 12808 - DNA, 1039 bp, Homo sapiens
ccttgcctgtccaaatcactaggtgagaatgaagggtggagagagaggaggaagccataccagagaccctgtggctggtggatggacttgctggggtttttctctgtccctcaaatagacaaaactttggagaaaactgaataatgatgtgccttctccctgacatctgcactctatgatttgttcgtttgtttttaagacagggtcttgctctgtcaccccggctagagtgcagtggtgcaattgtagctcactgtagtcttgacctcctgggctcaagcaatcctcctgcctcagcctcctgagtaattgggactacaggcgcatatcaccacacccagctaatttttaaattttttgtagagatggggtttcactgtgttgcccaagccgatctccaactcctgttctcaagtgatcctcccacctcagcctcctgaatagctgggactataggcatgcgccaccacacccagctaatttttaaattttttgtagagacaggctctcactgttttgcccaggctgggacatgctacaatttgaatgttactttattacttttcttttcttttcaaggttgcccttttcatggtttgctcatattctacccagaaaagacttaggagacttagaagaagttagtactttgcatcctacctacactgctctccttggaggaagaccttattctggattttacagagcaaatcagatctgatgtttgtagcttccaatgtgctatggagcttcctcctgcagagtgacttgggtctggagagcctgatatttgcaactgatgtctgcagcttccagtgtacctgctagcccttataaacctcacaccagtactttgaggtcagagttattcaagagcttactgagacaacaggccctgagaagctaagcgatttgccctgtggcatggatggtagagaggggagctggcacttgaactcaggtctggctcgacctcagaatgagtgatcttgtgtctctgtgccccaggactgcatcctctcaccaatacttcaccagc

SEQ ID NO: 12809 - DNA, 1078 bp, Homo sapiens
gccaccgcgcccagccgtgttctccattcagattttgtcacagtgacgtcctaaaattattcccaactccccccaccctgctgtttccgcaccctcgagcacagctagtcgtccgtctgcgccctccaggctcgctttcccactgctcactctcctcgctcaaaattcaagtctcaaccgagtcatctctgtgacgtcacgttgatttgcataagattccccagcgtcccaagcgaatattcttatggttttcaaaacctgaatgtttgacacgggatgttccaacaacaagaaacctcctatgcagatgggccttaaatacggctggtggagtgggaacacgtcgtatacacggacacacgggcaggcactcaccctcaatgtaatggtagtcatcatccgtgggggagcggggcgcgaacagaacctttccagctttgcgcagtggcagtatcgtagccaatgaggtttatccgaggcgcgattattgctaattgaaaacttttcccaataccccgccatgacgacttgaaatatagtcggcattggcaatttttgacagtctctacggagactgaatttttaaaagtctaaagaaaagggttttaggaagttgtattatagcaggttgtgtcttatgtttggtttgataagttatgagctgttcctatgatagttttttggttgttgttcaggagtattccgtgattgaatgtccggggttctgtgcgggtactgtgagttgttttccaaaatgtatgacactatgttgggaactgggttctaactaagacagttatcgttaatcttttttatccaaatgcagccagcgagtgagctactccacttcctttgtcactgaaggtcacagattcccttaaagggaaggggaactctaaaactaacacattaatacatccaaagtcttcctttttttttttttttttttttttgagacggagttttcgctgtttcccaggctggggtacagtggcgcgatctcggctgactgcaacctccacattccgggttcaagcgattctctgtctcagcctccggagtagctgggattacggga

SEQ ID NO: 12810 - DNA, 1094 bp, Homo sapiens
caatgtgaacatattctatgccagtgaatttacacttaaggttaaaatggtaaattttatgtatactttggcataatttaaaaaaaagtttgaaaaagaaaaaagacaaaacaataatcgtctttggagaagtctgttacactgaatctggagccaagtgaacagaaccctgattttgatcccttttctctcaaaagcccttcgcagtctctgaattaagtctattagcatgttcctcccatagtgctttgcttcatatcaacaaaaacctagctaagtgaaatcagcaacgatatgcagaaaccacctacgcaggtcacaaacatctttctatgattgtataattttcaagcaagcaataagtgaagatttttccataggccctaaactcacctttgcgaaataggaagctggtttattgggagtgatgagcagggggcgtaacaaattagctttgcgcagtggcagtatcgtagccaatgaggtctatccgaggcgcgattattgctaattgaaaacttttcccaataccccgccgtgacgacttgcaatatagtcggcactggcaatttttgacagtctctacggagactgaattttcttgcagttgaacaacagaggctttttttgtgtgtgtgggggtgcttggttttgggaggttgaagagtacttgttcgcaaactctctaaatgagagatggggaagtgtcttaccagctgattcgcgagagcacctgcaagtttacctgttttagtgatttgcgtttatgaaagttggagttgctgattttgtgatctctacttttaaggtaaaagcagggcggtgttgacttttcttgccagttggctgtcctgttttctttctcgcactgttttctttttgagacgaagtctgtcgctcaggctggagtgcactggcgtgatctcggctcgctgcaaactttgccgaacccctgtttagcgatttccgtttgtgaaagttggagttgctgattttgtgatctctacttttaaggtaaatgcagggcggtgttgacttttcttgccagctggctgtcctgttttctttctctcgcactgttgttttctttttga

SEQ ID NO: 12811 - DNA, 1105 bp, Homo sapiens
ttttttttttttttttttttttttggtagagacggggtctcactatgttgcccagctggtctcgaactcctggcctcaagcaatcttctcacctcaggttcccaaagtgttgtggtggtaggcatgagccaccatggccagccagacccagtaatgctctttatagaatatttttgtccttcagaataagatccaggctagaatcaggtattgtagttagttgtcttgtctctttcactttgttttatttagaacattgagaaagttttattctaaggtgattcatgagctgttttcacccttcatttaagaggtggaaaaagaagttaggcaccttggctcacgcctgtaatcccagcactttgggaggctgaggcgggtggatcacctgaggttgggagttcgagaccagcctgaccaacatggagaaaccctgtctcaactaaaaatacaaaattagctgggggtagtggcacatgcctttattcccagctcctcgggaggcttaggcaggagaattgcttgaacctgggaggcggaggtggcggtgagccgagatcatgccattgcactccagcctggggaacaagagtgaaactccatctcaaaaaaaaaaaagtggaaaaagaaattatctaacaaatagtgagatcggtggttaagaggcttggagcccgtcagatctgaattttaatcttaattgcaccattattgctaactattggatttttctttgagaagacagaaaatcagcacttaaagaaatcatgagtactttctggccaagtgtggtggctcatgcttgtaattccagaccaaggcaggaggatcacttgaggctagtagttcgagaccagcctgggcaatacagcaagaccccatctctacaaaaaaattaaaaattagccaggcatagcagcacacaccttgtagtcacagctactagggaggctgaggcaggagaatcacttgagcccagaagtttgaggctgcagtgacctacaattgtaccactgtgcactccagcctgggcaaaagagcaagatcctgtctctaaaaaagaaaaaagaaaaaaaaatcattatataagttcagataatgatca

SEQ ID NO: 12812 - DNA, 1027 bp, Homo sapiens
gctctgtgggaaagactaaccgccaggtctcattgcaggtggaatgtaagaaagctcagccaaaggaggtgatgtcgccaacgggctcagcccgggggaggtctcgagtcatgccctacggaatggacgccttcatgctgggcatcggcatgctgggtatgcgcgagcctgcgcctgcggcttctttctgccagaactgctcccaggactagcaggggctgtgtgggtgttgcacctcccctgtggtctgccctcctcctgtctgagtcattgagcaggagtggggacaagggatctgtcgggtctggcagtcctacccaaggtggggtggtttggttggggggtgctgccctctggtggtagccagcagaaaggtccaaccatattcattggtcctgtcaatctgtccattctctcgtccatccatccctccatctgtccattcctctatccattcatccatccagtacacagttattgagcaactctatatgccagacattatgccaggaactgcaacaatgactttctttacaatctggcagggaaaacaagtaagaagataaaatagatttcagatgcagaagtgtagggtgccgagggagtgtggtcacagggaacttgaccgtgacttggagaagtgggaaaagaagttacatttaagttgagtctgcgggtggagtaggagccagtgatggggaggctggagagacgggaaggggaaaagtgttccaggcggagggaacagcatttgcaaaggccaaaggcctttggagggggcaaaaggaaggctgcctggtcttattcattcaggtaatatttattgagcaacttctgagaaggagagcctgctctcatggggctctccttcaagttggagacaggagtaaatgggcactgccactacagagtgactggaggctgtgggaggcccctaaacccacctggaggttgaggagacttcctggaagaggtgaaggctgccatgagccttgaaagctgagcaggagtcagctgtgctttgggt

SEQ ID NO: 12813 - DNA, 1051 bp, Homo sapiens
caccgtcccactaggggcctctccagccaaggcccaggttgaagggtgtagtggggccagggatggtggccttccttgcagggttgggtggaggaaggtgggagaagttgtggatttgggctgaatccatttgtgggtcaggcagggactcggagctgtaggattaggggggagggtgtggctggttcgttcattcattcattcattcattcaaaaaatgattgacctccagtcaaggtgctcaataggatggtggtcatggccctaaatgacacagacgatgtcctcatgcaaccttcaagccattagtatctggctgctctctccccagctttgccacgttccccccgtgtaactatgggcaagtccctcccttgtaaagataataataatagctattatttattaggcacttactatatcctgggtctgtgagttaagagtgttacatgcactatctcactaaatcctctcatagccaggcttggtggtgcacacctgtagtcccagctaccaaggagggtgagatgggaggattgcttgagcctgggagttcaagactagcctgggcaatatagcgagaacccttttccaaaaaaaaaaaaaggtgtctttcatttaacttcaacctgtgagatagacactgttatgcctatttcacagatgaggaaccaaagccagagaaacatcaagtcacctgcccaaggttacccaaccagcaaatgcaggatccaggattccagctcaggcccgtcctacccaaagcctgtgctatgaccacaatccttctttctgggtttctgtttttcattggttaagtgaggggtgggcaagatgtgctgaacctgaaatgattgtcccattcgggtggtccagctgatttgggattgggactcagagtgggtccataggatgggagtgagagtgccactctgttgcgtgggccccagtacaggcagctctttgagaagagagatgtcatgagattctccagggaccttgttgcctcctggctcagtggggtcctggttctcccagtgggagtcagagg

SEQ ID NO: 12814 - DNA, 1050 bp, Homo sapiens
gcacagcccaaggtaggtgtgtctatgtctgggaggagctctcttactatgggcaatgctgggcagtgattttcccagtatttcctgctctggaagatgcttctggaacctctgcttggagtgtttgtggaatgggctgggctgggaagaggggattcttgacgtccttgctctgtggcctgaagacactatatgtctttccacgtgagctctggggtggactggagaggggcttgtgtgtgttgggagaaaggggagctactcagaggattcatcgtcctgtatttgaacccagtagagtttggagcctgagtctaattccaacatcatagaccacagccttgatgtccaggcctctggaagtgaaatacaggacagacttagaccctaaggccgcgctacaggcaggctagggagctacccttggatccccccagtcaccctttgcagaggcagaggggaccacagactctgtcacctgttgtctttcagtttagatgtctgtggctgctttctcaatgctctcttaccctgctgctctggcgagttctcccagtgagagggtcaaggtgcgcagaaaatggatttctgagcagttgagtgatacaacactcaaaaaacttttggtgcagggcaggggcctaagagtctattctaggcctcagggcaactagccaggtcttccttttgaagcaattgaatatagaggacagaaggagagactgattgcggaacatggggtcaggacccctgagtttactgacttatcatgggtcctaggacgaggtccctctctaggagagttcggtttcctcctttgccaggtggaactagagctctttaagattccgggccagtgaattccatcaagtcccccaactcctgccagggctgaaggagaggaagagttttgggagacaggaaaggggcatctctggaagggtccagtagagggcctgaaagcaattatggagcaggtattcgaaggaagccgcaccagggagcacatggttggaactgggttaattccattaagcagtttggtgacag

SEQ ID NO: 12815 - DNA, 1047 bp, Homo sapiens
actttgccggctctgaaaggatcttcttggcgcagcctgagtgacccaagcctggaaatggagagacagtggcctattgtttttggtgattatctgccatcaagctgcctgttctgctaccatcccctgtcctcagaatgcactgatggcttctgcagtgctgaggaagctgagatttaggggctgggggatggaggagtggaagattgataaaggggaagagaatgagggaggaaggagggtgagatgagcatccttaggagatggggctgaaaagggccagggctttgtctgtgtttggcgtcctccagcctgggaaagggggtgggagggaggtttactgtggggagtctattttgagctctgactttcaccttttatttacttgttgggttttatttatgttgccagctgtgagtcacagtggaggtggggtgtgtcagggatggggtgtgcgtgggtctgtgggatcgtggcttgggtaccatctccccatcggggtctgtgtagggggactgtgtgtggtgcgctggtggctggggcggctgcttctgggagaaagagaaggatggacatgtccgtggaggtgtggaattgaaacttcaggcgggagaaatgggcagttgtgatttttccctggagcccagtgggacttggcaggagaggaggcattgccccagtgtggattttggaggttccatctctgtggacagattccagtgggggagcctgtaggaggctagttcctggtctgtgccattcagagagaagccagagccagctgcctagaacgaggctgagttttgaacagaaggaactttgggaaaagatagatcttccctgcgattggctggtgaacttatgaatgacgtccacccatgtgggtggcaaaaagctctggcctgacctggccctgtaggccctgcatggatcacagcgtctcatgccctgtcttttgctgtttgtcgtacagctatagtacccaggagtacacccagatgcatcttgatttttccctctggttgttcacagccaagggcaaaggtg

SEQ ID NO: 12816 - DNA, 1117 bp, Homo sapiens
agagatctacagcccatctcagtactgaaccacagggtcttacagataccagattccttgccaatagttaatcaggtaacttaaaaaatacaactttgggccgggcgcagtggctcacacctgtaatcccagcactttgggaggctgaggcggccagatcacaaggtcaggagatcaagaccatcccgtctaacgcagtgaaaccctgtctccactaaaaatacaaaaaattagctgggcatggtggtgggtgcctgtaatctcaggtactcaggaggctgaggcaggagaatggcgtgaacccgggaggcagagcttgcagtgagctgagatcccactactgtactgcagcctgggctagagcgagactctgtctcaaacaaaaaatgcaacctttgcagttggggggggcgcgggtgctggcctcatctgacatcattactgcatggtcatgtagcagctgtccacttaaggaacttaaggtagtttttgtagttccgctcttattgcgcctgaatacaaggcgccctgaagacaagtcagactgccatactcacaggaagtaggaatggcgggagacttgtgatccaggtttgatctgctacctactgacatttctgggatctgttttctccataatacaatggatgagactgaaagtaccatacacatttaacagaaacactggtgattctggcttcaacatgccccctcatctggaggccagaacaccctcatccatccaggaaatttcctgataggatttcttttaaaatggcaggttaaagctaagcccagctctagaaccatttaaacctgacaccagaaaagacagcctacaatatcatagtagctgtcacgttaacctattcaagaaataacttgtctagcttacctgtaatgaacttaaaaaaacaaaaagctcacaatgcttgtgcaggtgatttattgcaactatttgccttcgcattctaatgcacctagaggtcactttattaagcagcaaaagaattcacatcaaattcagctcaaaccaaggcataagaaaactgctctagatgagagggagatggtggcaatgctaccgcttcagatggccctgctctcctgcagctgt

SEQ ID NO: 12817 - DNA, 1031 bp, Homo sapiens
tagactgtaagctccattaggactcactgcatgtgatttaaatttttttcctcttatttctctagggcctattccctggtggattccagtcaagtgtctacatttctgatttccattcttcttatagtctatggtagtttcaggtaagatattctcaaatggggttgatacaagttggaggtggaagaaggaagcattgctctgaaagtgctggtaccaaaacttactctgtgaagaaaaacaggacttcggcaggatttgactcagaatagagagttctgctatttgttctttaattggctgctgttaaacacttcttcattgtgcttatgagtttagcatgttaatgcttacatgtaaaaactaattgcttaaaatgctggttctgaaattaatcacctaatgcactctttattaagaaggttaaggagagagtctttgacaatgattctagagtctcaaagggaacaaagagtttaaatggaaggacaatttgaaatatgaaaaaaaaactactaaatatccatgtaataaaatgacaaagagaacatttcattttttttttctaaccaaaaatgaaagtgtagtcacaaaactttagtaggcttacgaagaccagggaaaccaaagtaaaactgtacccaggatgctaataaagttcttaatctttggccgggcacagtgccatatgcctataatcccagcactttgggaggctgagacaggaggattgcttgagcccaggagttcaagactagcctgggcaacatagcaagaccccgtctctacaaaaaatattttttaaagaagttagccaggcatggtggtagtgcctatggtcccagctactcaggagactgaggcagaagaaggatcacttaagcccaggagattgaggatacaataagctatgatcacactgctgcactccagcttgggcaacagagccagactatgtctcaaaaaaaaaaaaatttttttatgttgtcctaaaatgcttgtaagtaagtagattatgtccttatggaaat

SEQ ID NO: 12818 - DNA, 1031 bp, Homo sapiens
aacaataaaattccctgcttttaatataattgaaaatctatttaaagagcccagcatatatctttgataaaattgccatgctaaacaaatatgtcattactgtgcatgtgttggaaatgaatttatgaagttagaaaattattttattgttactcttggaatgtccctacttttcaattattcagtcacttaaaatatttactgagctcttgttatgtatgtgccaggcactgttgtaacagtgaatgaagcatcaaggcccctgctctcacagagctaaccctaaaaaaaatatcagtaatgacaggactttgagaccagcctggccaacatagcaaaatcccatccctactaaaaatacaaaaatcagctgggcgtggtggcatgcacctgtggtcccagctacttgggggctaaggtataagaatcgcttgaacccgggaggcggaggcttgcagtgagcaagattgcaccaccgcactctagcctaggcatcggagcaagactgtgcctcaaaaaaatagatagatagatagatagatagatagatagatagatagatagatagataatggattctaagcaattaaaatagtaattggggtggctctgaaattaggtaggcagaaaatgcctgtctgagaaggtgacatttaagttgctgtctgaagaacaagaaagagccagccctggtgggagcaaaacagtacctggctcggagcagcagccactgaggtacccttcccagcgtccttccacctgtccacaagcatggggaacataacatctttgccaacgtcttcaagggcctttttgacagaaaagaaatgtgcatcctcatggtgggcctggatgctgcagggaagaccacagtccagtacaagcttaagctgggggagatggtgaccaccattcccaccataggcttcaacgtggaaaccatggagtacaagaatattagcttcactgtgtggggcgtgggcggctcggacaagatccggcctctgtggtgccactacttccagaacaca

SEQ ID NO: 12819 - DNA, 1032 bp, Homo sapiens
gccctgtgcatgtcttttatttttctgctcctgagttgtatcctttataataaaccaacaatagtaagtaaattgttttcctgagttcagtgagccatcctagcaaatggtcaaacctgagaaagggattgtggaaacccctaactttgtagctgatgagtcagaagtacgggtgacctggacttgataccggcacctgaaatagaggcaatctcatgagacctagcccttaacatgcagggcctgtgacacctttgggtaatagtgtcagaattgaattgatgaacatctaattattattggaaaattggttattgacatggaaaaaacccacacatttggtgtcagaagtgttaagagtagaaacagatcatagaaatatgtgtaatttatgttaatgtataatgagtttattttaaaatgaataaatatttttcatattcacagtttcaatgtctaatatggtaaatatcaggaagtataatctatataaacaaatgccctttggggtcctcaacaagagtcctgaactaaaaagtttgaaaactacttctctggacactgtggacattattttctgtagtactgcctacattgtaattcatgttcacttatttactattgttttggaatcttaataccttcaagtatgttgctcaaaattctagaattgaagacatgaagatgttgagcactacagcccaaagtgatattcccaatcctttgagttcccagtccctctcttacccctaactccctcacagcccttctgttctctccttttggtatctcagaaatcttgggtatcagaaatcatttcataatacaagtaacaaggaataagataacctgttagaagattggattggtttttatatgttacaatttcaggcatatgatttttaaatctgccagagaggtgattgtatactgagtaatatcagtcagcgtactcccctgccagataaaccaggactcagtccgctgctaggatgcgtttcaatgaagacatctgacctgtgtggtatgtct

SEQ ID NO: 12820 - DNA, 1032 bp, Homo sapiens
tctctgaataatacggccttttccttctggacacttgaagtttttctttttaccactgatttttagcactttggttatgatgtgccttgatgtggttttatgtatgtttcttttgtttggggctttttgagtttcttagatctgtgagtttatggttttcattatattatgaaatttgcagccgttatttcttcaaattttttttctgctttcccttttgcccttcctgtattctagttcagctgtgttagaccacttgatcgtgttccacaggttacttaggctttgttaatattttttcagtcttcactgtgggtactttttactgctgtgtcttcaagttaaaccatctttccttctgcagggggtctcatctgctgttactctcagccaatgtgtttttcatttgagatactgtacttttaaaatctttacagtttccatttgggtcagaaaaactatttgtctcctttccacatcacattcatatgaactgtatattgtttgttttaacgtccttgtgttctaattccattatttctatcatttgtagatttatttcaattaatttttcatctggatatgggtctttttcacttcttcgtatgcctggacattgtgaattttatattgctgaacactggatttgctgtattcctctaaagactgtcagattgtatttggtcacacagataagtaatgtttggatcagtttgatccttgtgaagcttacttttaaggtttttgtggctagtaatagcggcctttaatccttggactaacttggcccccctactaaggtgttgatccttctaaggccccgtgcttttttcatggtcagagtgaccagccctgtgggagctctgggaagtgttggccctattgctttccagtagattgttccctgaccttggggagacttcctctcaagcacttggagatccgagactgaaaggaacccttctgccagacctccggagccctctgcatgcagcccccgcttctccagtactgggtcctgcaaattctggc

SEQ ID NO: 12821 - DNA, 1089 bp, Homo sapiens
tctatttattgaataggtgtgacttgtcacccacttcacacaccattgttacctttctgaaagccaaaaaaaaaaaaaaacccaaaaaaaaaacccaaaaaaactctagccataattttgaaacatctccagccataagggtgtcagataaggaattatgaaactgtaataccatattttattggtgaaaatattgaaaagtgtagataaacacaaaaagaatagaaaaactacccacaattctaccaacacagagagatctttcattaaatttgttgcatatctttcaggtttaaaaaaaatccatatattgtgacagttggtttttttttttttttaaattatacaagttgttgaaacccagaaatcccaaatagaagtaaaaaaagaaaaatcctaattacctaatatttaacttacttagaaaatttatggtaacatttcatgttacccttttgggcattacatataggaactgtagatcattttttacacaaaagcaggaacaggtttatactgtgctttcatttttatgtgatatttaatgtctacagaagaatatatgatttgtatgtgtagcataatgaacgctcatgaacttcaccagttaaagaaactataggattaccaatgttctggaagccccctttgtactctcctttgtccttcctcatgcctctgtcccctgtccccgtttaggtgtaaccactgtcgtgaattttgtttaccatccctttgctttttaaaaaaactagatttacatctgcatttttttttttttttttttgagacatagtttcgctgttgttgcccacgctggagtgcagtagcgtgatctcagctcaccacaacctccgcctcctgggttcaagcgattcgcctgcctcagcctcctgagtagctgggattagaggcatgcgccaccacgcccggctaattttgtatttttaatagagacagggtttctccatgttgatcaggctggtcttgaactcccaacctcaggtgatccacccaccttggcctcccaaagtgttggtattacaggcatgagccaccacgcccggcttacgtctacattttaatgtt

SEQ ID NO: 12822 - DNA, 1031 bp, Homo sapiens
tcttgggtgaatactttggagtaaagttgctggctcatagtttctgtttttaacattttgataaactgccaaacagctttccaaaacggctgcaccattttacattaccaccagcaatgtgtgagattctaatttctccacgtcttcaccaacacttgttattgtcttttaaattatagctatcctagtgagtgtaaagtcatatctcattgtggttttatttgtgtagtgtttatatttaattaagggtttgtagaggaaaaaagcagtagtttaaaatgttaggtctgattgtttttagaagtgtactaccaaagttgaacctctgttttagtcaactaaaaatcttgtgtcaagaacaaaaatttagtacacctttggttcacagatttttcttcaggctacttcttatttcttttgcgtgctggaataatttagaaagaaattagcctcagataattgttaaactagtttcttccctttggttaagtgattaaccgaattactctggcaacctgctgcatcatcagtaagcttgggactaggagtggtttcatgactgaaggtttggtgggtggaagtggcggtgaggggtgccttgatgtgtcagttctttgccaggaggataatcactggaggagttagttgtaaaatactaccttttctagagctgcactgcccaatagaagtataatatatggtatatatgtaatgtaaagttttctggtagccacattaaaaagtttttttaaaaaggtgatactaatttacataaaaatacttatttcacgcctgtaatcccagcactttgagaggccgagatgggtggatcatgaggtcaggagttcgagaccagcctggccagtatggtgaaaccccatctctactaaaaatacaaaaattagccgggcgtgatggtgggaggctgaggcacaagaattgcttgaacctgggaggcagaggttgcagtgagccgagatcgtgccactgcattccagcctgggtgacagggtaattctgtctcaaaaaaa

SEQ ID NO: 12823 - DNA, 1016 bp, Homo sapiens
gaactccttcaagtgaattttgttaccaaaatactatcataataacttgtgtattttctatgtgatagagttttacgagcattgctaagtaaggaaattgaggctcaaagcatgtaagtaacttgcccaaggatgtaaatggtaaagggctcaaagggaagattatctgacacaaattctgacactgaatctgtccacttaatgtttccacagtgttgactgtaagccagccctcttttgcttgagttcctgtattagcctctttgctgggtttcttccattatctacctgttggtaccttcttggccttctaacaacctaagtcagatcttggcagttctctgcttaaaagtatgggttttggccacacttagaataaaacccagattccttagtgtggttcttcatggtttgatcttgtgtgtgtctctctgagggatgacagacgataaacaaaataagctacataaggataaaaccctttctgtttttggtactctctccagtgcctggcatttaatagatataaataggtggctgctctgtgctacccatctttttttttttttttttttttaaaaaaaaaaaaaaaaaacagagtcttgctctgtccaggctggagtgtggtggcacgatctcgactcactgcaacctccgcttcccaggctcgagcaattctcgtgtctcagtctcctgagtagatgggactacaggcaggctccaccatgcccagctaattttttgtagacatgaggttttgccatattggccaggttggtctcgaactcctgacttcaagcaatccacccacctcggcctcccaaagtgctggtattataggcatgagccactgcgcctggcccgtgctactcattttaaggctttctaatctcagggctgtattatattgaggtgatgtattgttgtgataatggtcattacatgtcaggtatttgcaaatattattaaacctgagaatggcaaataacacaggtctccatatctagtggaagtca

SEQ ID NO: 12824 - DNA, 1926 bp, Homo sapiens
ttagcatgtagaggtgggatatttgcaggacgggttgaaggaatgatggcagtatccatgaagagtggaaatcgggtagtgagaaggaagtcatagctggagagtgaggaagcaagaaatggcatgatcgtaggagtgggggacctgattgcaatttagagaaatggtttgaagatggtttactcttgaagcaaatgtggtttgggacagaactgtagacattcccttcttagaaaagagcataatagaatgggacgagcatgccgtgtggagttggaagacctatttcggaggtccggtttgccaccaacttgctttgttgatacgacatggtagtgagttcttcggtcctttttccttacctataaaatagagggaattaccttttccacagcctgtaaggattaagtgagtacatttagaaagcacttggcaaactgtgaagtgccacagatcttactacattaattataattatcctagagaaacatctaagaaatgggtaatatcagaaaataaggaatggttttaggtagaagactttgagtggattatttatagtgttagaggttataagtcagtaactcattgagtcttcacataagagaaagggagttggggattgaagatgataattcttaagagaacttcattgatgtatgtgcaatctcaagaagaaggtaactgagagacaaagtaaccctaaaggaagaattaaaatcttggtgaacacgtgctctaaaaagaggtttaagctaatttcatagttttgcgtgacagctgcctttcagtagcaggtcgtagggaacacaagattacaatttcagcttccttctggacagagtaagaaatgaaggtaaaggtgtttctgtcatgccttgtggttactcatcttgagcttctcatactctggccctaatggctgtggccctgagagtcctaatggctgctttgctgtttttactgtgctgtacagaggccctggatggttgaaagaatagaaaactcagtggtcaagaaatggggaaaatgaaaatgttttactaggtaggttggacacacacgacctctctctgacattagttggctctattaaggagggattactttgtgaagtttgacaatttacaaatttattctactaaaatacttccttcaatgtcagctctgtttgctttacaggcaaagaaactccttgaaatcggggagcttagcccctcaacctttggcaggttttgagatgaagaaaatttttacattatctggagagagggtggcatataaggggagactggggaaagtgggcagtttcctttttttttttttttttttttaggacggagtctcgctctgtcacccaggctgcagtgcagtggcgccatctcggctcactgcagcctccgcttcccgggtgcaagcaattcttatgcctcagcctcccgagtagctgggactacagccacatgccaccatgcccggcttttttttgtatttttagtagagatggggtttcaccatgttggccaggctggtctcaaactcctgacccagtgatctgcccacctcggcttcccaaagtgctgggattgcaggcatgaaccaccgtgcccggccacagcttcctatttaatagttgttcctgattcaactgactaataatataataaaataaggaactatacacatggcattaaatatacacatttaattctcacaagtttctgaggtaggtgatatttccctgtttcacagaggaagaaacaggcttgggaggccaagtggtatgtttaaagtacttcacttgtgatgctttattttgtttgacatgaattctcccatcattttactcattcttattgaaatataaatatggaaaaggtattccagtagtctatgtagactgatttttggattatctgtcatttt

SEQ ID NO: 12825 - DNA, 1037 bp, Homo sapiens
aagtttccaccgcatttctccttgactttactaaaagttaaataaacgtgccactcgccccggctggctacaagctgcagggggtgccgggtcaccccaggccttttcctgaatcccagggtagacgcggtacactgaaggccaggttctcagcagcaggcccagggatgtgggaccatgcttgtcctgggttcacaggctcctttgtccctcctggcagtgctcaggacctcagactcctcagggtggctgcgaactgccctcagccagccaggcccccaggcttctgagtgttagtcctgtccacacaggtagctcctgtgccctggggtcacctctttcttctcctgggcacctcagcttggccagttccccggccctgctcagctgctcgggccttgctgccttgtgagctcagctactcctgccccaaacaagggcagggtctgcagggcgctcgagacagaggagctgccccaccaggacctggacttggcacgggttgcgaggctcccacaggagtaaggacgacttcccagccccgaagtagccttcccagtagaggcaggaggccaggctggcctcagaggcatgatgctcttgggaacaaatacaggaaagctggaggtcatggggcctgggagagggaatcgctggggatgggaagccaggagagccctgcctgccttccctgttagcttcggcctccctgggctcaggcgttagagccccaggctctggcacagagtagccacccaggaaatgcctgtgtgagtaggtgatggggtcagtacaaatggcatgtgggtcactagctggaaggagttggggcaggaaggagtggcccggtgggtacattggtgacagaacaaggccacgctgatccagggcctctcagagctcagcaggtcacagctacacaggcctgtgtcctgagaagtgtggctgccagagtggtgtagcggtcccagggctctccataggcccaggctgggggtgcccaagtcataggccgcccccttcagttccaagtaaga

SEQ ID NO: 12826 - DNA, 1048 bp, Homo sapiens
agaggttaccaaagacttctcagttgccagactgggtggatatattttattccttatgttacttgatctcttggatgcattcaacatcactggctactttctgcatcttggaccagtattttcccttggtttccatgactttcctgggtcccatgttctcctggtttctcatttgtacttctatgactctttatcttatctttctttttaaaaaattaatttaattaatttattttagagactgggtcttgctctgtcgtccaggctggagtgcagtggcgcaatcatggctcactgcagcttcaaacttctgggctccagtgatccccctaccacagcctcctgagtagctgggaccacaggcacatgccaccaagcctcgttaattttttttttaattttgtagagatagggtcttgctatgctgcccaggctggtctcgaactcctggcttcaagtgatcctcctgactcagccttccaaagtgctggggttacaggcataagccactgcatccaatctttgtcttatctttctctggctctcttctccctgtaaatatcagttccagcaaattgtctctcagcacttcttatgattctatcaggataggacaggttatgctgcaataacaaagcactctcagtgtctcatggcttatagcagtgatgaattaattctcactcacactatatgtccatcatgggtctcccagatggctcagctctctgtaatcactcagagatcgaggctaacggaacagccattgtcttgaactctttaatgagaactctggagagtctcacagcagcaatgaaatgttctgacctcgtgatggaaggaatataaagttaccaaaaaaaaaaaaattggggattgaacggtggatttcttagtcttgtgagtgtgtgggtgtgtttacaatttacagaaaatcaagtgacattcttcagcagaaaagggagtttttttttttgaggaaacacttatctcacagactgcaagtgcaggaaatgtgcccaacctcatgagaacctattaatagaat

SEQ ID NO: 12827 - DNA, 1048 bp, Homo sapiens
gagggcctgacctaacgtctagttacagcgcccccctccccagggaccttacccacattctccatcagaaacatagcaagccagacatcacgcttcctttcccttgtgtaaggacagtctccctcctggacaggagacacggattgttgtgggggaaggacagacagtaacccatgtggcatgcccagtgacctccctaagaacaggggagctgtgtgatggtggtgaggggataggctcggggattcccctcgcacctgtcacgccatccacgctgtcacaccggcggctccagcctgggctcttcagggaaacaagggctctcctcctcccacttccaagagggaaggggcctcctcttctgtctgaggtgctcctccctcagggctggctgcaggagggctgaggcgggaggatccctggagcagttgtcatctgccctttcttgagggccagctgtgtgccaggccaggcaggggaggctctgatcacccccacacacaaggaactcaacatctggtgactgaggacaagcgtcacagtcccttccctgtaagggctcatagcctaagtgggggatcgaagtacctaaaaacctggtatgacaggcgccgtggggtggggggtgccttctacttgggatttgtgcagtgaattttggtgttacatagttttggaactgttgtacgggtccttgctatttttggcaaatgatgctggtctttcatttacagaggggctgcgtgcaaagtctcctttgaaaaatttatgtgagcaaggaaaaggggagaggatctcaaagactgggttacgtagatcacgttccagggggtgcgcgacggcccacttgggcagggggcccagatgtgggagcagctggctcagggcctcgctggcatttctcagagtcttaatgttggttttctgttcggtgagcaggaagcaaggcagcgaagacaacctccagggcaccgacccgccccccgtgggggaggaggaagtgctcttgtgagaggcagtccctgcgtggaaagttgctgggcccccg

SEQ ID NO: 12828 - DNA, 1048 bp, Homo sapiens
ggacgggctaacacactgggtggggccactgaagcagggcaaggaaggtggagggagggtgtggcgaggttttacatgtttactccaagagcatgggtttgaatcagggtttgaaccagggcagctggagcagggatgggcgggtagatactgggaagtggtctgacttgggacaagatggcaaggtccaggccccctgcatgtgttcatcatttagcaaacacggagcagccagtgtgtgccaggcataggtgtcaaagatgagcttagcccagtgcctgctctcaggggtagggggctggggggctgggggaggggctcctggccttataagaaagatggacctgggaagaatcagcctcctgtgtgatcagaggccagtgcagagagatgcaagggctgggggcttcacagaggaggagctcctgctctgggttgacaaggccacaggggaggcggcagggtgggctcacctggggagtgacatctgctcagacacagaggaaagaggggctggcatgtcccagtgactgtaagaacctcagtaggggaagaggccttcattctctctctcttttttttttgagatggagttttgctctcgttgcccaggctggagtgcagtggtgtggtcttggctcactgcaacctccgcctcccaggttcaagcaattcttctgcctcagcctcccatgtagctgggatgacaggtgcctaccaccatgcccagctaatttttgtatttttagtggagacgcggtttctccatgctggccaggctggtctcaaactcctgacctcaggtgatccacctgcctcagcctcccaaagtgctggtattacaagcatgagccaccacgcccgcctccccccccccgctccttcttttaaattgaggtagaattcacataacataaaattaaagtgaacaattcagtgacatttgggacattcacagtgacatgcaattatctcctcaatagttctgaacattttcattacttcacacccccgcccatcagcaatgactctccattcacctcccccc

SEQ ID NO: 12829 - DNA, 1048 bp, Homo sapiens
ctcttgcagaaagcacttttaggaaagtgtattcccctacacatctccactaatgccacacacatatatctggccctctaggaaatctagagatttgccctgggacttcctaggcagctagctaactggcatttgaaggtcttaacagaaggcagcccaaaaaatcatggattggggcttggacccaagggggcagacccctgcctgggtcctctcctgatcctgtcctgccagctggtcccaccatgcctccaagcctctcctgctgtgagatggggagaatgctgcctgctgtgcactgagcctcccaggtgtcagggattgtggctgaggagtgatggatgctccttgggcagccaggcaaggcagatgccaaattcccatcacttcggccaagacccggggccggatggagaatcgccccacttccatttcagccttgtagctcctcccgtcctgtctctccgtcttcatgtttccgcccctttgctcacccctgccctctgctcgccagctgttttgcatgcctgaccacaggcccttgcctctccgtcctgcatgcccttgtggctccgctcgctggcagggccccccggtagccagccacacctgcccctcacccctcctgtcgttcgttgaagctgcacccctgggtcacgaggcatggggcggagccgttgccgtcggaggatgagaactgcacgctggtcgaagtgactgaagaggaggtcgagaactcagtcaaacacattcccagcttggcaaccgtggtaaggtggatggacccctgacccagagcagggacccaggagcctgaggtggggcctggccaggacaggccggacacaggcgggtgcccgggagtcagatgtccgggggccacccctaatccacagctgctggcctctgggccttggtcatgtatcaggccaggtgacccctgcatcttctgagccaggttccatgttaccataggaaggggaagattatccttctggaattcctgctttcagagctcatcaggggagaggaactaggagaagttcca

SEQ ID NO: 12830 - DNA, 1021 bp, Homo sapiens
ctgaggggtaggcttcaggcttggctagatccagggactcaaacagaaaccatctcccgccatctttcagttgtttttcttatttggtttcctccacaggtgggtcaggcacccagggaccaggttactttctatcatttgccaacctcagtggcaagagcattcctcattctgaatagtgcctgtgaaaaccctggggttggctctgattggcccaacatgggtcatgtgcccatgcttgaaccaatcactgtggctgggggtagtggtgctctcattggcctggcctggatcctgtgcctgccccagagcctaggagacaagattggtcccgccccaactccaagggctgaaagtcaagaggtggttccccaaaggaaaactggaggattggaggctggaccaccccttatgccctcacactaagctctttttcttgcaggccttggatgtttgggccatgggtgtgacactatactgctttgtctttggccaggtaagagggcggggtgtctgtcccctcagtactgctgggtggcccctgggttaatagtcacccttgcggggagacagtacttacttatttaagagttattttaggctgggcatggtggctcacgcctgtaaacccagcactttgggaggctgaggcagaggttaggagttggagaccagcttggccaacatggtgaaaccccgtctttactaaaaatacaaaaaattagccaggcgtgatggcgcatgcctatagtcccagctactctggaggctgaagcaggagaatcgcctgaacccaggaggcggagcttgcagtgagctgagattgcaccattgtattccagcctgggcaacaagagcgagactccgtctcaaaaaataaaataagagaagagttattttatttctacacctagatctcaatgtgaaaaaggatgccttcctaaatatacatgtgtatgtatgtcatgatcatatctatgaaaaaatgatctgttaaaacagaaggattggcagaggctct

SEQ ID NO: 12831 - DNA, 1047 bp, Homo sapiens
ttgtaaaaacctgggctccaacaaaatacagttgcgggacagatttgaccaatgggctgccggtttgcaacgtctgtattagggttctcattttgcagatcttaacttctggatagtatgtcatgggcatctccctttatccagggctcctatggtgtcgtcaagttggcctacaatgaaaatgacaatacctactatgtgagtatccgcattctcctccctgcccccatccttatccacagaagagcctcctttccagcactcagcttcctggaaagttttcctagctgttgtctcattttattcttaggtcatgtttattttgtgccttaggaaggaagtggtatgcccattttacagataggaaaatggggaggtgaggggattggcccagaaaaagttactcattcagcaaaaggcttttatgcccttcctctgagctgtcatctctgcatcctccatagtattgagaacaaggcagcagtgagacaggtgtctgtgtgggtggctttggagtcagtccagcgtagttttgaacctgaatctatcgtgtgccaaccatgtgaccttgacaagtgatatttctccatgtgtaaaacagctgagcctcagtttccccatgtgtaaaacagctgagcctcagtttccccatgtgtaaaacagctgagcctcagtttccccgtgtgtaaaacaaccagtcctgcccctcctttgcccattgctccagctcacttgtgttttgattcgatggcagcaagtcctgaggctcgtggtttcccagctgagagaggcgaccgtgagcctcaggaacacctcagagctggaggcaccccaggagtccagcctccctacaaccccatggctgcttgaccctctctggtaatgaggggctcactctgttgacctgagcctgccagggggccaggagcttgggccggctttggagtagaggaaccccgactgcgccctccttccccttttcctccctgctttaaacaggacctggctaaaggtgctgtccttcattttcctgcaggcaatgaaggt

SEQ ID NO: 12832 - DNA, 1563 bp, Homo sapiens
ggcagggcgtggtggctcatgcctgtaatctcagcactttgggaggctgaggcgggtggatcatctgaggtcagtagtttgagaccagcctgaccaacatggtgaaaccctgtctccactaaaaatacaaaaattagccgggcatggtggtgggtgcctgtaatcccaactactcaggaggctgaggcaggagaagcacttgaacttgggaggcggaggttgcagtaagccgaaattgcgccattgcactccagcccgggggacagagcaagactctgtcaaaaagaaaagaaaagaaaagaaaaaaaagaacagagatatattctgtcatttctggaggccagaagtctgggatcaagccttggcagggttcgtcccttctgaaggctccgaggggagtctgttccaggcctctcctggctgctggtggttgttgataatctctgatgctccttggcctctagaaggagcatcgtctccgcctccatctccgtgtggccttccccctccgtgctggctggctgtgtgtctacctttcccatttattggactaggcctgttggactggggcccaccctaatgacctcattttaacttcataatctctgtaaagacctgtctccaaataaggccacattctgaggtcctgagggttagaactgccacataacatttttgggggacacagttcaactcacagcagggtctgagcccagtccctgtagcattgccctgggctgccctctcgtcatcatcatccacttcccacaaagctgtagcccttccagcccctccttccccactttgttcctgctcccgggctccagacccaggaaacttgtttctgttgcctccactctcccgcctcttttccacagagggccttctcagaagctgtttcctctgctgggaacaagttcctgctcctttagtatctactcaccctgtaggtctcagcctaatagacgttcaccaagaggggccttctttcacccaccgcctcccttcaaatctaaagtggtcccctctggtattctctttgatcatatcctggtcttctgccccagtctgtgcttatagattcacttgggacctactttttctttttcaagatggactctcgctttgtcacccaggctagagtgcaatggcccaatcttggctcaccacaacctctgcctcccaggctcaagcgattctcctgcctcagcctcccaagtagctgagattacaggcgcccgccaccacacctggctatttttgtatttttagtagagacggggtttcaccatttggccaggctagtcttgaactcctgacctcaggtgatccacccgtctcggcctcccaaagtgctgggattccaggcatgagccaccgcacccggccttgtgcacctacttttaaatgttggtccccctcattggactgtcagtcccctcgagggcaaaaaccacatctgttttgtttatccagcacgtgatcattgctttataattactacatgtaagaacaaatgaatgaatgaatgaatgaacgcatttccttgaggacctctgtggg

SEQ ID NO: 12833 - DNA, 1056 bp, Homo sapiens
actccttctcaaaagaaaaaaaaaattgaggtgaaattcacataatataagcttaaccattttattttattttgttttattttatttatttatttttttgagacagagtctcactctgtcgccaggctggagtgcagtggcgtgatctcggctcactgcaacctccagctcctgggttcaagcgattctcctgcctcagcctcccaaggagctgggattacaggcatgtgacaccatgcccagctaatttttgtatttttagtagagacggggtttcaccatgttggctaggatggtcttgatctcttgacctcatgatctgcccgcctcggcctcccaaagtgctgggattacaggcgtgagccaccatgcccagcccaaacttaaccattttaaagtgaacaattcagtggcatttagtacatttataatgttgtacaaccactacttctgtctagttccagagcattttcatcacccccagaggaaaccttgtacccattaaactgtcactctctcttcccagtgcccctccctgcagcccctggcaaccaccagcctactttctgtctctctggatttgcttgttttggacatttcatataaatagaatcatgtaatatatgacttttgtgtctggcttctttcattcagcatcatgctttcaagactgatccatgccatagtggctgtcagtgcttcattcgcttctgcggcccagtactattccattgtgtggatggaccgcattttgtgtatacattcatccattgatagacatttgggttgtttccaccataaaggcgtcttaaggctactttgtccattcccgtgtctctgtagcccctcagttaatgaacttcttggcataagacatttttttgtcactctgtttggagggagcaggtgatggaagaaaggtttcttgaaatcactcaggaaccagtttcccaacccaaggttttcgggattcccttcatgcacccttacctaccccttgcaagaatcgtggctccccatttaaacccattgctggccaggcacagtggcttacgc

SEQ ID NO: 12834 - DNA, 1035 bp, Homo sapiens
tctccctacaggctacttttaccttccccagcctggtgtttggagtctccacgcaggggatagaaacttcaggtgccctagagctgtgctgccatttaccactccccctcccctagctctgcccccagaggagagagaagaggatggctttatgtccccataagctcctttgttccttggaggaggcgggggctgcaacaaggggagggctttgggggagttagccaccctcttccctaatcaccccacaaaaacatgcagtttcagaataaatagtgtgcatgccatgcaaatgcagctttagggcaagccccacataccccttccagactgctgctcatacacccttcctatggaggaagcaggcattggtgacacacacccttcctatggaggaagcaggcattggtgatgaggacgcaaaacatatttttgtaatgaagagtaatagccatcatttgatgagcccctaacttggataataataagaatacttatttatttattttgagacggagtctctgttgcccagggtggagtgcagtggcacaatcttggctcactgcaacctccgcctcccgggttcaagcgattctcatgcctcagcctctccagtagctgggattacaggcgcccaccaccatgcctggctaatttctgtatttttagtagagaaggggtttcaccatgttggtcaggctggtcttgaactccttacctcaagtgatccgcctacgtcagtctcccaagtgctaggattacaggcatgagctgccacctggccctggacaataataataataacagtattaaaaactaacatctattgagttcttgctgcctgccagattctgtgctatgtgttacatgcattatctcatttaatgcctaccaaatcctacaacgtagggaattttaaccccatagtagagattaggagactgaggtttacagaaatcctgcagtgttgctaggatttagccccattttatagaagggctcagagaagttaagtaacttgctcagggtcacaca

SEQ ID NO: 12835 - DNA, 1048 bp, Homo sapiens
aggtgatccacccgcctcggcctcccaaagtgctaggattacaggcatgagccacttcgcccagtcttaaagacctttttgaaaacctcaccctagtggtttgttttttctctctcaaagaatggagaatataaaagaatcttctggtagttgttgaacaaataaaactaaataccacgttttgaaaactatacgtgaagggttgagttaaatgtgtgtgttattttcccctttccgtcagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaactacgtatttgttttattccccttttcttcccttttggtagcaaaggacaccaactttttcttaataaatgggtattttgctaacaagttagtgcaagcatctcagattatgttctctctgggcaaaattgccaatatcttgattagaaattgtacacactccatcattatgtaaattcatttagcacctattctcagacaagagctcttcctggaattggtagatctctccagggtggtcagtgcaggtctgtatgaggcttggactttcttctgaggcctccctgccttgttggactgaaccagcgcttgtggttcctgtggctgctcacgaggacttgttggtccctgactggagattaagaaggaaaagattttttcataatttttggaccaatgaccaggagcatttttcagtccctttctagatgttggctttcttatata

SEQ ID NO: 12836 - DNA, 1052 bp, Homo sapiens
ttggattttgtcaaattttttttttctgcattgattgatttgatcatatgggtttttgtttgtttgtttttgagatagagtgtcactctgttgcccaggctggaatgcagtggtgcagtcttggctcactgcaacttctgtctcccaggctgtctcccaggttcaagcagttcttgtgcctcagcttcccaagtagctgggatcacaggtgtgcaccaccatgcccaagtaatttttgtattttagtagagacagggttttgccatgttggtcaggctggtctctaactcctggcctcatgatccacccacctctgcctcccaaggtactgggattacaggcgtgagccactgcgcccagccccgattttttctttcattttatttatatatttgtgtattgaactaccttgcattcctggagtaaatttcacatggtcatagtgtatgttccttttaacgtgctattggatttggtttgcaagtattttgttgagaatttttgcatctgtattcataaaggatgttgatctgtggttttcttgtgatatctttctttggctttagtattagggtaatagtggccccacaaaatgagttagaaagtattctctcttctcctttttctgggaagaatttgagaaggattggtgttaattgttttaaagtttggtaaaattcaccagtgaagcagtctggccctgggcttttctttgttggaagtttttttggttactaattcagtctctttagttgttataggtctattcagatttcctgtttcttgagtcaattttagtagtttggtctttctaggaatttgttcattttaccttttatctaatttcttgcatagaattgttcatggtattcttgtataatccattttacttttgtaaggttgttagtaaagtccccagtgtcatccctgacttcggttatttgagtcttgtctcttttttcttggtcagtctaacagtttatcaattttgtcgatctcttcaaagaaccaacttttggttttattgattctctctgttgttctcttagtct

SEQ ID NO: 12837 - DNA, 1051 bp, Homo sapiens
aaagtggaggttctccaaactggctgtacattagaattattgcggagatttaaaaaatatcttcgtacctgaggccttgcctcagacctacggagtcagaatctctaggggtggagctaaggaatctgtttcttactaccttcctcagtgattctttttttttttcttgagataaaatgtacatggccaggtgtggtggctcatgcctataatcccagcactttgggaggctgaggtgggcagatcacaaggtcaggagttcaagaccagcctggccagcatggtgaaaccccatctctattaaaaatacaaaaattagccgggcgtggtggcacgtgcctgtaatcccagccactcgggaggctgaggcaggagaatcgcttgaccctgggaggcggaggttgcagtgagccaggatcgtgacaccgtactcccagcctgggcaacagagcgagactccatctcaaaaaaaaaaaaaaaaagtatgtaacacaagatttaccactttaaccattttaaagtgtacatttcagtggttttgagaatattgacaacattgtgcaaccattactgctatctaatttcagagtattttcattacatagaaaaggaaactgtacccattaagcagtcattccccagtcctcccttcccccagcctctggtaacctctcaccggtttctgtctctatgagtttgcctattctgaacagtttgcataactggactcatataaatgtggccttttttgattggcttcttttacttagcttgatgttttcaggttttatccatgtagcaataggtatcagtgcttcattgtttttcatggctgaagaatatttcactgtatggttagatcacattttgcttatccattcatcagctgatgggcatttgagtcgtttccaccttttggctgttatgaatagcggctctttacatttctgtacagcttttgtttgaacacctgttttctttttttttttttttttttttttttgagacagagtctcgctctgtcacccaggctggagtgcagtggtgcaat

SEQ ID NO: 12838 - DNA, 1050 bp, Homo sapiens
caacctgcctagtagctgggactacaggtgcacaccacctcatccagctaattattttaattcttgtttcttagagatggaatctttctatgttgtgttgcccaggctgatcttgaactcctggcctcaagtgatcttcctgccttggcctcccaaagtgttggaattacaggtgtgagtcacagtgccttgtggctcaattctttagccttgtaactttgttcaaggccatttgttagaattttgtgtcttttttttctgggagtaagaccctaaaaagtaaccatgctctttgggtctatattaataattccatcttcatctccctttcacctctgggcttatgtgaaaaacctgctgacccaatcattgtttggcttcaacagccaggctgtgttaggaagccttttagtacacaactagaaggtagctgccttttttttttaagtcagtcctttacccctttcttcatcttgccttagatctttctagttttagaacatcaaccgtgtggatatatatatacttactgggctgatgactgtcacatttttaattagacaagttagactcatacttgtgaaattaagtttggccagctgcagagaaggcagctttatcatgagtctccagttactcttttctttctcttgtatctgcttctgaaactttccttcaagtaaattggatggtgcacgttgttttgtggtatgagagtgattggggtttcggtaagcccataaataagttatggggctcagaactgctttctgagcttcctcttgcaacccagaggaggtagagtgaattctttttctaatataaccattctcctttgctctttccatgtaattctagctcatcttatatcactcctctctcagtctcaggaattgcaggccacgatgggaatatttttgggggatactgcaggatctatatccccatgcccgactccctgtggcggtcatgaaaataattggtgagactggccagttaaaatcacaggaataatgatcttttattgtaattctatgtaatttctgctta

SEQ ID NO: 12839 - DNA, 1045 bp, Homo sapiens
aaaagtaatggggaagagggctatggccggagcttgagatacgccgctctgaatcttgccgccctgcactgccgcttcggtcactagtaagtttatagacctttgtccttgcgcaaattgaaggaaccgatgacaataaaaagtctgctgtttggcctggtgcggtggctcacgcctatagtcccagcactttgggaggccaaggcgggtggatcacgtgaggtcaggagttcaagaccagcctggccaaaatggtgaaaccccatctctactaaaaatacaaaaattagccaggtgtggtggcaggcacctgtagtcccagctactcaggagactgaggcaggagaatcgcttgaacccgggaggtggaggttgcagtgagccgagagcacgccattgcactccagcctgggcaacaagagtgaaactccgtctcaaaaaaaaagaaaaaataaataaagatttgctattttgggagaaaagaaaagggaaaagaaatggaagaaatgaattctcaaatgttaattgtgatgcatttttaaaaaatgtattttttaaaaagaagataggaaagcagctcatcaacctggactagtcagtaacttccatagagggaaccttattggcactggaacagtttatgaaaaccttctgcctaaatagtctgccccctagtgtcactatgtaacattgccgtcttagtgcctagcctctttcattacttctaagaacaacaggccgttcagtgaaaaagaaattaggtcattaggccagagagtccctaaaggattttttggaggtaaaaatggggatgcagaagctatttttagtatttcaaaaagccagaaggcagttgtacctttactggatgaaagactacataggcttactgaaagtcaggtttgctttcaggtagaattcaggctgctcagtcaggtgacactggtttatactgttgcctcagtgtgcctctgtttttaatgaatagaaataggaaaatcgatcaattatgttttagtaaatagaattaagtagataaaacaac

SEQ ID NO: 12840 - DNA, 1074 bp, Homo sapiens
actgaccagtagagatgagggtgaaagaaaaatggaaaaagaagaacttgatgtatctgtaaggtaatttggcttttctgacagggatccttttcctgtgaaatagtataatttcaagtgcaataagtccttgttcatttagaattcacgtgctggcttatgccctttttacccttccagatctgggaagttaactgataagggctgcaccagtgggtcccttgccctctgacttgtgattggccaatgggaggcactggcaggaaatcccaagggccagggagaatgacgtggagtgtggattcattggctccctttcttgggggtcctggggggctggctgtagggtcacagcttctgtcaggtcgctctttctgcactccttcagggggttcggtgactaggagcaagtgtttgcaggccccaggtgaaaggtaccccactgttatcagtcctggggactgtattgtgtcttatgacttctctgtcctttcccctacttttgtcaattgatcctttgttaaactcttctcagactactcaatttgaatgtgttctttgttttctgctgggtccctgactggtattgttcatcacatcagagtgaagtaacacttgattaattcagtgaaaatttattgaatgccttctaaggtctagcctctaaggaagctgttgtaaggaagttactcacttagttggtcaagcccaaaatgcagtagtatccttgattcctccctgtccttcaccccagtccctcagcagatccagtcagtccttcctccctgctatgtttggaacttgttcacttatctcatagccactgctacccctggagtctaagcacccaatctctaccaaatctactcaccaaatctgcactagcatcacttttctccttgacttaactcctgtctccctacatctgttcttcaggcagcatctggggaagcccctaagaatattaatcagatcccagcacttttctgcctaaaccctttggaacttagagaggagtttgagcttaccatggcctcagtgcctgtataacctggcccaatgaacttccctgac

SEQ ID NO: 12841 - DNA, 1031 bp, Homo sapiens
gaaggcactaggcaactcaagatgaaatcagagtgggccttggtctctccttctgtgtggagggttccttcccactctttagaacttaggaaagcagaggagccagtatcttgtcagggatatgggaacaatcttggtagtgacttggagccagtcaagctaggaaagatgccagctgtgctcaaaacaaaatgtgtgttccacccaagccagagattgaactagggttagattatgcagtgagttaatggagaaagacactggaaaccatgctgtcataataacaaccatgttatatcctacgccgcaaagtacttaagggtgggaatggcattatcgttgtgcactgtacatagttgctatttacatttatgaagtcaactgacttctcccctcactgccagaaaaccatttcccagccagcagcctacgacctctgaaagctctgaggatgaagattcctgcatctaccactgtgacatcatctttgaagtaggattgccaaaatattttgtgcatattctgggcataaacctgttcatcaacaaatgctgtattataaccagcttttaaaggacaaaactcaagatgataaaagttaatgatgggagggctgtttaagctagataggaacataagatttgttagtctgaacaccactgagggtcaggcatggtggcccacgcctaattcagcactagtctgggcaacatagtgagaccctgtctcaatttaaaaatattaagtacatatatattttttttacaattaaaaagaaaaaaataaatacaactgaattattttttcttgtccataaatgttccgtggcttgatcgtgttaccagctgaggaagaatttctgtgccaaatttcatcaatgtatagttgagaagtttttgttctgttttgttttgttttgagacagtcttgctctgtcacctaggctggagtgcagtggcatgaccacggctccctgcaggctcaagcaatcctcccccctcagcctcccaagtagctgggaccacaggctg

SEQ ID NO: 12842 - DNA, 1126 bp, Homo sapiens
tttctattatctggctaataaaccagggttacttcaaactactatctaaaaaatccaccaagcattttgtactctttctataaagaagccactaaaacttaatacacaaatctaagagtaaacattaaactgctttaaactaagactgtataaatctgaatttttgaatttaagtttagacaaaaccagcacctactgcttagcttctatggcctggatttaaagacttgccaccaccaagttaccaatttggaggaaatgttaagatttccagagtctcatcaaaagattactttgggaggaagaggcgggtggatcatgaggtcaggagattgagactatcctggctaacacagtgaaaccccgtctctactaaatatacagaaaaattagccgggcgtggtggcgggtgcctgtagtcccagctacttgggaggctgaggcaggagaatggcatgaacccaggaggtggaatttgcagtgagctgagatcacgccactgcactccggcctgggcaacagagcgagactctgtctcaaaaaaaaaaaaaaagtttagacaaaaagcacaagtgcccacaaaactctggcaacttatgctgcttctaaagggaaaccatgacctgctcaagccagttactaccaattgtggttgcagacaaacaagtgggaggccttgatttacatgctttgatcttcaaaagcagaaaatttttttctttactattagccacacaaactttctgcccaaagcacaggggcatctgcctcctggtgttcacaggtattttcagctctgttgatggactaataaattctgagcacccaaggccatatgtgttactcactgcacagtcaggagataacagactctgagaagtggccactcccagctgcactgaaatgacagttggtctcaactcaaccatcctgagtcaagtcaagttggacctaaaagagatttcacaacatttttgcataatagctcaagttcctctttttttttttttttttttgagacggagtttcgctcgtcgcccagcctggagtgcaatggcacgatcttggctcactgcaacctccgccttccagtttcaggcgattctcctgcctcagcctcctgagt

SEQ ID NO: 12843 - DNA, 1050 bp, Homo sapiens
tagagagtctcgctctgttgcccagcctggagtgcagtgcagtggcacgatcttggctcactgcaacctccacctcccgggttcaagtgattctcctgcctcagcctcctgtgtagctgggagtacaggtgtgtgccaccatgccatgttggccaggctggtctcgaactcctgacctcaggtgatccgcccacctcggcctcccaaagtgctgggattataggcgtgagtcaccacgcctggccgagctcttgattctattccattggtctatatgtctatccttatgcctgtaacgtgctttatttatgaatgaatgaatgacggggcttactctgtcatccaggctggagtgcagtgaggtaatcatggctcactgcaggctccaccttccaggcaaaaatgatcctcccacctcagcctcctgtgtagttgggactagaggcaccatgtttggctaattttggtgttttttgtttttttatagagacaggcttttgctatgttgctcaggctggtcttgaactcctaggctcaagtgatccacccacctcagcctcccaagtgctggtcttacaggcatgagcagtcgcgcccggcctatgtattttattttatttggagacaggatctcactgtgttgctcaggctggaatcatactcctgggttcaagtggttttccacctcagcttcagattagctcaagttcttcaactttgttctttttttggattgtttggacaacttggagccccatgcattcacatgaattttaggatagatttttctatttctgcaaaaaatactactaggattttatagcaatttcattgaatctgtagattgctgtgggtagtgctgagctgacatctgtattaagtcttgactttccatttatttatgtctaatttagtttttttcagcaatgctttatagtcttcaaagtacaagttcttccttggttaaatttattcctgaagctaggcatggtggcacacacctatagtcccagctactcaggaagctgaggtgggaggatcacttgagcc

SEQ ID NO: 12844 - DNA, 1055 bp, Homo sapiens
gccgggggttggtggccggcgcctgtaatcccagctactcgggaggctgaggcaggagaatcgcttgaaactggcagtggaggtcgccgtgagccaagatggcgccactgcactccagcctatgtgacaagaccaaaactgtctcaaaaaaaaaaaaaaaaaaagttaccattggagttgtagtaattgctaccccaaaatagtgccagttagcagcagccacaagcacatagcagtggttcctgacccaaaatacggacaagggacagcttcccgagggggtgcagaagagccggtgcctgacaaccagggtgttgagacagtgggggccgggaggcaagggccctggtgggcaggagggagcttggtttctgcctttgctgtcgttgcttacatgcaccccttgtgaccctgctatcaaggggcctgttgttggagagaaaaaaacccacagtgagttccattattgttctctgtctgtcgctgtggtgcaggatcttcgctcgctgcacttgccgttggggcggcagttggttctgaaggacttggggctccagtatgcagcgaggtacacagagcaatgctgcctgctcttcgcccaactaacccaattttggtctggtagcttaggatggtctggattggggggtgttgggtttgcgtgagagcaaaaaaagaaagagaaaaagaaactacaggtttttttttttttttacccttagaaattaccaagtactaaggacatccccatctcatcaaattacatttttcacacagcgcagtggtgacatacacgttgttttctcctctgcatcccacatttatgcctgataaactgtctggcaaccatgcctcatagcaggggcatgggagctttggatgggatgagatcattcgggacctaggaagccattccttctcctcatgaagttttggtggcagggattgttccacctcgtggacgcaaagaaccagagtgaattgaggcttctccagctcaagggccaggtcatggccttgaatgggtgatggagctgccctttggagagggcctg

SEQ ID NO: 12845 - DNA, 1048 bp, Homo sapiens
tgtgttttcttttgcctggaaacgggatagatgtgacgttggggagggggtgctgctgcttctggaagacgtggcgtcacagagccttgtgcccgtgggccatcttctccgcccgtccctcttctgagtcctggtgttccccgcagattaaggagtcagagggtgtggtcaacgacgagcttccaaactgctgggagtgtccgaagtgtaaccacgccggcaagaccgggaaagtgagtgccgggctccaagtcccagggtcagtcgggagaggggcgggcctgggcctggccgggaccagcctgtcccaggagtttcaggcaggtgggttgccgtcggcctggggaggaggaagggcaagtccaaaggtatacagttggtctgttcattctctctttttggcctacaagcaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatacgagaagccccaggagctgagtggacgcaagcgggtacggaccaggaggggctgggaggcaaaggggttggtctggctggtcccgggtgctgggttggagggatggggcagggggtgggcagcaggtagagcttgggataatcccggcctcttgctgccctgagcaggtcacctaagtcctgagagccctgccccaaagaaaggaggggaaaaccagcgagtcactcctcttcccactccacccccctttaggcctcatcgcttcaaacgtcccccggttcctcctctcacctctcgccgaggccccctctaggcagcagcctcagcccctggtggagatccagtctcacttacttccagcagcaggtgctcccacgacgcacgccctcctgaggccccggggactggcga

SEQ ID NO: 12846 - DNA, 1023 bp, Homo sapiens
gttgaaggaaaccccatttttctacgtctcctactctcttcagcttgacgtggcttctggaactgatggcagatgcaggcttggcctgacccttggggtccttcttactcttctcctagcccttctgctctgccagggcacttctcacgtgttacccacctgtgacatacgcagccccacctatcttccttttctggaccctccctttgctccgtcgctggggctgcctccgtagcctcccctctccaccatgtccctgccagtgtcatgccgatgtcatgctggtgtcctgcagtctgcccccccacatgcgccccaagccccctgccagcccctgcaggagatttgcctctggcaccgcctcccatcctgccacctggctcagagcccgttctgccatctgccccaccccaccacagaccctcttcttgccgtgtgggccgtgcttcaccctgtgccccccgctgcagtctggtccccagacgtcccctttggcctggcctgctctgtcctcattcaccttgaggccccgcggccttgcccacttggcttctctccaccctgtcctccaagtcctccagaaatcagcctctgctgcttctgagaactcttgaacatgatttttccatgttttctttggatttcagcgacttaatgtctttgtcttcccaaatagctcatggggagcagccatctccctcgctcctgtggccccaggaccttgtttcaggccgtggcagatgtgtgtttggtatttgtggaaggaacgatgactgccttgccttctgtgtcctgtttattagaattcaaacatttgcgccatttaatcaagtctttttcacttaccaatggcgtgtatatcccagcctgcttgaagctcctctgagcagcataataaaggttggctgcgtgcttcctctgtctgcaggtgcactgggcgggatgaggctgacctgccctggcctcagggggctcacagccgggtgcatcaagttctcacacttcgtggtctcagggacccct

SEQ ID NO: 12847 - DNA, 1115 bp, Homo sapiens
cgaatctgctttctgtcccgtggatttacttattctagatatttcattgtaacgtaggttttggtttttttttgagatgggggtctcactctgtcacccagcctggagtacagtggcacaatcatagctcactgcagcctcaaccccccaggctcaagcaatcctcccatctcagcttcccaagtagctgggactacaggcatatgccactactcccagttaattttttcattatttgtagagactacgtcttgctatgttgcttatgcctgtaatgccagcagtttgggagaccgaggcaggaggactggttgagcccaggagtctgagactgactttggcaacatagcaagatcctatgtctataaaaaataaaaaattagccatgtatagtggtgtgcacctctacctgggagactgtacagcgttagagggctgaggcaggaggatcatttgagcccaggaggtggaggctacagtgaattgtgattgcatcagacagagaccctgtctcaacataaatgataaatatagacacttactgtgatggaagtgccaagatattggcctgtatgagatgggaaagacaagaactcaggacagaggagaccctggagttcaagtttggtttctgctcttagctactcgctgtgtggccttgggcaagccagtccgcctttctgttcacctgtatggaaaatgaggatgtgctttgtccttctggggaccagattctgggactcttatggccattctgaagcacttacccttgggtgaaactgcagtgtcctcactatgatatgggcataacagcagggacctgtgtcactgaattactttaaggaacaaggaagccatgaacataggttgcagctaaaggtgagccaggctggctttggccagctacccacacttcccctgccctttctctttccttcccccttctcacctctcagcagccccctcatcccccctccaagttaaagattgctgtttaggctgtgcacagtgactcacacctgtaatcccagccctttgggaggccaaagtgggagggtggctggagctcaggagtttgaggccaccctgggcaacatagtgagaccccagtctac

SEQ ID NO: 12848 - DNA, 1009 bp, Homo sapiens
ggcgccgctgccccaggccctggctgctcttctccactccctgcaccctcctgcacgctcgctctccctccctgcagccttgtgaggtgtgggagcccacaggggccagcggctcatcctctccttgcccttcccaccccaggttggatccatgccgtctacacccctgtagactctttggtgttcggcggaaacatcctgcacagctttaacgtgcccatgcagctgcggatctacgagatcgaggacaggacgcgggtaaggaggttcccttctgtcctcgcgtgcgcgcctggcccctgagctctgccggtgctcggtgtgtgggacaggtcatactgaagtcctccacagttcccctctccctcccgattcctctctcaagctggcttcagtcctggttctgtggcgggggagggggggcaggggaatgcctgtaggagccacacccggaggccctggagtttctgttcacctccaggttgggggcagccaaaacccccttgtggaagaggaagtgtctctgagaaagcaccgtgagatttcagggacctgcctcttcctcctcacgtggagaaagtggtgtgagggattagggggatttggtcgctgttgtttggaggatgggtgtggaccttggaagggcctgtcctggtctgaggtcaggtcttggctatatgttctcccagggaccccagatctgactggggaggaagcctgaggaagccagtgcctgagtccccctgggtactgtctctgaggtagtctccatgtctgctgaggacgtctctagtttcctggggccgaggcttttctctgcccttgacagggacggtgctagtttcccagacgtcaagtttccctcactcaccccatgtcctacgaacatgggcggaggcttaggtaactgatgtgtgtccttcgctccacaagtgtcccctgaaaaggacaagtggcctgaacttgccatggcctttctcgtgctaggacttgatcacgtgtccctagg

SEQ ID NO: 12849 - DNA, 1051 bp, Homo sapiens
gcttattgctgtataattattctaaaacttcagagcttaagaaaaattttagcagcttaaaacatcaaacattatctcacagtttctgtgattcaggaatctgggaacaactgagctgggtggttctggctcagggtctcttataagcttgtgttaggccttggccatgtgtggtggcttacgcctgtaatcacagcactttgggaggccaaggggggtggagtgcttgagcccaggagttcaagagcagcctggccaacatagtgagaaatgttgcagtggggggaatgatgtaggcctgggctgcagtcagctgaagcctctatgggctggaagatccgcttccaagatggtgcatccccgtggctgttggcaggaggcctcagttccttgccacatatagctctccataggtctgcttgagtgtcctcatgatatggcagtgggttccccatagtgaatggttcaagaaacaccaaggaggaagccacagtgccatttatgacctaattttgaaagtcacatattgtttgctcctgccatattctgttaattaaaagtaaatcactaagtccagctcatactcaaggggaggagaatttagctctgcctctcgaagggaggtgtatcaaagcatttgtagacatgtttcaaagcctccacagttgcctagttctatgacatgggctcacctttttcacttagcaccgctgggttctgtgatagattccagaagtggattagtgagtctcctcccctcctttgctcctgtagaatacaggtttgtagagatcaagtttcttggtggaatgaagatatgctgtgatctgacaagcagtaaaggagctcaaaagcccagcaaaatggggaccccacataaagcataggtttggccctcagataattgatagttgagtgggttctcttccctgtgtactttctgggggtggcaggaggaactggggaaattgttgggggagtgagaacctgacacacagagaagaggaaacagaggcactgggctgggcacattttggggcacattttgtgt

SEQ ID NO: 12850 - DNA, 1027 bp, Homo sapiens
aagagtccatccctgtgagtaggatttaaaccttgggcatcattgttaattaatagtgaattgtagcccatattaccacatccctggaactagtacaatgcgtgtctttttttccctctgaacttaaaggggtccgtcccactttgcataaaactcctcatggagagtattttctagagggagaaagagacatagagagggctacccaccctaaaagaaagcaggcatttgaatgtctagctctggcccttacctttgaccccacacttccagcttccctggaaaaatggggtggacagtggatgtcctaccctctgctgaggttcaggtttgagttgcctcttggggtagggaagggcctcagtggttctggggtgaccctccctggaggcatcaactggtctacttctctccctctggatgttctcattttgagttcccaaactgaggggaaaggatctctcttggaaaaatggcttccccccgggcccagggtagtctagctctgttgtttctggcctctcaccaaaggtctgtgctcctctttccccaggatgcctgaccctgatttcacagtccgagacgtcaaactcctagtgggtaagtcgcttgccgtgtgtgtggctcagacatgctgaagtagggaaggggaaagaggcggtcaccacctgcccatttagacttttaactgcctctcaaaacaaagtccccacgggagaaggcaggagcaggtgtgagctgcaaccgtttcattctggagaacaggtagggttgcagtcttaagaagctgtatcagagggcgtttgccggtacacagttttatgaggcccatttggacgctgcctccagcctgggtgtcagcaacgcaatctgagatctctcttctgcatttgtttgtgggttgccgggtaaacactgggtgctttatgatccctcatagactttaaggctttcgaggcgaggggctgttcctcctgcttccttggggttctagacaagcctggggcagggcttggaactgcgagct

SEQ ID NO: 12851 - DNA, 1124 bp, Homo sapiens
ggggaggagacttgaggccaggagttcgagaccggcctaggcaaaatagtgaaacctgtctccaaaaaaaaaaaaaaaaaaaaaagtagcgaagtgtggtggtgtgtccctgcagtcccagctactgaggaggctgaggcaagataatctcttgagcccaggagttcaaggctgcagtgagctctgattgcgctgctgcactctagcctgggtacaaagcaagatattgtctataaaaaaaaaaatagaagaaaaataaaaaggccaggctcagtggctcatgcctgtaatcccagcactttgggaggccaaggtgggtggctcacctgaggtcaggagttcaagaccagcctggccaacatggtgaaaccccgtctctacaaaaaatacaaaaattagccgggcatggtgatgcatacctgtaatcctagctactcgggaggctgaggcaggagaatcacttgaacccgggaggcagaggttgcagtgagcagagatcgtgccactacacgccagcctgggtgacaaagtgagactctgtctcaaaaaataaaaataaataaaacaaaaaataaaaaataaggcttggcgcggtggctcatgcctgtaatcccagcactttgggaggccgaggtgggaggatcacgaggttaggagatcgagaccatcctggctaacacggtgaaacccgtctctactaaaaatacaaaaaattagccaggcgtggtggcgggcgcctatagtcccaactactcgggaggctgaggcagaagaatggcgtgaaccagggaggcggagcttgcagtgagccgagattgcaccactgcactccagcctgggtgacagagcgagactctgtctcaaaataaataaataaataaaataaaataaaatataaaaaataaaaataatgaggccgggtgcagtagctcccgcctataatcccagcactttgggaggccgaggcgggatgatcacctaagttcaggagttggagaccagcctggtcaacatggtgaaaccccgcctctactaaaaatacaaaaattagcagggcatggtggctgccatctgtaatcccagctactctggaggctgaggtgggagaatcccttgaacccatg

SEQ ID NO: 12852 - DNA, 1032 bp, Homo sapiens
gccaacagatgagggaagccatttttctgcaatggaattaaatggccaagtgggtttttcctttgttgcaaatggggaatgtttttcctttgactctaccatccagttcaggacgtctcagtgtgtttaacatttgtcaacaggcccaaggactcacagttggaagactggagaagactttttaaaaagatctggatttttccttatgacttggaatccatctttgtcttgtataactaggtcatagcacaccattcatgtcagcagttaacagttttgaattccaaaaaaacctaagtaaatgacatattttttttcctctttttgttctatgggtgggtggggggagcttggagctgtcttaatctgtattctcttgactgaacaataaatttttaaatatatctagtttcctctattaaacacttaaacctggccatcttattaactccttctctctttttaacaaggtaatgttttaaatgtatatagctttaggactagcgaaatggcagcaacaaaaaattgtgagcagttgttactcttttagtttttaaaaaaccttttacattgtaagtacccaatccattctgtcctgacgcagtacagttttgatgttaatgttgctgagatgtccttaattttccgaaccttcatctgcatgtatgtctttgtctctcttgtctaatataagccagttaagatgcttgagacgatcttgctttataaagctaaggttctagctttatgcttttgaaaatgtttacagcactaaatgctagtcagctttcttccccgtagcttgtacactttctttgaaaatcgatctatttgaagaaaaacagccctgtttttctcgtctttggtgttgggggttggggggagctggtgggtgagggaaaggaagaccttttctttgtgtagagagactaaagccgtcacaggaaactagattaaaactggaaaacaagtcctagctggttccagcaaacaccaacgttaagtggggggtattttctatggtggttgggc

SEQ ID NO: 12853 - DNA, 1031 bp, Homo sapiens
tttcagtatggccggctcacgcctgtaatcccagcactttgtgaggctgaggtgggcggatcacttgaggtcaggagtttgagaccagcctggtgaccaacatggtgaaaccccatctctactaaaaatacaaaaattagctgggcgtggtggcaggcgcctgtaatcccagctactcaggaggctgaggcaggagaatcgcttgaacccaggaggcggaggttgcagtgagcagagatcgcaccactggactccagcctgggcaacagagcgagactctgtcaaaaaaaaaaataaaaaaaacacacaactttaaataggtacacatatgtaaacacatgctagcctgctctttgggctgttttcactgtgtcctgcgttcctccctgttcctccttcgtctttccctttctcttctcactcccacaaccctctcattaaaggcctcatccccgccctctgctgataaccaagtgctgagtcaggccgagaacataaaccaggcgctctgaatttctccttccaggctccccatgctttcattctgcacctgagaaaaccattttaacattttctgttctagcctttatgtaattaccattaatttctatgagctaatttaatgtcctcttcagagtctatggctggaaagtaataatccttcagtttgagtaataataataatctttactactgttttggcccataacatcttaaacacccattcttggaacttgctacaaaagttactgaaattagtgagaaccaattgatatttccagcataaagctgctctgcatgacatctgtataactgctttgcatgtgtgtattttaattgtcgttattgcttggtaataatttattcaagaattaacaaacttcaacttggggttagattttagtagaatattggggagggtgcaaccgttttttttttttttaattctacctcttccaaatttattaacttgtttctttaagttcaaatggatacaatcacatgcagactctggcatgtctatgcatagg

SEQ ID NO: 12854 - DNA, 1020 bp, Homo sapiens
atgtaaatggattttagataatagttggggcccttcattgccttctaaaactcagattgataaaggattcatatgtaggcctatgcgtgtaatggttaaataaatgtgtcaaccattgagtaccaaaaagaacttaatatactattaatttaaaaagccttgcaaatacttacattgtgagtatttgaaatgtagttggtcatgcaagaactgagagcttagtcaacacttgaattcagaagtgatcattaaacgtacatagttaagatagtaatagaatcactatggccaaatagtcatgatattcaagtgcagaacttactcccaactgtaggattaaactggttatcatgaagaaattagaatccggctgggtgcggtgggtcacgcctgtaatcccagtgctttgggaggatcacctgaggtcaggagttcaagaccagcctggccaacatggtgaaaccccatctctactaaaaatacaaaaattagctgggtgtggtggcgggtgcctggaatctcagctactcaggagtctgaggcagcagagttgcttgaactcaggaggcggaggttacagtgagccgagatcgcaccactgcactccagcctgggcaacagagcgagattccatctcaaaaaaaaaaaaaaagaaaagaaagaaagaaaaagaaaggaattagtggaatccttctttatttgctgtggggttttttttctttttgttttttgtttttttgtaactttaaacattgagttgcaagcagtatgtagtaaaaaatttttccccaagcataaaaatgtaatcatttctttgaaaaactctcaagttgggtaagccttttaaaacaggctctaagagtctaatgggtaaagcagggtatgccttgcattgctctaattgccagaactgggggagtttgttcatctgtgcctctgaagcctgatgcagatttgggagccggtttggttgctccattctctaggctttttagtgtcaaagaaggggctccaaagcca

SEQ ID NO: 12855 - DNA, 1079 bp, Homo sapiens
acattaacccaggaggctgaggttgcagtgagctgaggtagggccattgcactccagcctgggcaacaagagtaaaactaaaaaaaaaactaaaaaaaacttaaaaaactaaaaaaaataaaaaaaaataaaaaaaagaaaaaagaaataaaactgctagatgcagcttgctatctcctagattgggtaataatcctggaccagaagaagaaaaaacattgttttctataaagatcagtatgataaatatcaaacatctcttccttggaaattcaggcacatggaccctctaagaaagagggagaatctttgcgtattgtgtttttgtagggttgaatgatttttcaaatattcactaatgatttttattttgttttgtgaattgtctgccatgctctttgtccatttatatattcattgtaaaaattttccagttttaagtattgatttttttaacttttaaattataaaactaaaacagattccttctttaaagaataaatataaactgtacaaagggcataaagaccaaaatgaaaacccttctcatctccatatcccactctccagatgttctctttctcatttcattttttaaagtttgcctcccactcttttttcttcctttcattctaaaaatttctaaatatttctgtgaattagtcatgcagcaaaaacatacatcttaatgggctaggacatcaaagagtctataaaactatgttaacatttacagatttcatggtaaagggatatttatgttcagaacataatgtatatttaagaatttttaaaataagacctcatagcaaagcatgaacataagtaataattaataatgactataactacttagagtgagctagtaacttaaattctaggctgttggaagccattacataatctttggtgttatctttttatttaaaaaaatataagagctttttgacccttttaaaaaaattaacagtgtgcagcctggccaacatggcgaaaccctgtctactaaaaatacaaacattagctgggcatggtggtaggcacctgtaatcccagctatttgggagactgaagcagga

SEQ ID NO: 12856 - DNA, 1084 bp, Homo sapiens
agatagtaggattatttttagacaggaaacaggctcaaaagtgaactaatggctgggcacagtgactcacacctgtaatctcagcattttgggaggccgaggcgggtggatcatgaggtcaggagttcgagaccggcctggccaagatggtgaaaccccatctctactaaaaatacaaaaattaaccaggcatggtggcgggcgcctgtaatcccagctactcgggatactgagggagagaattgcttgaatctgggaggtggaggttacagtgagccgagatcgtgccactgcactccagcctgggcgacagagtgagactctgtctcaaaaaaaaaaaaaaaaaaaaaaaaaaaaagtgaacttaccaaggatacacagataggcagtggaggagctgagatttgaaattgtgtttgaaagcctgtttgtccagctgctgttctattctgagaataaaacttttttctgcttacttcatgattattgttcaagattttaaaaagctgtgagctagaaatggggtaggtgcggtcaaacattgctctaaaaatggcttctgaaccctactggtactttttttttctgcctcaaatatttattttgcttagaaaacccagtgcatcccagaatcttgccattcacaggtctgcttttgcatcttttcttgtctcctttctcacttggtgatcatgtcctcattgttaaaggcccatgttaaaggtcatggcctctgatcttgagcagagcaagctgctgcccctttgtggtcaggtgcgggctctgcagtgccctgaccttagaacccagcattttggtcaggatcgtgtgcttctgcttctcccacagacagtgagaaagtaggaatcatagagcacgacgtgtaggtttgaatgaatgcatgggtgtttggtgagtatcttgtttttagccagggccccagtttctgttttacagaagaagacagaggactttgtgactgctctttccattttttagatgattcactttacttccagcttcatagctgaattagtcggggttctctagagggacagaactagtaggatagatagatatcaag

SEQ ID NO: 12857 - DNA, 1052 bp, Homo sapiens
ctgctgtcacgctaaccccagcctgtgctgagctgttcctggtgctgtactccccagacctctgatccctgaacacattcaggtggggagggaccggatcccagggcagaaagagcctgggctgctttggattttctactatttttctgccccaacagacctgagggaatcacatcttcctgtcagtgacttggcacaatatggctgggactgttaacgggagggaggaacagtgggagacacgctggtagcgttccatggaagctggcacaggaggtatggggagtaggttgaaaaagcccctgcccctgatgactggtggctttgtggtcagatttccagggccttctgcggtaagaggactgtgtaatgggaacagtgcttctcaaaacaaagcagtcactttgctattccttagtcttattcctcagagctcaaagctggagaatgagcagctgcttacttcttccgtggtttaacgtgtatggggttttgcgtgtcctctggagcttttttggtgtttctcttcacctaataggactgtggttcctggagaaaaaggggcaccaatatagacacagggtttcttatttttttgagacagggtgtcactctgttgccctagctagagtacagtggcagcagtctcagctcactgcagccaccacctcccgggtttaattcatcatgccaccccagcctcccaagtagctgggatcacagacatgcaccaccacgcccaactaatttttgtatttttagtagagatggggttttgccatgttggccaggctggtctcgaactcctggcctcaagtgatccgcctgcctcagcctcccaaagtgctgggattacaggcttgagccactacgctcagccaccacaagggttctaataggaacccctccctctagaatattgcccttgcccctggaaaccagcacttgtaactgttcttttcctgtgtgccacttacaaggctgcttttaggaaagctcttgcttgatttcggttagccagctcctattttcagttgtagataacaatgaaa

SEQ ID NO: 12858 - DNA, 1071 bp, Homo sapiens
aggctgaggcacaagaattgcttgaacccgggaggtggaggtggcagtgagctgagatcgtgccactgtaccccatcctgggcgacagagcaagactccatctccaaaaaacaaaaaaaaacccatgctgtgataaataacattcacagcaaaattaagggtaagagcttggagccctttgcatggcagaaatctcattggagtttttttctgtggcataatgagaacatgatctgtcccctccttttctgggggaaatactgaacaagtgtgcatgtggtcaaggcttaggaaattacgtgaaacattcgccagctgcattccttactaactagccttgttaaatgtcatctttatctttaaaggtggttcgaggaattgtttcccagtcctgccactagttgaggcactggtattgatgctcaatgttctgaacttttttgtgggagaagctgctctattggcaaagaaggaagggttgtgatggttaaatggggtgaggtgaggactgacaaacagcaaaaaattgctaactaaccatagtcgaagatgacaaactggttacaggaaatttttctcaaatctcctcatgtggttccgaaatactaatcaaaacacaaaaattaattagaagataatatttagctaatgctagtttactttttaacatcaagatttcatgaaagccaagttctaatgactattgtccagtggatttttttgttttgttttgttctgtttttttgagacagtctcactctgttgcgcaggctggagtgcagtggcacaatctcgagtcactgcaacctccacctcccaggttcaagcgattctcctgcctcagcctcccgagtagccaggattacaggcgcccgccatcatgcctggctcatttttgtatttttaatagagagagggtttcaccatgttggccagggtggtctcgaactcctgacctcaagtgatccactgacctcggcctcccaaagtgctgggattataggcttcagccactgcaccttgcctgtccagtggatttttaaattttatttaaatgtcaaactactttaa

SEQ ID NO: 12859 - DNA, 1004 bp, Homo sapiens
atcttgatgcacttcggaaagccagttccgaaggtaaatcggaaatgaagaaacttagacagcagcttgaggcagctgagaaacagattaaacatttagagattgaaaagaatgctgaaagtagcaaggtttgtattgacatcctccattcttttcttttccatttgttattcttgttttgcattatgttacttttgagttgagatcattcatcttccaaattgctgatttaattaaattgcttgatgtccccagttgagtatagtgtagtatgttctgagtatctcaagtatggtttcatctgaggagattagagaaaataatggctcaaccatgtgaatttattttggttgcctgttatctgggtacctgatctatttatctctgggctatgctgtgacttctaatttaagcttagctccagtctataatctgtttaaaataaagaatgccctaacactatggtgttaagatgaatgaatgaacagaaactcaaaagatcggccaggcgcagtggctcacgcctgtaatcccagcactttgggaggctgaggcaggtgatcacctgaggtcaggagttcgagatcagcctggccaacatagtgaaaccccatctctactaaaaatacaaaattagcctggcatggtggcggacacctgtaatcccagctacccaggaggctgaggcaggagaatcacttgaacaacccgggaggcggaggttgcagtgacctgagattattccactgcactccagcctgggagacagagcaagactctgtctaaaggaaaaaaaaaaaaaaagcttaaaagatcatctcctcctcttctaaccacatatagtcaggtgccacataatgatgtttcaatcaacaatggaccacataaacaaaggcggttccataagattgtaatatggtatctttaccttttgtatgtttaaatatgctttgatacacaaatacttagcattgtgttacagttgcctacaacattcagtacag

SEQ ID NO: 12860 - DNA, 1069 bp, Homo sapiens
ttacgtgagtgagttctttagtggtgttttgtgagattttggtgcacccatcttccgagcagtatacgctgcacctaataattcgattttttctgtttttctcaatcctcttatcggtgacttagaacctcaaacctatgagcctggttgtgaccttgcatttacattgagtgtttcttcattgtctacttggggaattcttgggctctttttgggtgggagtttatgctctggggaagttgttctttacctgaaatccatttgcctagattgctgatggagtagttagtggcaggatttgctgttttgtgtggtccacaattgagaagatgccagatagtcacatttagttaaaagccccttttggctgaatcttgagatcgtttctaacacaatggattttacttagcttaattcctttgcgatgaggtttgctgcagatttgaataattattttttctgattttagttttgtttttttttttttaatcaagatggaatctcgctcttttgcccagctggagtgcagtggcatgatctcagttcactgcatcctctgccccgtgagttcaagcgattctcctgcctcagcttcccaagtagcgtagctgggattacaggcacccaccaccacacccgactaattttttttttttttctttagaccaggtttcactcttgtcgcccaggctggagtgcaatggcgcaatctcactgcaacctccgcctcccgggttcaagtgattctcctgtctcagcctcctgagtagctgggattatctggatgtgccaccacgcctggctaattttgtatttttagtagagacggggtttttccatgttggtcaggctggtcttgaactcctgacctcaggtgatctgctcgcctcggcctcccaaagcattgggattacaggtgtgagccaccacacccagactgtattttttttttttccccatagagacagggtttcaccatgttggccagtatggtctcgaactcctgacctcaagtgatccgcccaccttggcctcccaaagttctgggattacaggcgtgagccactgt

SEQ ID NO: 12861 - DNA, 1050 bp, Homo sapiens
agttattcttggcttccttgtttaaaacaaaacagcacaaaacaaacaaaaacactttggtgaggcacagtggctcatgcctgtaatcctaacactttgggaggctgaggcgggaggttcacctgaggtcaggagtttgagaccagcctggccaacgtggtgagaccccgtctctactaaaaatacaaaaattagccagatatggtggtgcacatctgtaatcctagctactcaggaggctgaaggaggagaatcacttgtacccggaaggtggaggttgcagtgagccgagatcacaccactgcattctagcctgggcgacagagcgagactgtctcaaaagaacaaaaaaccacactttaaaacacctttctaagagttctgggctactcctgtgggctgttggctttctctagtttttctttaagttagaggttgtctgcttgaaaattaaatcgaatctcttatgatcttttgttttcagttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacaga

SEQ ID NO: 12862 - DNA, 1907 bp, Homo sapiens
cacttgaggtcaggaaatcgagaccctcctggccaatatggtgaaacctcgtctctactaaaaatacaaaaaattagctgggcatggtggcacacgcctgtaatcccaactacttgggaggttgaggcaggagaatcccttgaacccaggaggcagaggttgcagtaaggcgagatgccactgtactccagcctaggtgacagagtgagactccatctaaaaaaaaaaaaaaaacaagattgccaatctgcagtgaattttagccacagggacaatatataacttctttagatcaagtttcattattaaaaacatttctggctgggtgtggtggttcacacctgtaatcccagcactttgggaggccgaggtgggtggatcacttgaggtcaggagttcaagaccagcctggccaacatagcgaaaccctgtctctactaaaaatacaaaaattagccgggggtggtggtgtgtgcctgtagtcccagttactcgggaggctgaggcaggaggattgcttgagcctgggaggtggaagttgtagtgaactgagagtgggccactgcactccagcctgggcaacaggaatgaaaccctgtctcaaaaaaaaaccaaaaaacaatttttgtgcttttagtatgtattcttattagggagaatagaagtgaatctttaacctttgaattcacattcaccttgcaagatctctttcacggaagggtagttactgagatgtgtctgagtggtagcgggcattagagtgggagtgattctcgagccggcttgccatggtggttttctggggctcctggaacagtgactgccctctgtgctttgcgtgaagtgttgtacagcactaacttcaccaccaaactttgggattcattgctggggccctgttttgttttcattcaagatcctggtaactcactcactctcttctaccacaagtcaattttttccttatgtggatattttgaatattcttaccttaatgaggcaggttataggggattgcttattaaaaggaataaatacagaaagcatatttttatgttttgagaaggctatggtcttgaactgtatgtatacccaacctcagatttccttctttcttttgttttgtttttagagatggggctcgttctattgcccaggctggagtgcagtcgtgtaatcataggtcactgcagtcttggcctcatgggctcaagccgttctcctgcctcggcctcctgagtagctcgctctataggcgtgatccaccacacacagttaatttgtatttttttgtagagatgggggtctcactgtgttgcccaggctggtctcaaactcctggacttaagcaatcctctcacctcagccccctaacgtgctaggattacaggtgtgaaccactgtgcctggcttggaagacagatttttatgtaatttactgttcaaataatgtgtagtgataagaagtgatatctgagaggaaaatgaggagcttggattcttagaattagtgatacaactaacatttgtgattcttgtatggactggtggtggtgcattcaaatggtgttccaactatttgaaacatcccccaggtgctggtgttttccaggcattgaggctatgacagtatctaacgcgctaaatactaaatcttgactttatgaagggtagaacacatttttgtgttgttgggaggaagaatagtcctactttcaggaatactaaatttgacatcccaaatgtcatttatttttcatgtcctaaagctgacatgaagttcttattactattttatttattattttctttttgagacgaagtctcgcttctgtgccccaggctggagtacgatggcgcgatctcagctcactgcaccctccgcctcctgggttcaagcgattttc

SEQ ID NO: 12863 - DNA, 1033 bp, Homo sapiens
tcatgacctcatagccaggctgttcaaaatgtttgcccagcttctggcaggatatgagctgatgcctgccccgattctacagacaccatgaggtactattttcatattctagatttgtgttgattttcttcaacttcttatagataaaaagtaaagacattgacaccaggccctctttattttgctgaaagagatcgtataatgatgagaaaattattgtgagtatcctctggcaggacttttaaaggcagaaaactccacagttgaatagaaagtgtttttactgtgtgtacgtgattagtcagtagctctatttgctacggaatttactatccattttttctgcaaataaacataaagttttttcttctgtgaaaaagtaacagtttgaaatgattagactaggttatcagtggcagaaattctttatgacccagaggtctcaattcagatgcatcacaatcgagaagttgtcaccatctgtttttgattattttgccttgtgctgtttatacctgtttcagttggagttggaagaaaaggtgttggttcgtacagatattcagaaagctagtctctgagggttaatattaactttttaaaggattgtccttctttttttttatttttgagccggagtctcatgctgtcgccagactggagtgcagtgatgcaatctcggctcactgcaacctccgcctcctgggagctgggattacaggcgcgcaccaccacacccagctaatttttgtatttttagtagagatgcggttccaccatgttggccaggatggtctcgatctcctgatctcgtgatccgtccacctcggcctcccaaaatgctgggattacaggcatgagccactgtgcctggcctaaaggattgtccctttaagtaaataaaaacttagaaaaccctgtgtttctgtattctgggtgcaaacacttgataaattgtccctttccatcttttttttttttttttttttttttgagacagcgtctcactgtgttgcccaggctggagtgcagt

SEQ ID NO: 12864 - DNA, 1055 bp, Homo sapiens
aatttgccgggtgtggtggtgtctgcctgtagtcccagctacttgggaggctgaggtggaaggatggctggagtctgggaggtcaaggctgccatgagccatgagtgcatcactgcagttcaacctgggcaacagggcaagactctgcctcaaaaaaaaaaaaataaacaacaacaaaaaagtcttggtgaacagctagccaccctctccccctctccatatgtattcacttccatcctggcttggctgtactgcactcttgtttctgtggagaaagcagctcagtagagtctgtttcttcactctttcggttgaagccgttttactgtggctcaaaagaattttttttctgcctgtgaaattaattatacctgttcattaaataaaatttctatagacccaagaaaacacagataaaaattaccagtgattccattgagataattgttctgagtccctgttacagttcccttcaatttcagaatttttaagcacttagaaataataaaatgtcactaattcttactctgtgctggcttgcaaacttcaaaactcttaagagggaggaaacaacagcctggccattttgccttttcctcacaaagatacacagggctattccggagctgtcccgaggctttattcttctggcattttcaaaatgacttagacatcttaatctccacttctccttagtaaacagggtaaatattggggctggtgaactcaatagtttattaggatggcaagggtaacattttaagtttatgatttattttctactcagttatcaggattcttttttctttcctttttctttttttttttttgagatggagtcttgctctatcgccaggcaggagtgcagtggcacgatctcggctcactgcaacctccacctcccaggttcaagagattctcctgcctcagtctcccaagtagctgggactacacgcacgcaccaccatgcccagctaatttttgtattagtagagacggggtttcaccatgttggccagggttgtctctatctcttgacctcatgatcagcctgc

SEQ ID NO: 12865 - DNA, 1024 bp, Homo sapiens
agatctgggttctttcttcactgatggcagaggtctgtacttttcactttggcaaagttagagccacagtctttcctttcacttctgaatccttgaccttttgcttacaggatttggatttgatacccaaaacaggactagaactgtgaaggtatggagttagaaacagatcttatttaattagtgtcctcaggttgaagttgggaatactgagccggggaaggggttatgtgagttgttcagggtcatccaactggggtggaatttaggtgtctcacttcctagtccagctctctgttcatacttttttatttatttgaaccatgacatttaaaaaataggagtaaacataaccttaagaaatcagatgagaatatgaagaatattactgctttttgtatgaacataattttcaccattcttgtttttgggaactgcttgttttgtggaacctcttgtttctgtaaattgcttaaggttttttttttttttttttggatatctggtcaggaggaagggggattagattttattaaaatatatattttctataataagtgtctttttttcttaaactttttaaaaaaagattttagagataaagtcttgctaatattgcctaggctggactcaatctcctgggctcaagcgatcctcccacctcagtctccgaagtagctgggattccaggcaggcgccaccatgcccggctaattaaaaaaaattttttttttttagagatggggtttcactatgttgcccaggcagctctcagactcctggacttaagtgatccacctgccttggcctcccaaaatgctgggattataggtgtgagccaccatgcctgggcaaacttgtgtgttttaaaaacatattttgttcttacgagtaaaatgtctctgcttttataaaaatatagtactttaattattcacattataatgctttttgtgatataaagcatttcaatcttagaggctcgtccttaaaattaattttttttttttttttaaggtggagt

SEQ ID NO: 12866 - DNA, 1045 bp, Homo sapiens
tgggtggcagagtaagactgtctcaaaaaaaaaaaaaaaaaaaagagctaggaaataacccaaggtgtactcctgccttgcccctcacttcctccccattagccttccacccactcagtaaccagcctgcacctccagtcaaatttcctactgcattctgccacaaatttttgggtagagtgcactgccttgaaattctgaagtctccatgcaattgctcgcatttcctcaatctaaaatgatgcacacagcacagaaacagatctcccgagggatagcctttagcaccagaagatcctgacagctatccctgcagatcttttcaggtggactgaggataccaggtggtggtaatggcacctgagaatccagaatttccctcatgttaagccagttatttttggccattgaattactggatacacctgagttcaaataacaaattttagtaaaaccaaatgctattataagttctaaagtatctcttaactttcttacttcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtc

SEQ ID NO: 12867 - DNA, 1027 bp, Homo sapiens
gtggtggcacatgcctgtagtcctggctactagggaggctggggtgggaggattgcagaggttacagtgaggtgagatcacactagaccctgtctcaaaaaataattagttaattcatatacacctacaaacttatatagcagttactatttaaaggaataaatttgttacttgtttacatttttaatttcttttatagaatctttctagaatcttaattgaagtcttatattcatcaacagcagttttctctgattttgtgccctcagaaagggagccaaaatagattggttagagtatctaaatctaaaagtactctaacattttaaaagtttttaacaatatggatttttctgagacagtattattaattttacagaattaacttgggaaataagtttctatctataataaatctaaatatattatcactctttttcctgattattcttgccttttttcccctcaaagtaaaatttctcattttttatatgaatggtttttccatacttaactcttttccagcttccatcttaggtctcaggattcaacaatgaactattgtactgttttatttaaaaagcatattcttggccggcgcagtggcccgtgcctgtaatcccagcactttgggaagccaaggcgggtggatcacctggagctcaggagtttgagaccagcctggccaacatggcaaaatcctatctctactaaaaatataaaaattagctgagcgtggtggcaggcgcctataatcccagctactcaggaggctgaagcagaagaatcacttgaaccaaggaggtggaggttgcagtgagccgagatcgtgccattgcactttagcctgggtgatgaaagcaaaactccatctcaaaaaatataaaaataaaaagtgtatccttggtgttcttaggaactggacagtagggaaacagccaaagacttgaagttagagtctagtgagcagatagaaagttctcaatcacgcaagactgtgtaattcattacgggcggaagtgcatga

SEQ ID NO: 12868 - DNA, 1054 bp, Homo sapiens
tcattgggaagctccattgttaggagctcagcccagtgatatgtatagaagcattactggaaatgttcaagagagagggcagtgtcattaaaaaaatggaggccaggcacagtggctcaacacctgtagtcccagcactttgggaggctgaggcgggaggattgcttgaggccaggagtttaagaccagcctggacaacatagcaagaccccatctcaaaaaaaaaaattagctgtgtgtagtgacacaactactcaggagactgaggcaggaggatcattttagcccaggactttgaagttacagtgagccaagatcatgccactgcattccagcctggacaacagagcaagaccctgcctcaaaaaaaaaaaaaaaattaaagagtatatgtgaggccaggtgcagtggttcacggctgtaatcctaacattttgggaggctgagtcgggtggatcgcttaagctcaggagtttgagaccagcctgggcaacatggcaagactgcctctactaaaaatacaaaaaaatagctgggcaaaaaaatagctgaccgtgcttgtggtcccagcttctcaggaggctgaggtgggaggatcgtttgagcctggcaggtggaggttgcagtaagccaagattgcaccactgtactccagcctgggcaacagagaccctatctcaaaacaaacaaaaaagtgtatgtgtgtgtgttcggtgtatgtgtaaagagagagagaggcagacaaaaatgttaaactattaacagttgtttaggtgaaggatacattgggtattcattgtaccacttttccaacttgtctgtatggaattttttcaaaaagaactggagggataagaaaagagtaaatgggaagaaaggaaatggaaacaataactaaagggtctgcatgtcttgcaaagagaagcaatgaaatggggcattggagggaaatatgagagtcaaggttttcattttttgtttgaattctgtagagaatgcagctgatagtcatgatccaatacagaggaaaaactgatctagcagagagagggaa

SEQ ID NO: 12869 - DNA, 1082 bp, Homo sapiens
tcctgagtagctgggatcacaggtgtgcaccaccacacctggctaatttttgtatttttagtagagatggggtttcaccatgttggtcaggctggtctcaaactcctgactttgtgatccacccaccgcggcctcccaaagtgctaggattacaggcatgagccaccacgcctggccatgaattgactttttaaaagagctgggttctgtgtggaaaatagtctgtagctggttatctgtggaagctgaaaaccagttaggaagttattgtattcaactcaggtgagagaaactggtactgagactggagtgagagtggtgctgctgagaagtgcttagaacgtggatgtactggggaagtagagctgatcaaatgtgttgatgaattggacgcagaatatgagagcaaaagagtcatcggagtgactcaggtttttggcccgagtgccagtaagaatgtcgtcgtaaaaaattagccaggcgtggtggtgggcgcctgtagtcccagctactcatgaggctgaggcgggagaatggcatgaacctggaaggcagagcttgcagtgagccgagatcgcgccactgcactccagcctgggcgacagagcgagactccatctcagaaaaaaaaaaaaaaggatgtcgtcatattttctctgatggggaagactagaggaggagcaggtttggagggggctagaaatccagtgcagttttaagcaggtgagtttgagatgccactcacacgccccttgagagctgtcaagttgacacttccatatataaaattggaggttaggactgatcagaacttgaccgtaaaggagaacatatattcagggcaacttcaatctatgctcccagtgaaaaaataataattaaaaagtgataacttaggccaggcgcagtggctcatgccagtaatcccagcactttgggaggccaaggcgggcagatcacctgaggtcgagagtttgagaccagcctgaccaacatgaagaaaccccgtctctactaaaaatacaaaattagccgggtgtggtggtgcatgcctgtaatcccagctacttgagaggctgagg

SEQ ID NO: 12870 - DNA, 1149 bp, Homo sapiens
atacatatcccaaaagtatatttttgtttgtttgttttttgtttttagtatagacggggtttcaccatgttggccaggctagtctcgaaatcctgacctcaggtgatccacccgtctcagcctcccaaagtgctgggattacaggcgtgagccacactgcacccggccaaaagtataatttaatagtgtcagcctagttcacacctgtaatcccaacacttcgggaggccggggggcaggcggcaggggggatccctgaggtcaggagttcgagaccagcctgaccaatgtggtgaaaccccgtctctactgaaaatacaaaaattagctgggcgtggtggcatgtgcctctaatcccagctatttgggaggctgaggcataagaattacttaaacccaggaggcagaggttgcagtgagccgagatggcaccactgcactccagacgggacaacagagcaagactccatctcaaaaaaaaaaaatacataaaaaatagtgtcaagtgagagaatatttatctccatctgaattcattgtaatgttttatgtctgatttttagagtgaagatgaagctggatgtagctcagttgatgaagaaagttacaagactctgaagcagcaggaagaagtatttcgaaatttagatgctcagtatgaaatggcaagatcacaaacccacacacaaagaggaatgggtttgggtttcacatcttcaatgcgaggaatggatgcagtttgaaaatgatcacacttgtaaagtttgggacttatagacttcttgttctgatgtcacgtccttgttcaccaaacagctagcactctagcttgcatgggtgttgcattgactttaatttattgaaaaatacaaatttttgtaaatatcagatcagtgatactggtgttagtgttgtaatcaggttaaacccacttccattaaacttgacaggactatagaaggataatattttttagttcatgaattctacttttcaaatatataaaagctgcaggtggggataaaatctcatacatggattttttcgtgtccgctgtcttgtgtacttttgtacttaaccttgtacagttattttcatctcttgaaacatgaaagaaatgttatgtagatgttctttagaagatctggc

SEQ ID NO: 12871 - DNA, 1047 bp, Homo sapiens
gattgataaatcagggaatccttaggaagaaaagagttcctctttcaggaattcattgtgaagataatgttacttgttatttgctatatagaaagggtaaacttaacatatagcttgtttagtgtgcatactcattagtgaatttaatgtatgcacactactcattcaacagagtgagtagagagaacaagcattcatttttgggctgggcatggtggctcacgcctgtaatgccagcacttcgggaggccaaggcgggcggatcagaaggtcaggagtttgagaccaggctgaccaacattggtgaaaccccatctctactaaaaatacaaacattagctgggcatggtggtgtgtacctgtaatcccggctacacaggaggctgaggcaggagaatcgcttgaacccaggaggcggaggttgcagtgagccaaggtcgtgccattgcactccagcctgggcaacagagtgagactgtctcaaaaaaaaattcatttttgttttgggatgaatttgtgtttcatgttactagttcctttgtaaatgataaatttgttcaactgctagaagtaatttcctaattgagaaaagttttcctcccattttattagattacagagaatggcaaggtttgcttgaccttttagttttggctttttgatttttattaaattgaagactttactaaggtctgtacaatataaaaaattatccgaatgtcttgatcggctggctttttctccctcaagaaacatttagataattctataaatttatttactacttaaccatgctctaaaatttactcagctttcaatatgttacttgcaagacgtaatttttttcacttgttaattggaactgcatataaaaactatgcccatttctgactagtcaattcaaaaatgtttaaaaccactgttgtggtattcttcaaatgtagcttatatcatcttaagaatgattgctttttcttcacatacggctatcggtggagggatgctaaaaatttaaaattttatggaagttggcttgtctctgtacat

SEQ ID NO: 12872 - DNA, 1087 bp, Homo sapiens
aaattttgtgtttttgtagagacggggtttcaccatgttggccaggcaggtctcgaactcctgacctcaggtcatctgtccgcctgagcttcccaaagttctgggattacaggcatgagccacagcacccagccagacctaatttttagtggttaataactttttatttttgaaaaacatctacaaattcactgtagatgaaaatatgtaggaatgattcctgtggtatacatattgacctacaagagcacaaaatgactaatgtataaggctagcttttccaacattggatatactatgcaaaagattggaaacagccagatgcggtggggcatgcttgtagacctgtgtactctggaggctaaggcaggaggatcactggaggccagcctgggcaacatggtgagaccctgtctcttaaaaagggatgagggagttggaaacaaatgttatttccaatgagttcagctgtaacactgatgttttaaatcttttgcatctcaaactaaatgtttttgtatcgttgggatttttgtttgaactaattgatttcttattaacaaaatagttatgacttggccataatttgacatatgaaatacgatttactacagagatagaaagaagagaattgaaaagccgagaagatttagcagaagtttaagccggactccaagtccacctcccttcagaggcagaaacacagcaatggatgcacaggaagctttagctagaaggtgtgtatatttcttaattcatttgttccagttcgcctttaaataaatgctcaattgtgtggataagatgaattctttcagtaagagaatgattcacatactttagtaatatggtggcatatttgtgatctagaactatgtaaatagtttaattctcatcctaaacatttgcacaactataagattgagatgtctacaatttctgttttttccttcatgatttaactgatttcatttttctcaaatttagactcccaaatattttcagtttgcatttgaaactttttttttttgagtcttaaatctggttcaagaactattattttctcatctaagatgacttttccttt

SEQ ID NO: 12873 - DNA, 1207 bp, Homo sapiens
caagatgaaaagtgattgcttcacagtttagacattgggaggaaaatcaagagctgtcttttagaggatgtagcaggcagtataactgtaaaagggacactgcatctctgtgtaaaataatttgaaattatagaaaatattagtacttagtaataattatatttagctacctaattgaaatgcgtttctggtgcactttttgtgtcattatctccattacttacttaaacttaacattatgtaatctggatttagaagttgatgtatatacatggtctgtattcttttagataaacataagggattcctcttttgtctggcataatggcttttcaatatttcaactttaaaaatcattgtttctgttgtattgaaaatattttggggaggaactacattttgggtgtttatagtaaaaaaaatagtaattacatctgcaacatttgggtgatgtgaaactagatcttttttttatttgccacacactcctaaggttactaatgttgcatcacaacatttttgtctactgatacccatactaactctctttgttgcactattttcctgaaagaaccaacttcttcttaaaacagggaagaagacatgaatccaaagataaatcctctaagaaacataagtctgaggaacataatgacaaagaacattcttctgataaaggaagagagcgactaaattcatctgaaaatggtgaggacaggcacaaacgcaaagaaagaaagtcatcaagaggcagaagtcactcaagatctaggtctcgtgaaaggtaagtcatgttgtattataatgtagtaccttctaacaagttacataaagtttctcattgacccagcaacacccaaaaaaatcataattagggagtttttcttgttcgtttgtttgggtttgtggttttgtttgttttttgcctttgggctttgctttctcatcatgcaaaaatggtttccaagaatggggtgtaagggatgactaaatctcaagtgcctagatttcttttcccttttttttttttgacacggagtcttgctgtgttgcccaggctggagtgcagtggcatgatctcggctcactgcaacctctgcctcctgggttcaagtgattctcctttctcagcctcccaagtagctgggattacaggcatgtgctaccatgcctggctagtttttgtatttttagtagagatgaggtt

SEQ ID NO: 12874 - DNA, 1050 bp, Homo sapiens
ctctctacctttactttttgaaagtatcttctataaaaggtttttttaaaaaaggtataaataggaatgaaccttagatgattgttgttataacatgaaaatagagaaatagtaaactagtaaatttccatttgatcctctgctggagtgtagtggtgtgattacagcccactgcggtcttgccttccctggctcaagcaagcctccttcctcagcctcccagtagttgggaccacaggtgcatgctgccatggctggctcattttttattttttgtagagatggggtcttactttattgctcaggctgttctccaaccaactcctgggcttaaacaatctgcctgcctgggcctcccagagtgctgggtttacagccatgagccaccatacctggcataatttatttttagagatagggtctcaccatgttgcctagactggccttgaactcctaggctcaagtgatcctcttgcttcagcctcccaagtaactggggctacaggcgtgagccactgcacagtagttaagatcgcagctctggagggagttactagcagttgtaactttgacagctcgtttaaccttcctaagattgtgtttcctgtctcttgagtaaaatgaggacaaatttgtctcactgtcacagaggatagaatggagacagtggaactaagagaaggtggcacatgctagctatgctcaacaaatgtcagcaaattttgttgaaatgtggaagatactgacaagagcaaagttttcagatcagcaccagtaacttgtcttacttaaaccgttaaaatcacatctgttttgatttttcccctttttctcttttgagccttttattggaagagcagatgcagtctgtgcgggtatgcagtgctgcagtacgaagtgaatggcaccccctggagttgggcagtgcacaacgctcagtgccttacgtaggaggatgggcttgactgagactctgagccagactccctgtgatgatggtgtctcccccgagcctggcacacagaggtgcttcccaagtatttcttgtat

SEQ ID NO: 12875 - DNA, 1035 bp, Homo sapiens
tcggcctcccaaagtgctaggattacaggcatgagccaccgcgcccggcccaacattcatgttttttttgtgggagtttgctttcgcctctcttgggtagatgcctgggagtggaattgctgggtcccatgagaactctgtgctcaacgttttgaggaactgccagactgtcttccacagcggctgcaccattttgcattcccaccagcaatccatgagggttgcaatttccccacatcctcaccaacacttgttattttctggttttgtttttgtttttaattatcaccatccagggccgggaacagtggctcacatctgtaatcccagcactttgggaggctgaggcaggcagatcgcttgagcccacgagttcaagaccagcctgggcaacgtggtgaaacctcatctctactaaaaaatccaaaaactgctagccgggcatggtggcacacacctgtggtctcagctgttcatgaggctgaagtgggaggattgcttgaactcggaaggtggaggttgtggtgagctggtatcatgccactgcactccagcctgggtgacagagtgagactctgtctcaaaaacaaacaatataaaattgtcaccatcctggtgggtgtggagagttatgacttttaaagctgacttttttctgttacaattaatttagcaaatgtcactgtcctccttctgtcccacacagtgtgctgggtaaaccaggagaaagtaattgcagtcgagggctttgggaacagcacagttggccagagagacagatgaggaaaacaagcagggatgagagagaatgaagaggagcacggcaccccagggctggcttagtcctggcgccaggacttagtttactctgtcattgtttctttcccacattagagtttgtcttcatcactgctgtattccccagtgcctagaacagtggctgacacatagtatgtgctcagtaaacagccattaaagaaatgtttgagctgagcatagaggcccatgtctgtaattccagctactcgggaggct

SEQ ID NO: 12876 - DNA, 1059 bp, Homo sapiens
tgggggtggtgcgggcccgctgtgatgccatcgcgggcccgctgtgatgccatcatgggcaggctgctgtcccctctggccaccccacggcactgcttctgcttccgagctagggccgtgagccaggtttgacctcaccctcctcctgcttcctgaatgggcgggtgcccccgagccctaagggacagacaggctgggttcagacaggcagggctgtgaccctgtgacaggtacaggcaaccccctcacagtcacccaggcccacgtggggtacttctagagcaggggcttggatgcatgacggcctccaggtggtgccgggtaagtcattgtcgcagctccattggagcctttggtgttggtgacctgagaccagggtagcaaaggaagccatctcccacccagcccccggtgaggccactccccacagtcttctccagccacacaggtaggacctcttcccgaagttcctggtcacgagcctccccaccgtcctcactgagatgagaaagtaaatctattctttagagtctgagccatttctggcacgctgctccccaccccttgcttccggccttcccaccagcccctgggatggagcaagaaaccctggagctccccctcagcccccacctctgtgtgcactgcaggccctgccttttagttcagctaagggaggcctcaggaaggctctgtttgggttttccaccccatgcctgaatgtgttgtgtgtagccagcgagtcatctccacaaaccacacacaccgcccatggccaaacatgactcaggcaccctgcatgcttcctgcggctggggcgtgacacatggtcatgggacatgccagtgcatgctcctgtcctggactctcaggcagccttcctggctggcttgagaatcagcatagtgactcctgcaaagtgtgaacagctccacccaggggcctcttccaggactctggtgaacagcagcctgatggccgcacacttgggaccacttttcagctctgcctgtggtgacatgcacatggtgtgggcagatttcacaacccatggcccct

SEQ ID NO: 12877 - DNA, 1107 bp, Homo sapiens
acaaaaattagccaggtgcaatggcaggtgtctgtaatcccagctactcgggaggctgaggcaggacaatcacttgaacccaggtggcagaggttacagcgagctgaaatcgtgccaatacactccagcctgggcgacggagtgcgactccatctcaaaatatatatatacatatataaaatttagccgggtgtgatggcggtcacctgtaatctcagctacttgggaggctgaggcatgagaatcacttgaacccaggaagtggaggttgcagtgagctgagatcatgccactgcactccagcctgggtaacagactgagactccatctcaaaaaaaaaaaaaaatgtatgtggtaagagcactccaggcagaaggactagcccatgcaaaggtcctgaggcaggaaggtgcccagttgttcaagagcagacaccagttagctggagcagagggagtgagatggggcggggagaagacaaaggtctctgctagcggctcaatcatgcaggtccttgtgggctattgtaaagactttggcttttaccatctcactggatgagaagggggatttggactgttttgagccaaggagcaacaagatctgaagttagttccaacaggatcctgccttctactgtgtggacaggctgatgtgagcaaagttgagagcaggctactgagatagtcccagtgaggttaatgacttggaccagggttggggcagtagaggcagtgaaagtggtcaggttctggaaatggtctgagtatttgctggtgcattggagagtttcacgtaattcttgtgcagattcagcaagagagtttgccggcatgctttgcacagcccctggtacccagtaaggcgattattagcattggtgcttgctggaatcagatattccagaatattctgtcacagctcatcgttgccctcttcttttctgtgggtaaactgaggcagaaactcaggctgggtggaactctgcagcctcagctggagacctcgtctggccaaggactgtggggacacaggccctctaggctgccacctcatggtcccagcagagggcaccagaactgcacagaaagtctcactacccaagtg

SEQ ID NO: 12878 - DNA, 2046 bp, Homo sapiens
ttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggtaagtaaggacctcggggacatgtggccaccagaacatcaaattaggtggatatgactgccttagattttaaaagattttacttacgtggttcagacatcaaattgatatgaaaaggaaaagaggccaggcatagtggctcatatctataatcccagcactttgggaggctgaggtaggaagatcacttgagcccaggagttgaaaaccagcctgggcaacatagcgagaacccatttctattttatttatttatttatttattgtatttatttattttttcgaaacatagtattgctctgtcacctaggctagagtgcagtggcacaatctcaggtcactgcaacctctgcctcccagcttcaagtgattctcctgcctcagcctctcaagtagctgggactacaggcatatgccaccacacccaactaatttttgtatttttagtagaaacaggttttcgccatgttggccaggctggtcttgaactcctgacctcaggtgatccactggcctcggcctcccaaagtgctgggattacaggcgtgagccacggtgcctgccccatttctattttatgtaatttaaaacgaaaaaataggccaggcgcggtggctcacgcctgtaatcccagcactttgggaggccaaggtgggaagattgcctgagcccaggagttcaagaccagcctgggcaatatgacaagaccccatctcaatttaaaaaaggaaaaagtaaaagacaagagaagaaaaaggaaactatgagttccactcctgtttttttctttttttagacagggtctcactctgttgcccaggctgtagtgcagtggcatgatcacagcttacggcagcttcaacctcccaggctcaagtaatccccccacctcagtcttccaaatagctgggactacaggggcgtgcaccacacccagctaattaaaaaaagaaaaatttgtaaagataggatctcactatgttgtccaggctgatctcgaactcctgggctcaagtgatcctcccaccttggcctctcaaagcactgggattacaggcgcaagccacaatgcctggctgtgtttcacttctaattctaccctgatcattctgcccagggctaactgcaggaaaaggacccagaaactcccaggtggccaggaaagcattctttcttactcaattcttgtgcatgttcccagcttttccttatgcagctacaagcacatcaaaagaacatgcatcactcccccacctctcacccacattgttttatgttttgctcttttcacttaacaatatgttctggaatttttccaaccagtacctcattgttttatttggcttcataatattccattgtgcggctataccatagattatttagttggtctcccatcatttgactcttgggttattttgagccttttcctcttaacatgaattttttttttttttttttttttgagatggagtcttgctctgtcacccaggctggaatgcagtggtgcgatcttggctcaccgcaacctccatctcctgggttcaagcgattctcctgcctcagccacccaagcagctgggattacaggcgcctgccaccacgtctggctaatttttgtatttttagtagagacagggtttcaccatgttggccaggctagtctcaaactcctgagttcaagcgatctgcctgccttggcctcccaaggtgctgggattacaggcatgagccactgcgcccgacctgcacgtcaataattctgttcatacacatttcatatgaatgtggatggatctgtagaataaattcctggagc

SEQ ID NO: 12879 - DNA, 1038 bp, Homo sapiens
actttcatcactccagaaggagaccctacacccattggcagtcactccccattcttccctctcccagccccctggcaacaactcatctactttctgtttctattgatttacctgttctgaacatttcatatttatattaaatggaatcatataatgtatggccttttgtgtctggtttctttcacataacatagtgttttcaaggttcaaccatgttgtatcatggatcagtacttcattcctttttttgtggtaaaatatacataatataacatttaccattttaaacatttttatttttgaaacagggtctctctctgttgcttgtgcagtgacaccaacacagcttactgcagcctcgaactcctgggctcaagtgatcctcttgcctcagcctcccgagtagctgggactacaggcacgcaccaccatgtctggataatttttgtatttttttgcagagatggggttttgccatgttgcccaggctggtcttgaactcctgagctcaagcgatccacccacctcagcctcccaaagtgttgggattacaggcgtgaaccattgcaccggccgtcttttctttttaagactgactaatggttcattgtaggcatacaccacattttctttcttcattcatccattgatagacgtttagatgtttctgggctagtgaaattttgactttggtttgcctctggatgaggaacaacaaaagacaactgaactaggagggtttagggacccagagacatcagttgtcccatttccaaggtaagtgaccactgacagttgcatctttcttttgttttgctttcttcttcttcttctttttttttttttttgagacagaatctcgctctgtcacccaggctggagtacagtggtgtgatcttggctcactgcagcctccatctcccgggttcaagtgattctcctgcctcagcctcctgagtagctggcactacagacacgcaccaccacgtcccgctaatttttgtatttttagtagagatggggtttcactttgttggc

SEQ ID NO: 12880 - DNA, 1054 bp, Homo sapiens
ccttagtgtcctaaattgttaggagatccaaacatctttccattctgaggtagactcatcatactaggtaatgacttccaagcttgtattacaaatctgacagtctacattttcaatttgcttaaagtctttcaaaaatctttttatggtgcttattttgatatcattaatttgtttcattattgataacaccatttaattttgtttcgtatctttaagtctaatactagtaatgagatgaagctaccgtcactgaaggatatttattataaaaaacaaagggaaaacaagcagttacctgagaggaatctcacttctgcttccaacccaaatcatccaccagaggtaaagttgtccacattctgccgagtgaacgtgaacaatgcttcctgactctaacttttacctcaagcttcattttccctaggagatctaaagcctactcacttcaaaacaagcaaaacaaagccgagttctgagggtaagacttcgttgttgtctggtttccaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagtatgtatttcagtgaatggcttgtaatgttaatagattttctgtgatatctgattgaaaatgatctttattgaacttcagta

SEQ ID NO: 12881 - DNA, 1086 bp, Homo sapiens
agtgttgggattacaggcgtgagccaccacagtatattttaaaggtttagatttaacaaattaatgcctttaatgcacacactcacaaggttttaaaaatacatattcatggtgctctgcagcctacgtagggtctagaaatgggacacaaatttaaagctacatgattaatgtgttctttcagtgttttcagtgtatctattgttgaatctgtaatctcatttgtgacagtgttcacagtttaaatttgaggcccaaggttaattggttctcctctcacaccctataatacgtcccaccttgaaataatttaagcccaaagttttagtgtttagagcctagacctctctgcaacatttttagtgtagtgaggtcctgatttcaatttttcgaaattagggtcctatcttctgttttttgagacagagttttgctctgtcgcccaggctagagtgaaggagtacagtggcatgatcccaactcactgcaacctctgcctcctgggttcaagtgatcgtcccacttcagtctcctgcgttgctgggattacaggcctgcgccaccactcccagctaatttttgtatttttagtagagacagggtttcaccatattagccaggctggtctcgaactcccgacctcaggcgatccgcctgccttggcctcccaaagcgctgggattacaggtgtaagccaccgtgtccagcctagggtcatatcttcttattttactaatgaataaagggacttattttcacttgatcttagccaaaaggctgagaagtgatgggtgggggggacttattttcattgggtcactttgtgacacctagttttgtttggccaactcttttaacaaacatgattgtaactacatagataaggaactccagctcttggtgctttttcttcagccatatgaaattaatttggccgaaagttttctcatccttctatcattcattctgaagtatcttgttttctttttttttttttttgagacggagtttcgctcttgttgcgcaggctaaagtgcaatggcgcaatctcggctcaccacaacctccgccttccaggttcaagcg

SEQ ID NO: 12882 - DNA, 1053 bp, Homo sapiens
ttctcatctcttctcttctcttctcctctcctctcctctcttctcttctcctcttcctctctttctctctttctttcttcacggtctcactctgttgccgaggctggagtatagcagcttcatcatagataactgcagactcaacctcctgggctcaggcgatcctcttgcctcagcctcctgagtagctgggactacagtcatgtgcaaccacacctggctcattttttttttgtttgtttgtttttagtagaggcaaggtctctctatgttgcccaagctggtctctcaaactcctggactcaagcaatcctcctgcctcagcctcccaaagtgctgggattacaaatgtgaaccactatgcctggccatttctctctcttcaccttggtgttagtttctgtgttttcccacgttatcttcctctagcccaccaagagcatcagcgattctgcatttctttaaaaagaatagaaaggcctttctgctttttacctgtcttagtagcatgtaggactagcccgctttggactcccatgtggagtatgttgctaaacgtgtctgattcaccgttctcttaaatattggtcctcaggagcttcattgtagtgtgtaggtttgtcttccaagctgctgatacctatttggccaattttgagctcatgagcagggaatgacagtctgtcacaaccacaacttggcccaaagcaatagcaattataaaatgccattaattacaagaggcatccctactttagagatgttaacatgacaagaacataaaagtggtgaaaagtggtacttttctattcccatgagctttgagtagaataaccccaactattcccccagaccaccaggctgtggccatagctggagtaatgctactcttcacaggcttcaggtcttgaaaaggcttctttaggttattggcatgtaaagaatgaattctacagcaggattatgggaattgtggtacttttttttttttgaggcagagtctcgctctgtttcacaggctggaatgcagtggtgcgatctcagctcactgca

SEQ ID NO: 12883 - DNA, 1033 bp, Homo sapiens
ttctattctgtgtgtttgtgcacatcaggattgacttactggaaactagaggaaaaggatatgcaccactctttgcctgaaactttagagaagacgttcatatcattgtcttccacagatgtgtcaccaaaccaggtaatttaaaaacacacggtggccgggcgcggtggcttacgcctgtaatcccagcgctttgggaggccgaggtgggcggatcatgaggtcaggagatcaagaccatcctggctaacacggtgaaaccccgtctctactaaaaatacaaaaaattagctgggcgtggtggcgggcgcctgtagtcccagctactcgggaggctgaggcaagagaatggtgtgaactcaggaggcagagcttatagtgaggggagattgcgccactgcactccagcctgggtgacagagcaagactccatctcaaaaaaaaaaaaaaaaacaacaaaacaaaacacacacaccgtggactgggcgtggtggcctgtaatcctgtaatctcggcactttgggaagctgaagtgggcagaccatctgaggtaaggagttcgagaccagcctggctaacatggtgaaaccccgtttctactaaaaatacaaaaaaattaaccagacttggtggcgtgtgcctgttcatcccagctatttgggaggctgaggcaggagaatcacttgaacctgggaggtggaggttgcactgaaccgagattgtgccattgcactccagcttgggcaacgagagtgcaactccatctcaaagaaaaaaaaaactgtgtgtgtttgtgttttacaattgttgctaagtactccagtataaattttatttttcaacttctaaaatactggaaaaagcatgggctttagaatcatactcacttgttttcaaattcagtctgtcatttttgccttatgtaatcttagcaatgcttcttaaaagtggaattaaaggctgggtgctgtggctcaagcctgtaatcccagcactttggtaggccaaggtgggcagatcacctgaggttggg

SEQ ID NO: 12884 - DNA, 1013 bp, Homo sapiens
cctcagactcctgagtagctggaattacagatgcgcaccaccgtgtctggctaatttttagtagagtcagagtttcaccgtgttggccaagctggtcttgagctcctgaccttgtgatctgcccacctcggcctcccaaagtgctgggattacaggcgtgagccactgtgcctggccaccagcctcaattttgtttataaactaaagataaagtatcacattatctttagaataatatctcatcatattttgaaacatgatattcttgtaacagtcataaaaatatgatgtttaatatactttcttacccaaatctataactttttatttccagcatatacaggaggagataaaaaatttagtcaaattacagactagtagtgcttccttagcttcctgtgaaggaaattcttcaaacaaacaagtatcttcggaaagtcaaatgggttttttttctctaagcagtgagagaaatgaatctgttatccattatcctgaatccacagaacctgaaatacagcaagaaatgtccacgtcacaaccagactgcaatgtggatagttgctcagtaagcagtggatatggcaccttttgtatctcagaattaaatctgtacaaatctaaagaccctaaggagttcatggagcacatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaataggtaagtagaatttctatcatttgaagggagtttattacatttagaatctagtgttccttttaatgcactataatagaatgagatgtatttgaacatttatcagttcattgcctgtagaaaattgaaataaacaaagcacactatattctaatgac

SEQ ID NO: 12885 - DNA, 1031 bp, Homo sapiens
gatgtctctctttggttggagctgcgcgagggggaacggcgaggtggacgcgcgcgccatgcgaggctgtctccgcctccttccgggcagccaatcactggagagacgccgggcgcgcgcgcgctccctcgggtaacggtcgcgagaggccgcttgcatgaccctgacatcggcagcgggagcggcggccaggtaagcggccaccagcctgcagggagctgtaggccgctggggacaggagacgagacttaggagacactgtcttagcggccccttgagtgtggtgatgggctggggtgtggggtgacggctgccgattggcctgaccccctcggagcccttcggcgtgtgggagctctgcccggccgcggtgcgccttttctagactcggcgcccttgagtgacactcgcgcggcccaatcgcagatcgctcttcctgaggggcggggggtttgtggggtttttttaatttttccccccattttttgccaaggtgccccggtttccttttggaatcgcggttgtagttgcaggagcggtggcttttctccgtcctccctgctttccgtagcttaggcgactgcatagattctccctctccttcccactttgacccgatagccgccaccagccattgcgggctgactgtgagctcagaatgtcgggatctggcctcatccccatctgaaatctcttcctctcccccaagcctcccgtcaaggcggagcgcccagttaactttcatgtttcataaccatcaatcgttccttttccccagctccctttttttgctagggggtagggacaccaaaagcgtcatatcttgttgctgggaaatataaaagctctgctcttatattcattctgtatcaagttaaaaaaatttttttttgcattgtatttgtgggtgtttaaggatttttccctcttacttccctgccctccccccagcacctccaccccaaatggagaagcatctttgaatttctagtggttttccatctggatctgcatccggatccggattacct

SEQ ID NO: 12886 - DNA, 1031 bp, Homo sapiens
agaatgggctttgctggctggtcctgtgcacttgctgacctcaggtctctgcctctgtttcaggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaatttgtattaaaatgtgggttccttgaattcttacgtgctgttttatttttttgagacagggtcttgttttgccacccaggctggagtgcagtaatataatcttggctcaccgcagcctcaacctcctgggctcaagcaatcctcccatctcagcctccctagtggct

SEQ ID NO: 12887 - DNA, 1005 bp, Homo sapiens
ttttgtgctgtatttatatatatgtacataaatgtatatatagagaaatgttgagttcttctggattctgaatgtaaataattcttgtaaattgggactctgcccacctgtttctcccttttccctcttcccttcagctctatttattcttttcttgactttcccatatggggcatcttatgacttttttttttttttttttttaagaaaagtatggaaaacttttcatttagaaaagtatttgttcctgtattttagaattcagttttgcatctttgctgtagaattcctgttttgtgttaatgttttttactatgtcttattgtgttgtgtgcaatgcattgtactggggggatgcacttgagtgccatttctgatactgtcattgtatgactgctgatgctcgtttatgttgttctttggaagctatagtgagcctgatgttttcacattttaaaaaatgcttcctgagacttctttaagctcctctaacttcttcagtgcatttgggatcaaacttagctcttagatcagcaaacctgacttgcttctacttttgcaatttttcaggccttaccatatttcttatctctgtcttcccacctgataggaaaatcttgcagatttgaaacagtggtttctggcctgctgctgcagcaaattccctatgtttatttaagaagtcgggcctatgcttttaacctacaaatgatgagtaatttacttgcaatgaacacaggtagcctgctgctgtttataacctgttgaggatatttatagcaggcaggaggcaggcctagtgtgttattgacaggtgactttagagaatgtacattggccgggtgcggtggctcacgcctgtaatcccagcactttgggaggccgaggcgggcggatcatgaggtcaggagattgagaccatctcctggctaacacggtgaaaccccgtctctactaaaaatacaaaaaaaaaaaaaacttagccaggcgtggtggcgggtgcct

SEQ ID NO: 12888 - DNA, 1694 bp, Homo sapiens
attacactaaacacatgcatatgcttgggtatttgtgggaaatgctgtggaagaatcagactacatctcaatggccatttcatttattaggtagtcgtttaatttttgtgtgaacttcttgtccattacgcttaatattatgcctcatttggaatctgctgtgaagctgtacagtgtggtttcttctggacacaacttgataaattcttgttactaattacaggtttgatcattccggcaaattgtgtgtctcctcttgtaaatctcctatcaacttcagaccagtctcaacagcttgcggtccaacagaaacagctatggcaacagcatcaccctcagagcatcaccaacttgagcaacgcatgaagaacagacaggtttcaacatggatggatctgaaatgctgttgaagcatatcatttgcataaaaatcagggacagtttccaaagaattatatatttttttcagttgtgctctctagttagtttttttgggagtaaggacaaacctggaatagatagcaaaactgaaaatcagcagtgctgatggtggtacatatgtctttcctttagcttctcccctgataattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtttattaaagcatgaaatgaaaggttgcatatcatgcattcaggttattttctaatttttgttctgacagtgcatgtctttggaagcatgctgaaacaagattaacacaggagtcgagtaacagagagaaacatttgttagatgtacagcattggttattgcatttttatagtgtttatacctgggtattgcttcaaaccctgcagacccctccttccccttctccctgccctgggtttctggtcaaggtaatgaatacatacatttttctgtgataaaactcttaaaagttaattttaatgtattaatagtattcctaatgtgtgctgcagaaatggctatgagcctcttaaatttacatttgcaacttaaaggtagttttagaaggaagtacaaattggctttcatcttgcaaacaatcgttttttacttcattatcttaatttgctttgtcactcataaaaaggaaaccatacctgagttgtagacaatgaggaaacacttgaggcttctgctgtgtgttcttttgttattgttgttattgttgttactcagtaacttgaatattgtttaatgtgttgtaagacgtagagtttatctcaagctgttaaaaatggtaatgtacaaatgtgaatagacacttatctatataatatgggtaagttttgtttcgcctataatagatgtttataaaaacaagtgaggggacagttggtctttttatcttttctttctttttctttcttttctttttttctttttttttttttttttttttttttttgcttccacaggttgcactattgaaaaatcgagattgtataaacctggtaaaaagc

SEQ ID NO: 12889 - DNA, 1082 bp, Homo sapiens
ttcaacatttttgctttctgctgccatagcagctttgatgtttacagaacactttatcatgtgatctctcactttgcccttcaaaaccctgtgacatcgggaaaggcagtactgacggagtagacaagtgcagaggactggggccatccaaggccttatcttggaggggcttgaattctattgttaacttgaaaggagagtaacatttctttttccattttactgagaaatgtttaaaaacatacagcagagcttaaagaattttctctgaagacccctaatgcctactgcctggattccactgttaacattttattacacttggtttttcttacctctctgaggctgcttgactgggattccaggtacaggaaataaaagaagcaaaatgatctgtgttggacatttgtgcattaaagctaattccacgtagttttctgaagataactttggtctttaaccttcatctttagccagaattaaggtccaataactgcctcttgggtgtgactgtgttagtcttttaaacaagcattttcggtcctttttgaagttaccgtgtacttacttagtgttatagtctcaaatgattatgtttgctgacgtgatggtacagaaacatgtcttaaagtgtgtattataaaatctttatattttgtcattttctttaaacagataaggaacaacaagaaaactgccatcttagttaaagaagtgaatcctaaaaagaaacttttcttagtttatcgaccaaatactgggaagcagctcaaattagaaatttatgctgatctaaaaaagaaatataagaaggtattttttcatttgtacattatattatataggaatacttactttgggccaggcaatgtggctcacacctgtaatctcagcactttgggaggccgaggtgggcagatcacctgaggtcaggagttcgagaccagcctgaccaacatggagaaaccccgtctctactaaaaatgcaaaatattatcccaggatggtgatgcatacctgtaattccagccacttgggaggccgaggtaggagaatcacttgaacccgggaggcggaggttg

SEQ ID NO: 12890 - DNA, 1030 bp, Homo sapiens
gtagtcccaggtacttgggaggctgaggtgggaggatcacatgagccagggaagtcgaggctgcagtgagctatgattgtgccactgcactccagcctgggcaacagtgaggccctgtctccaaaaataaaaaggttttataaattgattttctattgattttctaagtattccatgtctataaacctgtaattattaggcctcttctcaaatctgatacacagtcaaattgtgactatgccagaggttctgcttttactctgttgtcctgaatatgttttgaaacttgtgcacttgaaggcagtcttgacttagtacttttgtatccaatttcttcttcagaataaatgtttataaccttattttttatgggagtccaaaaggttagtgctggtttgtgaattctgtttgttttttgacttaacctaaatacttttcctctgcacttttcatttgaattaattcatgaactaaatgtgatgtactggatcttaagaaacattgaatttgggctgactctcttgtttgtggcggagggtaggtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatggtaagttcagtatattaaatatacacgaaagcatataatatttcagtatatttgaaaatgggatatgaaaccttttcttctgtacagtacaaatgatcacacagattataatctttgcttggtggaaagctccaggcttatctaccttctggaagtttgagcctcatatatgtgagaagataacctcaattttgtgcagttatttttaacttgaaaacatggatttgtaccccatggtgtatggatgaaccaatgtaggtggtgataagttatcagttaacaatataaaaa

SEQ ID NO: 12891 - DNA, 1026 bp, Homo sapiens
ttgaacagtaaaaattgtccatatggtgtataacatgttttggtatatacaagtatacattgtggaatggctaagtcaaattgtgattcctatgagtgagttctaagctggtcaccgataatgttatttataaccgttgctctctttcttacatgaacatcaaaaagtttctcagtaaaatttttttgtacttaaatgctcattgttaggaaaacatttcagaaagctctcatgaactgaataatagtttgcagtgaatatgcatttcattgattaatggcatctctacacttttgaatattattagatagggcttggtgtatagctcatggactgatggatcctgtggcctgcaggggctctgtggtctgtagttttggaagtcactggattaaaacaatgtacttctgtttcaaatgtaaataaatcatttccagtatttattttaaagagatgacattttgatagtctccagagttctattaatctgggtcaagattatctgtagccagtgggccaagaccctattttagtcttaacgaagtattttatggattgaaaatgttaaaagcattgatttagagctctaggtacttgttcgtattatgcagtaggataatttgtaaaagtatggtcaaatgtgtctatattagaaaaattagttaacttggtcttttttttgaatcaaaagtcatcaggcaaacaactttatttgaaatctatattgggacatttctcctgttaactctgtcattcatttccttcatgttatttatatcttgctgtctaatactttattccccctccaattttaatctcaatctggcgtttattttgaaataaaataatgaaacatcgtagtttaccaacatcaactttatctactcattggaaagaaaacttcgtggattttgggagtttgaactatctagtttctaatcttctaccacttcctgcgtgagtgaacttcggtagatgatttaagttttctgaccctcagtttcagctcttaaattatattaccta

SEQ ID NO: 12892 - DNA, 1089 bp, Homo sapiens
cagactattattgttttacaaaactgaggcacagaacagttaagtaatttacctaaggacttcacggcaagttaagaggtgaagtcaggatcttaattcagagatgctagtcctaaatactccatcctaaaatacagacatttgaccttacttgtactaacatttgatgagtgactgcagtgactgatgctaggctctggggctatggagataacgtagacaaggtccctgccctcaagaagctcacatctagtgggagaggtcagacacacagtcctagaaccagaatacaagtatacaaaccaggccaggcgcggtggctcacacctgtaatcccaacactttgggaggtcgaggcaggcagatcgcttgaggccaggagtttgggaccagcctgggcaaactggtgaaaccctgtctctactaaaaatacaaaattagctggacctgctggcacacgcttgtaatccagctactcggaggctgaggcacaagaatcacttgaacccgggtggcagaggttgcagtgagccaagatcgtgccactgcactccagctggggcaacagagcaagactgtctcaaaaacaaacaaacaaacaccaagtatacaaaccaaggctgggcgcagtggctcacgcctgtaatcccaacactttgggaggccaaggcaggtggatcaggaagtcaagagattgagaccatcctggccaacataccccgtgtctactaaaaatacaaaaattagctgggcacggtggcacgtgcctgtagtcccagctactcgggaggctaaggcaagagaattgcttgaacccgggaggcagaggttgcattgagctgagatcacgctgctgcattctagcctggcaacagagcgagacgacttcgtctcaaaaaaaaaaaaaaaaaagtatacaaaccaagaagtaagccaggaaagaacaggaacagagtcactgaaattcacatggaagtatgaagtttccctgtagcttccctggtaactttcttcttcttcttcttcttcttaattattattattatttgcctcataccttctctgacccctggtaatttatttcaccta

SEQ ID NO: 12893 - DNA, 1029 bp, Homo sapiens
gggctggcgcagggaatgacagtttctgaggcggttctgagcgtccttccatccttcattcctcctgcacctacctggtctgctgggtctcttccgtccttcctccagggagtattagccatgcggtctgctcagggcggctcttcagctctgcttcccactgttaactggtttttcccacccctcctcctgcagcaattcacagtcgccaaggagtgttcaggggcttcggcagcttagagtacttgaactaaagtatcttccatcctgtcagggacccagagctgggataattatccccatttctcagatgagggaactgaggcccagagaagcccactgacatttagatcaaactgctgggaaggctgtcttcagatttgaacccattccttttctgctcccacccccgccaccattttcccgctcccctccccgagtctctggtggtggccccttgtctgcacagtgcatcatgagtcacaggcgtcagacttcacatttctagactgaaccggacaagggaactgttttgctgccagtcaaaacagtgtgcccggaagatgttccaagaatagtttgtgattgagcagctgctgtccagagaggccaggctggcactgcccaggaaggtcacgagggagtgctggagtgacttcagcctcgtccccagtgaacaccaggcaccagtgcccccttttgcgtggtccctgtctctcagtcatggtcccatggacgcacacacagttgccttttgcagggcgggggctaggggctgatcaggagataagaagacaggtgggtatagaggggggaccggggaagcaggggatgagaactggcctcgaggactggaaaggttggctttggagtgggtggccacccaggtgtccaggggtagcaatgacagtgcattctatccctgtcctcccacccaccacccccctcgctccagcccaggaatagcttcttcacagccgcccattacactgcctgaaatgccactggtagaacttcatttggtttgag

SEQ ID NO: 12894 - DNA, 1085 bp, Homo sapiens
ctgcaacgtggatgaaccttggaaacaccgtgctaagtgaaaggagccaggcacaaaaggccacttaatgtatgattctgtttctgggaaatgtccatggtaggcagtccatagacagaaactacattggcatttgccaagggctcaggatagggaagtagagagtgactgcttaataagtacaggttttcagccgggtgcggtggctcacacctgtaatcccagcactttgggaggcaaaggcgggtggatcacttgaggtcaggagttcaagaccagtctggccaacatggtgaaaccctgtctctactaaaaatacaaaaattagccaggcataatggcaggcgcctgtaatcccaggtactcaggaggctgaggcaggaggatggcttgaacccgggtggtggagtttgcagtgagctgagatcgtgccactgcactccagcctgggtgacagagagattccgtctcaaaaaaaaaaaaattgccgggtgtggcggtacacacctgtaatcccagctactcgggaggctgaggcacaagaatcgcttgaagccaaggagtggaggttgcagtgagctgagatcatgccattgcactccagcctgggtgacagtgaaactccatctcagaaaaaaataaaataataagtatgggttttccttttggtatgaagaaaatgttctagaactggacagaggtggtggttgtgtgacatgtgagtttactaaatgtcacttccaaattgttcacttttaaaaggttcaaatggtaaattttagatgatgtatattttaccacatttttctaaaaaggctccctcgctatgcaagaaggtgagaggatgggtgtgggtgtgacctggggcaggtgacttagcatgatgctgggatctgttggtcacccgcatcacagagaaatggccgagtgtgcacccccgccgggcttccactgaactccagatactcaaagccactggggaggagaggacctaaccagaaggcccataacaacagggaaaatggatatgacttactgtcaaatgaaaaaggaatggagaattgtgtgtaggctgagattccagc

SEQ ID NO: 12895 - DNA, 1042 bp, Homo sapiens
agtcagaccccatctcaaaaaacaaaaaaagaaaatcttaggtatggtggcatatgcctgtagtcccagttacttgggaagatgaggcaggaggatcacttgagcccaggagtttgaggatgcagtgagccatgattgagccattgctctccagcctgggcaacagagtgagaccctatagcagcactattcacagtcgccaaaaggtggaaacaacccacatgtccatcagcagatgaatgggtgaacagtggtctctccatacagggggatatgattcagctctaaagaggaatgcagccctggccacgcggcagcacggatgagctgcaaaaacatcacgcggagtgaaagaagccaggcccaaaaggccagtgtgtgactccatttgcacgaaatgtcccagaacaggcaaatccatagagccagaaagtagactggtgtccgaatggggctgggggagggaggaatggggagtgactgccgatgggcatggagttccctttggggacgatggaaatgatccggaattagagagcggtgatggtcgcacaacactgtgcatgttactgtccgcgtggccagagctgtccatcacagctgcagctaacatccaggtaggcccagggctacaaagtgggcactagcggtgtctgttccttaaatgtgcccccagactgtgccaggaacacagagggtgagatcgttcatcctggcagaggtggggaggtggggtttcagggaagagctgttcctgaagccgggcgtcagtgttaacaatgctgagactttgacagatagaaatgtggacaatggagatgctgtttcagaaaagtatagtgaactttagggacacactcaggcttgtgttttctcccagcagatgtttatgagctgttgaaagtttgcagacgctgcactagtaacctgagttacaggtaggggaggtaggacagacaagctcacagtcaggtgggttcaagtcccagtagtcattaggtatcctgtgaatttggtagttacttccaggtttgctgtagga

SEQ ID NO: 12896 - DNA, 1032 bp, Homo sapiens
ttgcagtaagccaagatcgtgccactgcactccagcctgggcaataaagtgagactccgtctcaaaaaaataaaaaaaaaaacaaaaaaacttgatgggtgaacattctgatgggggtacacatatgcaaaaatatgtgagggcacccccagaaggtggctctgtctgggagaaagtggggactagagtctgccccgtggtgacacattctggtgaccttaagagagccttttgcatctcgtgccctggtgacaaggcagcttggtatcatggagaagacacgggatctggagtcagaaaacctgggcttgagtttttggctgtaagactttgagaaaaaaaaatatctctgggcctcagtttttcatatatgtaaaatgagactgatgttagaaacaacagtaatgataataagacccatttccagtggttgggaatgagaatgaaataaggtccagggtgtaaagcagtttatccttcctgggcttggcaggagtacgttgccctttgggagtgcagaagaagaaccagttcccgttcactggccagcctcaggcatctgtcatgtgtggggccctggaatacagagacgaatgagacaggctgatgcctctaggacgatcatataaaatcccaagctcaagctcaggacccaggccttacctggctttgtggcactggcatcgtcgcctgctgttctggaaacacaccagggatgcttgttcatggtggtgaccaccaagacaagagagaggaggtcagcggcaaggactctgatgcaatggcgcacccgggggggaaagtcatgccaaagaaatagctgaggggttgcctctgtgctttctcctcatgggattagatctggctgcatgtcctgagtcccgggggctaaggagggacgtttcccccttgttcacctcggattgagcctggccattgcaggccagcccaggcttcacggagcaggtgtgcactggcagccccagcacctacggaaggctgaataatggccccaaaatatcaggtcctagt

SEQ ID NO: 12897 - DNA, 1033 bp, Homo sapiens
cccaggaaggtgatgaggctgctgggcttccacatagacccagccgcccctctctcctcatgctcgcctcccgcccacctctcggggagccaaggcagccccagcaaggagtaaatgagtgagtgggtcctggcgccccaggacagggcatgtcgggacaagtgttcaaatggcaggcggggggtcgggaggagtttgtggctttggcactgacttctgtctacatgggacctcagcccccaaacacacacgacacacacatacaacacccacacagacacacacatacacccactcacacacgccacacacacagacctcacaccacacacacacggacctcacacaccacacacacacagacgccaccacacagacatacacgcactcacactgcacacagcacacacgcagacctcacacacaaacctcacacaccacacagacctcatacacacagatctcacaccacacacaaacctcacataccacacacagacctcacacacaccacacacacacggacctcacacaccacacacacacagatgtcaccacacacatacacgcactcacactgcacacaccacacacacacagacctcacacaccacacacacacaaacctcacacagcacacacagacctcacacatacacagatctcacaccacacacacacacaaacctcacacaccacacacagacctcacacataccacacacacacacaaacttcacacaccacacacagacctcacacacaccacacacatacaaacctcacacaccacacacagacctcacacacacacagctctcacaccacacacagacctcacacacgacacacagacacagacctcacacatacagatctcacacaccacacacagacctcacacacatacagacctcacacacacaccacacacagaccacacacacacagacctcacacacacacagatctcacaccacacacacacagacctcacacacagccctcacacacacatacagacctcacacac

SEQ ID NO: 12898 - DNA, 1056 bp, Homo sapiens
agactgagagagggagagtgatttgttcaaggtcacacagcaagttagtggcagagtcagaagtgaacccagatcagctgaaatcagctccctgaaggaaggcttctgtctctctgggaccctttgacccagggctgctggagaccctgtggttaaggctggtggggagactgaaatcacgcgcaccatggattgatccgccgtggtgttccactgcccaagagcttacgattccagacagaggcctgccatgcattcctttgctcaccctttgtctcccttatctctgatggagtgcccactctgtccctgttctgggctttgccaggttggaggcagggcagggaggcacattctggggcttgcgtctccctgccgcggtgacttggacattagaaagttttctagcagcaaagtaagcctgggcctggaggaccccggaaccctatcccaatttccttcagcccaagaaggaggacttttttgtttgtttgtttgtttgtttgtttgttttgagacggagtctcactccgtcgaccaggctgtaatgcagtggcgcaatcttggctcactgcaacctccacctcccaggttcaagtgatcctcctgcctcagcctcccaagtagctacgactacaggtgtgtgccaccacgtccatctaatatttgtatttttaatagagacgggatttcaccatgttggccaggctggccttgaagttctgacctaaggtgatctgcccaccttggcctcccaaagtgttgggattacaggcgtgagccaccactcccagccttgccttttcatgtccgaattgtctgaatcatattccgttctatggccatactgcatgtcgtttgcccactcatctatggatggacctgtgagacgtcaccaccttttggctgttgtgaatcgtgctgctgtgaacatcgtgctcaagcttttgtgtggacctatgttttcagttctttgaggtgtgtacctaggagtggaattgctgggccatagggaaactatgttaaacttctgacacttctgcagggcgcctggag

SEQ ID NO: 12899 - DNA, 1726 bp, Homo sapiens
ggcatgtcctggtttagtctgtccacctccattcctcttccctttcccctcttcttccctaccccttcttccttgtctctctcgctttcagcaattatggctccagtaaaggacatacactttcttccccctactcctcctctcagtagacccactcactcacttccactcatcactcagatgcaggccacagttgtgtcatgttctgtctcattactcagtctgcaactctgatgacaggccatagcgagcacagtgcccttcttggtaccatggctctgcagagaaaagcaaagtctcatgtcaggcagcaggcgggtaacagggaagaaagggaaaacacaaataaattctagaaagcaatggctgggctgatacactcgcgtgtaacataccagactatgctattcattcactcattcagcgaatatatttactgagaacctactgtgtgccatgcattgttctgggcactgggaagacagtaatgaccatgacagatgaggccttggccctgatgagcctgactttttagtgtagtgctataccatagaaatattatgcagctttgccatgttaataaaaaacagtgaagttggctgggcgcggtggctcacacctgtaatcccagcacttttggggggccaaggcgggtggatcacttgaggtcaggaattcaagaccagcttggccaatatggcaaaaccccatttctactaaaaatacaaaaattagccgggcatggtggcgagtgcctataatcccagctattcaggaagctgaggcaggagaatcgcttgaacccgggaggcagagattgcagcgagtcgaaatcacaccattgcactccagcctgggtgacagagtgagactctgtctcaaaaacaacaacaacaacaaaccagtgaggttaattttaatatatcttatgggacccagtagatccaaaatattttcatttcaacatgtaatcagtataaaaacttatcatttgatattctgcactctttttttcctactacatctttgaaatctggtgtgtctttaacccctgctgcacatttccactcagaccagccacatgtcaaatgctcaacagccacgtgtggctactgactttccatgggatggtgcaattattctagcatgaggaagagatagagattttttttctccttttttttttttttgagtcagggacgtactctgtcatccaggccagagagcaatgatggcatcacggctccctgcagccctgaacacctggattcaagtgatcctcctgcctcagcctcctgagtagctaagactacaggcacactgtaatttttttttcctttagagacaaggtgtcactatgttgcccaggctagtcttgagcttttgggctcaagcagtcctcctgtcttgtcctcccaaagtgctgggactacaggtttgatccactgtgcttagccaggatagattaaaaaaaaaaaaaaaattcaggctgggcacagtgtttcacacctgtaatcccagcactttgggaggccgaggcagctggatcacttgaggtcaggaggtcaagaccatcctggccaacatggcaaaacctcatccctactaaaaatacaaaaattagctgggtgtggtggcgcacgcctcaggaggcagaggcaggagaatcgcttgaacctgggaggtgaaggttgcgttgagccgagatcatatcactgcactccag

SEQ ID NO: 12900 - DNA, 1050 bp, Homo sapiens
ctctggtagcttttccagaaagacccatgacttcaccacatttctcgagttacgatgaaggtagagtctggggccctgagtgagcatcagatgctggaagctggggctgggaggggccaagcattggggacagactccagacacctgcaccaccccctggccccatgagatacgttctcagaccttcccaagaaggatctgtggctcctctcagtgctgtgaagtgcagggggcttccctctggaattcagcccatctctccctcctactttggctggctccagatgccatttagaggaaatgtttggcccatttcccaggtgccagcttttcccatgaggaagctgtcagtgcttcctggtcagggaaatcttttgggcgtgatttggtcagtcacagtctgttggggtgaggtggtgcgtggagaggacaggatttggaaccaagggtccctggattagaatccctgctccatacctcactggctgtgtgaccccaggctcgcgaatctgcctctcttgatctgtttcctcatgagtaaagggaaatgactttgtactctggagtgggcctcactcattcatgtgccaggcatcgtgctaggtgctagggcacaccccaaggcgttcgggaagcagaggctgccgtccctggcctggggcctccctgcagtgatgggaatgtagccctggtgcccccacaccctgcccttcaggagccgtggtttccttctgctctctcctgggaggcgcacacccctctgcacccagagccaaggagggcaggcagccctgggaccctcttcaggcaccgcagccagggtctgtgttacccacaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacaggtacatcggggagcaggcccgggcaggcggggggcggctatggggcacggcagagcccagcgtca

SEQ ID NO: 12901 - DNA, 1077 bp, Homo sapiens
ctccacacctccctgcaagctgagggagcgggctccggccttggccagcccagaaaggggctcccacagtgcagcggtgggctgaagggctcctcaagtgccgccaaagtgggagcccaggcagaggaggtgctgagagcaagcgagggctgtgaggactgccagcaggctgtcacttctcagaagcacctaaataggaagcccatggaaacaaaagcttttcaaccctgaagcccttacattcctctggcaccacagctgcactcaacagactggcaccaggcccattcgtgggcctccagggtgccaggcactgtgctagggcttagggtgcagcagtgaacaatctggagtctgtgcgaggaggcgggaaacagacccacacttacagaccctcacagagacacaaagactagaactggggacagggtggtaatgcacccgagtctgggggccagggcttccgggaggaagtaaacttgtactgagacctaaaggataagtagacagtggagacccaggagaggtgggtgggagagaggcctaagaagagtgttctgggcagaggaggagccatgagagggcaccagggtgggagaagcacagcccagcagggcacccggaggaaagctcgtgccacctggagccctgggggtaggagaagggccagcgagggtggcggggccagttgcagggccgggcagaccagtctgattctcagagcagtgggaaccattggaggtttttaagtagtctcaatttaaaaacaagatcactctgctgccacgtggagagcagaatggagcaggtaggagaggacagagggaggctttctggcagggatttgggtgagggtgaggacggcctcagcagcggagacggggagagttgaacggatctgagagctgctttcaaagcaggatgccagcaagatcatcatggactggaaatggatggcgggggatgccagcgtcaaggccacccccaggttgtgcagctggggacagtgcttgtgaggggtaggacactaggcctagggcagctctcctgtcatccaagacccactaaattctggat

SEQ ID NO: 12902 - DNA, 1047 bp, Homo sapiens
tctttgcgcctgtgtccagggagcagggatggggctgcgggagggctcgggcctacgcccccacctgccggctgcctggatgctgtcggactgggggaagtggaggcaggcggtgcaaggagaagctgaggcggggcagggacctgcgctgtcgaggaggagctgggtctggctcttgcatcttgccctgtccccagcccctgtaccccagaaaaaggggagccctctgcctctggacccctgccttggccctagttcatggctcctctctgttggactgggatggccgaggctatagcccaggcggggccccggggacccagggtcactcccagccacacccccacttctcactccgccccacacactccttccccagagacccatgctgcccccatctcacgctggcctcgcccggcctccaccacctgaacccatctctgtcccttcttgcctaatctctctctgtgtctccctctctgtctgtctctgtcccgggctctgcatctctctccacctctcccttggcctccctgtctctccccaacacccctctctgccttactgtctttgggagcccaaaccctacccctagcttgggttccccttgacccccccggggtcccagccagctgggagggcagccctgcccctcgggctccgaaaccctgggcccggtgcctgactctgcaccccccgcctgccctaggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggtacgccccacccagtacccaggcccccgaagccctgcacagtgaggaccctcaaggccccatcatgcagataggaaaacagaggtgcctaaaggccaaggaattggctggatcatgaggctcaaaggcatggggctgggatttgggcccagcagccctggggccagcagacaccccctgaccagctc

SEQ ID NO: 12903 - DNA, 1055 bp, Homo sapiens
gactgagttagccagatggatggatggatggatggatggatggatggatgggcaggtggttgggttaggtaggtaggtgggtgggtgagaggatagatgactggcttagctgggtgggtgggtgggtgggtggtaggtagatcgggttaggtaggtagatgggtgggtaagaggatagatggctgggttaactgggtggatggatggatgggtgggtgggtggttgggttaagtaggtaggtaggtgggaggaaggatagatggccagattagccatgtggatggatggatgggtgggtggctgagttaggtaggtaggtgggtgggtgagagtatagacgctggcttagctgggtgggtggatgggtgggtggtagggttagggaggtaggtgggtgggtgagagtatagatggctgggttagctgggtgggtgggtggatgggtgggtggtagggttaggtggatgatggaatggatggttggatgagtaattgtggggatgagtggatggaggccccagtggatggacgatgagttgggcggtgggatgagtagatggggaggttgtttggtttgagaatagaatctgtggagagggagagactgaatggggactgtgaggaaagactttcccggtcccccacatttagcaaggccagcaaggaaaagaggtgtccctcttgcctggacaaagtcccaagtttctctgagatgggagaggcccctgagtgccctctggtgacacacactccagagactgtgggcagagctgcttcaccaggggggtggggtcacacctcaacacccttccctgcccggaacctttttttttttttttttttgatggagttgtactctgtcgcccaggctggagtgcagtggtacgatctctgcttactgcaacctccacctcctgggttcaagtgattctcctgcctcagcctcccaagtagctgcagttacaggcacgtgcaaccacacccggctaatttttatatttttagtagaaatgcggtttcaccacgttggccaggctggtctcaaacttctgac

SEQ ID NO: 12904 - DNA, 1025 bp, Homo sapiens
aaggctctgagtagaccccacgcagtggtggggacacagactccaggaccagaatgcctgggttcaagtccccgcctgccccttattagccaggtgaccccgggtaaagtcactgtgcctccctgtgcctcggtttccccatctgaaacaggcataatcaatagggttgtcttagggttgtttcgaggattaaatgagcaaatccatagagagcacccagaacagcgtccactcatgggaagcacttgacaagggatcttcattcttcaggttcctcatagggttttgttccatgcaaactcttacctatttgagacagtgtgtgtgtggacacgcgtgtgcatcggtgggcacatgggcttttaagcacgtctttgcctgcatttgagttgagaggggtcctgggctgcagcctcctgggcgctcacccctctgcacctgcagggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtgagtcgcaggaggagaggaggcccaggaccaggggaggagtgtgcttggcccactgaggtagcttcacagggaggcagggctggattgacatcagaaagcacaatctgataggtggtgacctccttatccctgcaggtatgcaagccagcagcagggaagcgttggccttagctgcctcccacctctgcccagttctttacagtttagaaaacaaactcatggccaacctttttagaagcataggagggaaactgaggcccggaacagaagcccgagctcacgccgccaggcctccagcaccgtactgacaaaccacgcactctctcattggccatgaaagaggccatggccagagtgcccctcgccccactgtgtcccaggctcttgctgcggagcccccatcctctccctctctaggctctgggtt

SEQ ID NO: 12905 - DNA, 1022 bp, Homo sapiens
ctgggtgggggaggagggagggctgaggtggctggagctgaggcttctgtgacagtggtggtcttccgtggctgctctgagagatcagggacggcaggtgagaggccctgattaagcctcctggtgcccagggtgttagcccatcttaaggacgaggagcccaggggagaggagaacccctcccatggggtgtcccagcacatagccggtaggctcggggtctgccggcccagccagcgcacgctgcgtgacctgtctcttgtgctcaggatggggaggtgaggcaggtgctgggttggagcctgaggttgccctgcctgaatctccccggagacccagccagccccagcggcactgcaggcccctccccgggggcagtggaaagcgtcttgttgcatctgggctggaaatacaccagcgcggggctgggagtgataccctggcccagtggtttctccagtaataataatagtatcctcatagtgaatgaagccatgctgttctccgcatttgacagatggggagactgaggcatagcggggttatccaaggcgcatttggtgaccggggttcaaacccaggcagcccggtactggggacctccaggcagaaaggaaaggaggccatctggtggtgtgtttctattttttatttttggtggttttttggtcactcttgttaagcacctactgtgtgtcagatgctgcacaaagcacttcacctggattctagggcagcggtggcagagtgttccctgggatttgttagaagtgctgattcttgggccccagtccacacgtactgaatcagaaacctcggggcatagtgcagccacctgcactgtcacaagcccttggagtgcttctcatgcaggctcctgccccagacccccttgataactgtgagaccgagaagttaactgcccattttgtagatgaacaaactgagacccagaagtttcatccctggtcctggggccctcagcgttggcctcccaacgtcctgtactctgactgtggaag

SEQ ID NO: 12906 - DNA, 1050 bp, Homo sapiens
gcctagtatgccccagacactctgctagtgagagctgtgatggtgctggtggtggcacactcacgattgattgattcattcattcattcatccattcattcaaagaggcatcccagaaggatggtgcagagcagggctttggagctggtggctttgtaccccagctctgccgcttagtgactgggtccaaggatactgggcttcacctctccgtgcttcagtttccacctctgtaaaatggggataagaatgggacccagtcgtagggctgttgaagaacaagtgtgtttctttttgtaaagggtggtgcctggtccttggtcagccctcaataagcattcagtattatcctcactgtccattcagcagccccatattcagcgcctgctgtatcccagggaagcaatggcagctgccctgagggcagagacatggatggggttttcctgctgggctgtggagctaacacttcgttagtggaccgtggagggagtgggggctgcattgaaggattctgagctgagacacagcccccatccagggctggactcaaagtgggtcgtcctagtgtcgatgaaagtgattctgatccgaatgacacagtcaaagctgataaagaaggtggcccttctgtcccctgacgctgaagactctggaggcgtggacaggaggggaccccgagatccaggttgggacctggatgagaatgagtgatttgggagtgtggggttggttctcgctcctggccgaccttgaaggagcaccctcatatcgcgggctgcagagaaagcggagcagatgcagggacccactacaggaagtggggctcaggccaggccatccgtcttgacagtagccgttcttggtgtagtggtgagctccccatcgctgcagtaagcaagcaggtctcaccaggagaggtgccgctgaacctggtgacctccacctcctgcccctcccctgtgcctttcagtcccagggaggagggcatatcccagtgaatcctaacgcagtatcagccacctctggctgctggcccagccctgtctg

SEQ ID NO: 12907 - DNA, 1122 bp, Homo sapiens
cgaggtgtcggggagtgggcacgaccgcccctcccagggtcaacagcgcccacgtgcctcctgtgggtttcctgagttggggggtgcatggcccaggaccaaggacatgggtgcccctcctttcgccatttgtcaaggtgggattgaaatggaggctgtggtgggatcccgagggaggggaagcctgtgggctgggggtgagaagtgactccagggacactggaccgtgcactttccccggcagcgaggcttccgacttcctcagacaccactgaccacgctgggatggctgtagccagcatcctggggctgtgccctcctggagttccccctgtctgaggccaaggtctgctttgtgaggggacgtgtcccagtctgagtcctcagatgtgagtgcatgtcggaatcaccggaagggctggggaaacccagtcactgggccgcacccctcaccccacaataaggccgagatccaagactctgcatttccaaggagctcccaggcgttggtctaggacgctgctgagaacctcggtgctgggggtcagcccctgagcagggagcagggtggctgaaggggttgttaagcccgaggtgggctaccccacagcccagaccacccatgggagtacactcaagctggaacggcccttcccaggtgtttggggtgggcaacggcctccctggccagggcccaacttggatgaggcagctctgagctgagttattgtcagcgcgcctgacagccgatggcagccagccccttctagaagggaggtctggccagtccagcccaggaggcagcctgtgcatctgcatgtttgcaaagccacgcttcatagatgctgtggccacccgaatgcttaaccacagcccagcagcaagacgccagtgccaccgtgtcatctcaaggacacctgccctgtctgaagtgcttgcaccaggcccttctccgccctgtcaccccgacaccatgtgccctgtaccaaagcagtttgtgtgtcatttcgatggttacgtttctgaaacttggatggttataaagtggaatatgaaagtccttgattaaaagtgctggccatgggacgtctctggactcagacccgcgctgtgtgcggccgc

SEQ ID NO: 12908 - DNA, 1039 bp, Homo sapiens
tgcagctccttaaggagggtggggaggtgaactgagaccactccccacccactaccccgctgcctcagcatggctggcacctgcaggctgggacaggcatctgggactcttggtgactgtgggctggggagccactgccctgtgctccaggcaatgcaggcacccagggtacctctgtgggccggttcttctttctgacctatcctggcagctcaggccttgtgatcagatgggaatccctggccatggagcacacgagcccctgcccagccccactcccctcacagctgccccaggacacttgtccatgcttctctctccctcataggtttctgagtgagcagacacagccccttccccctaccgtgacatgggccccctccccaggcaccacgggaagatggagaacccgggtcttcccagccagtgagcccacccaccctcaggggtagggtgcccactgccaggagatgctgtctgcctcttccccgatgtcgtctagtgggagggagctcaagctcccttctccgtgatgtttacctggagggcagcaggtcgggttctccctcccttcctgggccctctagttttggaagaagacttaggttatctcagccaatatgcattggaccccttgatggctggtgggggatgggacctgggagtccagtgagacatgggagccttgtcaaaattccaggggcacctggccctgctgtgtgatggggatgggtgctgctggccgctatggtggcgatggcgatgatggtgatgatgacggcgacagtgatggtgccggccaacagtcatgcagcactatcgccacacactgtgatgatttcaacctcactagtgttggggacaggtgtgtaattatccccactggccagatgagacagaggcacagggaggtgaggaagcttccaaggagcctgctgagtggcagactgagggttctagcctggcacatgcagcccggggagttggagggaggcccagccgtcccctcggcagcacactggccataaagccagccttc

SEQ ID NO: 12909 - DNA, 1023 bp, Homo sapiens
ggtctcgaactcctgacctagatgatccacctgccttggcctcccaaagtgctgggattacaggcatgagccactgtgctcagccgctacggtgtttttgaaattgaagtgcattcaggaattttctagactgagaggcaaaaaggtaagtgccagtcagggagtatatagatgctgaggtatgagaggcagcagggagcggtggggattatgacaaaggaagggtggctaacggcctcaagaggtatttggaaaacatcatcaggcgtctgttgggcccctactgtatgctcattctcttgctggccttcccagttcccctcccatgacctgtttgggggcattgaggctgggcttgtggtgggagcccttcctggtagctgggctgggggctctgaagagcagaggcccatcccctccccctgtgtgagagccacatttgcacagagggaggtggggagaccatggtaatttaagaagggtggggggtgtcggtgcccggcatatcctgttgtagaggcctggcctgtactgtggtagagtgagtgtccagtagagtgagtgtccggcttgctcttcgtggagtgagtgtccggcctgctctccgtggagtgagtgtccggcctgctgtccgtggagtgagtgtccggcctgctgtccgtggagtgagtgtccggcctgctctgcgtggagtgagtgtccggcctgctctccgtggagtgagtgtctggtctgctctccgtggagtgactgtccggcctgctctccgtggagtgactgtccggcctgctctccgtggagtgagtgtccggcttgctctcaggagtgagtgtccggcttgctctgggcggagcgaatgtccagcttgctgactcatccattgattgagcatttattgtgtgcaggacatggggagcttcatgctggttgttcagagccattgtaaacaggtggcttcaagacagtgccgcgggtctccctgtgcggcgggtctatctgtgccacggggtctccctgggccac

SEQ ID NO: 12910 - DNA, 1036 bp, Homo sapiens
ggaagagaaggctgaagccagggaaaagagaacccggacctatgtttggggaaggctttgagtttgcccggctgtgggctggagtccttgtttcccataagggctgggggtgacatggcgacgtcagcgctgtcattaaccatagcaacagcggtgactgtgataacaggaaagacttccatcatgtttgctctgggccaggcctcgtcccaagtactttacctatgtattaactgatctgatctttgtgataatcctgtgaagtatgtacaattagcattcccattttacagatgagaaaactgagacacagaggttaggtcatctgtccgaggtcacccagccggtacgtggaagaggcaggatatgagcccaggatgtgagctcctggctcctgccctgaatgcctgtgctgtaccctgctcagcgtcctctttctctgtcccacagacagtggctgagtgcgtcctctattactacctgactaagaagaatgagaactataagagcctggtgagacggagctatcggcgccgcggcaagagccaggtaagaggcaaggtgggggtgactgtccttgcaggctccctgcatgctcagcggccacttgcttggtggccagcaccccgcatggctggcggtaactgtctccatgagttgttgttgcttggccaccggcagtgtgagtgcaggctcccctccgtggtagcagcagatgtggggagaccccctctggggtgctcaccctgccaggctatctcgagcctcccgtagtggccaggaagatagctggggagaaacagccacgggcctcctcagcctgtgaaatcccagactcctgactgggtgacctgtgatctctgtgcgtaaaaaggctacattccaaaagtaagagcttcccaggatgacttggggtagttcacaaacttcatgtttaaaatgttaatggttgtgtgtgtttatcttaatacatacttgaaagaaaaaatagccagtacttcagctcgccgttttttcagacgccgttgcttgggat

SEQ ID NO: 12911 - DNA, 1193 bp, Homo sapiens
gtatgtatgtgtgcctgtgcatatatctgtgtgtgtgtgtctctctgtgtatcttgtgtgtgcctgtatgtatgtgtgcctgtgtatatctgtctgactgtatgtatgtgtgcctgtgtatatatctgtgtgtgtgtgtctctctgtgtatctgcctatatgactgtctgtctgcctgtgtgactgtgtgtctgtctgtctgtctgcctgtgtatctgtctgtgtgtctgccatgtgactgtctgtgtgactgtgtgtctactgtgtgtgtaccgtgtgggtgactgcatgtgtgtatgtgactgtgtgtgtctgtgactgtatgtgtgtgtctgtgtgtctgcctgtgtgacttgtgtgtgcctgtatgtacgtgtgcctgtgtatatctgtctgactgtatgtgtgtgtgcctgtgtgtgcatgtctgtgtgactttgtgtatctgtgtgtgtctgtgactgcatgtgtgtctgcctgtgtgacttgtgtgtgcctgtgtatatctgtctgactgtatgtgtgtgcctgtatgtgcatgtctgtgactgtgtctgagtatatgtgtgtttgtgtgactgcatttgtgtgtgcctgtgtgacttgtatgtgcctgtgtgcttgtgtgcctgtgtgtatctgactgtatgtgtgtgcctgtatgtatgtgtctgtgtggctgtatctgactgtatatgtgtgtgcctgtgtgactttgtgtgtgtgcgcacgcacctgtgtgtctgcctgcatgtgagtgggcaggggggaggcggcgggtgccaggtgcaggagcatcttccgcagtgccccctgcgctctcccaggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagaggtgagcggggcctgagcccagggcccccgacgtcagggcccggggtcagctccagcatcctcagtagagatggcctggccaggaaggaacagaacagcacagcagcttctcaggccagtggccagggccctaccagaccctggcctgtgtcacgtggagcctctttggcctaatacttacttggaacttaaat

SEQ ID NO: 12912 - DNA, 1022 bp, Homo sapiens
ttcaacaggaaaggaatggctgtagctggaaatgtctgttgggtgtagatggcaggaatagtctttcaactcaagtcttgccttcatttcatttcattacatttcatttcattttatttgtttatttatttattatttatttttgagatggagtttcgctctgtcacccaggttggagtgcagtggcagggtctctactcactgcagcctccgcctctcgggttcaagcaattctcctgcctcagcctcccaagtagctgggattacaggcgcccgccaccaagcccggctaatttttgtatttttagtagagaaggtttcactccattgaccaggctggtcttgaactcccgacctcaggtgatgcacccgcctcggcctcccaaagcgctgggatcacaggtgtgagcactgcacccagccccttcattcctgtgcagttttttcaactccttatgttagaacattgacaaactgaacctgaattcccatagcaggtgggagccggagagagctgtgctttctcggatggtatcacagatgctctgattaggccaggagagggcctgcgtcctgtgaaccagtggctgatgccggggagatggagtgaggctgcctggttttggctcatgggactttctctacagttggggatgatgtcattgactccacccaagccacggggctgctgggacatggtagggaatgggataaggctggggaggccctgaaaaggtccccacctggggaagaggcgggctggatggggactgctgccttgggattcttggataagagacgcggcaagggctgggaactaggtttgctggaggctggaggggctcccctcatacctgcagccccctgccccacctcctctctccctcagctgtgttgaggcagggcctgcgaggcagctccctgtatcctttctgggcctccagagaggccctcccaggcgcaggcctggctcagtcatgcccagcgcctgtaggtctgtggtacacagtaggtgatgacca

SEQ ID NO: 12913 - DNA, 1053 bp, Homo sapiens
tggccacctcccctgcggcgtcagccccacccaccacgatcagagcagagacctcggcccccaaaggccaggaacgtgggaggacgtgcgtgggggcagtcgggtttcagcgggattgagaaaggcctgtttcccttctcccccaggttggggctgagtcccctgaattccagcctcccagccggaaggtggcagcccagcctgaagccctcctttgggccggagcagtccctgagttttgccacccttgggtggagttagttcagctctaacaagtgtgtcctggcgtcccctgcaagctgggccttgggcccgcatggggaagatgcagacaggagctcctgttggagcacttgctgtttgccaggaccaggggcagccagggagacagtgtcgggaggtggcccccaaaggggccgaggagatgtggagatatcagccacgggaatattggggttggggaatgttctagatgggagaggttcaggtgggaagggtttgggattttgcctagaactgtgtggattggtgacctcctatccaagtgtcctctccgagcctcagtttccccatctgtaaaatggggcagcccctgcaccccagaaacaggttactgggaggcttggcaatcctgattgtggcttggagagcagggagacagggcctgccctctcatccacctctatggagggggcagagaggactccgtgtccttggaaaggccaggcacatccgggatgtggactgcttcccccatggccctggagaaagtgcccactgccctcaaccctgtgctgggccctgctggacgatagcagcttggtggccagcgctggcctcttctggtcctggtggagaggcagggaggccctgggccagctgcagcgacgtggagagaggacagggttctgggctgggaccggacagcctgcaggtacaagaatgctttgccccagagaccgcctgagcgagggagccagccgcactccatttccaggtatttagaccattcctgagcatccactgtgagccagacactgtccaggcactgtg

SEQ ID NO: 12914 - DNA, 1042 bp, Homo sapiens
gcagggtcagacagagttggttgtgcccttggatgccagggtcacgccaaccccagaggtctgcatgctgtcatgttctgtgcccacttcgttgcagttggcaacgttgcagacctttggtggagtagtactgccctgggctaaggctcccagaccctggagactgcctgggccaggctggggcaggtgggcgcgtggggatcactggaagaggctagacttgggaggctttgcagtgtcctgagtgccctggggggggtctctccattagcttcatggcccccttgcagctcagttcctggtgcttggtgatggctcttaagaggctgttgagggatggtttggccctcaaaagagaggctggtgggagctcccatgctggggaagattcattcattcattgggagctcccatgctgggagatccatccatccatccatccatccatccatccatccatccatccatccatccatctggcaaatacttatcaggcgtctcgggcccgtcctcttccaggcccttgcagtgcagctgtgaacagaacaggtaagcatccttgtctcagggagctgacctccttgtggggaatggcgagttgggaaggagatgaggggaagggctgaggttgggggagcccagatttaagtagagagtcggggaggagcctcactgagaagctgcctttggagctgaacctggaggaagggagagggccaggcatgtgggaatctggctgaggaatgttccaggcagcaggaacagtatgtgcaaaggtcctgaggtgggagctctcttgactgtagccgccatcattccgggagagacccgtgaatgcagccagggtctaggaatgtgctgaattcttcctttgctttcccatgaatccagggtccaggaacgggctgaattcttcctttcctttcagtgtgcaatcccaggcattcccttgacaccttctggagtaaggagccctatgcaggggccagagaggggcactcctctcccgcaaaggaacttctcccagtccatgctcaaacat

SEQ ID NO: 12915 - DNA, 1036 bp, Homo sapiens
tccatccatccatccatccatccatccatccatccatccattcacccgtccatccatccatccatccatccattcgcccatccatccatccatccatccgtccgtccgtccatccatccatccgtccatccgtccgtcttccatctatccatccatccattcgtccatccatccatccattcatctgtccatcctctgtccatccatccatccatccatcaatccatcatccatccatccatccatcagtccatgcatccttcctcctttctctatccatgcatgcattcatccatccatcctcctttcctccctcccttcctcctttctcctccatcctcccatctctatccctcttccatcttctccctccatccagccaccccctgctgagcacctgggtggggagtctgccagttgggccagacctgtcactgggtgtgggccgtggtcagcagggccttttgccttttgtctgacttggtcactgctgtagctgtgcttgtacagtgtttgcacataacagatgctgaaataattctctaattgatgagaatgggtcagcaaccggagtttgggatgggtttggcttgcctggtctcagctggagggcagaccgcacccttgtgggtggcacccgggattgagctcttagtatttgaccctcagcccctccggcagagccaacgacaggctggggttgggtacctggctcttccttagggagtggaatgacctttctgccaagtgagggccaaggagtctggcctcattcctgcaggcctgccgctgtgcatgggtggaggcccgtttctctagggccctgacaatcgtggctgtcatcattcagggttacaggggcccttttacctgtgccccacactcagacacctgtgcccagtgctcctcgacacaggggcagctacagtgtcctttgaacacagagacgccagaggcagacttgccacaggagaccgcacgtcagccttgtttaaagtgcaccagctgtgtccttcctagctcccttgcagtgaac

SEQ ID NO: 12916 - DNA, 1050 bp, Homo sapiens
actggttgtgatcactggagtctgcacatgtgataagaacacatagaactaaatacgcgcacactcacacatgcacacacatacatgcacactcacgcacacacccacatgtatactcacacgcacacttgtgaacatacacaccatacacacagtcacacgaacatgcacacgcatactcgcacactcacactcacatgcacactcacactcatatgcacactcacagtcgtgcacacacacccatactcacatgcagacacccacacagatacatgcgcacatgcacacacacactcacacaagtgagtgcattggaaactgctgcaatctgcatacggctggctatatccatgctgccttcctagttatgatatggatgatgaattgtcgttgtctcaggtttgtctcaggatgttattcttgggggaggctgggtgaagggcacacaggatcctgggatcttgatttttttttttttttccttttttgaaaccgagtctcactccgtcacccaggctggagtgcagtgcagtggcacgatctcagctcactgcaaccactgcctcctgagttcaagcgattctcctgtcacagcctcccaagttgctgggactacaggcgcatgccatcaagcccagctaatgtttgtatttttagtagaggactcccccatgaagctggcctgtaactgagcttggtcccttggacatcccagggggtccaggcagagtttgctttgtgcctcaggatcacagagggctccagagcatcccaggctgggggacacgtggtgcctgcagggcctgtgggggcctcatgactgagctgctgtaagggtgttcctgtcatcagagtggcgtggtggaggcttgtgtcccgtgggcatgggtcgtagcttagggtctggagagatgggggtgggatagggtttgggggcatccagcctcatgagcctcttctttgctgttctttggggcccctgatcatgggcctgcctcaggacctttgcactggctataacctttttttttttttttttttttgaga

SEQ ID NO: 12917 - DNA, 1032 bp, Homo sapiens
gcgtccagggacgagtcattcaaggggagacctgggggtgattagttaggggcagttagttagggctcctgagttgtggcagagacacactcgagccgagttaggctatgacggggagttgatgggtcctcagagtggccagggtaggacacgttcaggcacggctggatctaggtgctcaaacaatgcctctgggagctggctttgcctcagctgtgcctccttccatgcgggccttgttctcagacaggctcatgccaccagcccagcccagccagccaaggagaaggagagtcacctggcatcccaggagggacactcctttctcttgtttgagtgaggtcctcgacatttgtttcactgtttgcaacagcaagaggaggtggccaaagaagggataaggggatgtcccaaactcagacacagggaggaaaggagtgagtgagtcagtgcaggtcaaaggggaggagtggggattgtggctaactggcatgctgggtattctgatggttttccaagagaagctggaaatctggattttataaggaatggcctagtttttaaaaaacattgaatgggccagaacaagttttcttcatggccacaactggctgtcaccattttatagcctcttcttagcagtgacttttaaagtattttgtccccactgtgatctgggtagaatgtcccatgggctgttccagaaggtctcaagtcttgggaagtcacgtctgacaccattggagatgccatttctgaaagtcaaggcccacggccacagcagtttctcagagaacaataccatgtctccagtggggcctgacattcttggagacagtatagtctagtggttagtgtcgtagatgcgggtttcacacttgctgagttcaaaaccgacattgccacttcccagccccgtccccttgggcaagtcacttcactgctctctgcctcagtttcccagtatgtattaatggaatgggtatgacagcaccccataggattgttgtaaggcaagcttgtccaacctgc

SEQ ID NO: 12918 - DNA, 1028 bp, Homo sapiens
tagaagggggctgtgggagcccctggccccaaaagtgggttgcccgtgactcgaaactctgtgagtggattcttcagctgggagtggggtggggaggtgggtgtctgggattgtctatacattggggtgaggggtccggtgtgggtgggggctggggtctcggggtaccctgggcgggtgatcggggacaccgaaggtgtgtagggggaggttttagggccctggcccggtgggatctcacctctcgggggctctgggaggaccggctttaaccccagttggacggggccctgggccctgcttgggtggggaggagagcaattcagggccccctgcccttccctgtctgcgccaccacccttccctctctgccatcctcctctctctccttcccagcctggatgctcagccctgggcgggggctccctgcaatcccttcctcccctcccccttccttcctgctccctacccctccttctcctccctccttctccccacaggccaccctcaaatgacagcaattaatggtgcctgtgatggcgggctgagaggaggaggctgacagttgagcgtgtctgcctgcggccgcccgctaatcgggcccgggggatgcccctcctgccgttggctccaggcgcctgccctgccatcactcagaggggagcaggagccctggacaggcctgtgggagctggtgcagagcccccatccctgcagccccctccctgtccttctattattattatcattttctttcataaacgggtgggctctggctggactgttgttcagcatgagttggtggatgcctcccagacgtccttctcctgaaatgacctctcatgtgcctgtgttgtcctcagggccagccatccccacagggccccatccttttgtccctgcttccctgggagaggcgggttgggtggagcccaggaaccgtgtcctgtccggacagcaggcatcagttaaatgccccggcctgagtcctcggggcctgggggcagctatttgagcccagagccttg

SEQ ID NO: 12919 - DNA, 1053 bp, Homo sapiens
cctgggcaacatggtgagaccctgtctctacaaaaaaatacaaaaattagccgggcatggtggcacgtgcccatagtcccagctacttagcaggcttaggtgggaggatcgccttagggttggggctgcagggagccatgattgcaccccagcctgagtgacagagcgagactatatccaaaacaaaaacaaaaacaaaaacactccaaaataccaaacaaacaaaaataaattcttgcatgagaatagtagacacccccacccccggaccccatccttcaggtgtccgtcgacccatctccctgtttgtggggtcctctgggtagttaatggggcagtttcccagtagcctagccgtgtggcccggggcccctcggtggtcttgccagggtgtgggatgcctttaaacccacacatctgggattgaatcacagctccgtcacttcccggctctgagaacctgggcatgagatttgattgtctgagcgtcagtctccctctctgtcaaataggtagcagtacctgcctcacagggttctcatggagaaatacttggcccagtgcttacgacacatgggccctgacggcagacatggtcttttttcctgcatgtcggtgtcgtcatgccaaactgcatacatgcgatgtcaactaacaaaacccgtgttttgtccgcaggtctccctgagtctttgaggacacagcctcgctggaggcagtttctggtaggttcatgtctgtctccacttggtgtccccaggaggttcatcctgcctggactttctcacgggaagtgggtctggaattactcggagccaggttcggcctggagtgtgtggtgggggcctcggggggcgtgtggggtctggcacatcagagctgtccagggcagggagcaacttagggcagtttgcggggtcccccagtgatgggccgtttcctggctgagttggtgcagtgattttttgatgacacctgagaggtgggagggtccctgacagtgtcagtgtcaggagggtgggcttccccgggctccggggttcttggtcacat

SEQ ID NO: 12920 - DNA, 1154 bp, Homo sapiens
aagtgtgggcagttcttacctcctggggctgagctcatgtggaaaaacctttgtgcaggttcatgggggctgacccagccggacccggaggaatcctaggttagcacccttgctggtatctgtctgcacaagcagatacctgcaaaagacacctatctgctttctctaagtgggatcatacttattttgttatgatatgacttaatacatcatggacttctttgatgaacatttttggggataatgttgctttttatacttcttggggagaatgtagaaaaacaaaaagtaatgcattcaaaactctgccagttgctttgggctttataaaagcttattttttaaatgaaagaaaatgcattgacttgtaaaaaagaaaattaacacattgcgtaaaagtctccctcggttcctggcctcccagtttctgttccccgaggcagtcacagcttcccgcgcctgagtttcctccgagatgctcttggcatatgtcggccttaaatggactgtatgtgtgcgttccctttaaaaacaaacatgcaagtggtatcacgccatatattcaggtttgattttcgccgtcatagtcacatcctacgtgataatatgtttcggagccgattgtggaacgtagaaagcaagagttggcaaactatggcccttgggccaaatccggccagcccaccacctgtttctgtatggtgcacaagctgagaatggtttctccattttttaatggttgaaaaaaatcgaaagaagaataatattttatgacatgtgaaatcatatgaaatgcaaatttcggtgtccataaataaagttttgttggaatgcagccacgctcactcatttacatgttgtctgtggctgcttttgggtacagcgtttgcaaagttgagtagttgtgacagaggctggaaggcctacagaacctaaaatatttactctctggccctttgcagaagatatttgccgatccctaatatactacctcactgttttgaacctcagtgtagccttgcacggtttccctgttgaggaaactgtggcccagagaggggtgtgagtttgaaggtcattccaggtaggccctaaaacccctccttctagcctgggctcctgttcttgctgagttacgctgatgctcatggtta

SEQ ID NO: 12921 - DNA, 1014 bp, Homo sapiens
tctgcttgtccggagaggatggagaagggcaggtgcccccgcccattgaacagatgcaaagactgagtcaggcccagcagagcaatgaagggggggtggagccagcggtgactggcgagtcggcagcgcggctgccagggcatcccgggctctgtctggcttccctgagccgcctgccgtgtccctgcttggaaattcactgctgccaccgccagcgggtgccgggggagtctgtggtgccggtgcccagacatgggggcgggagcgcagcaggccccagccctggcctcttcccactgagctatttacgctgctggggatcaatactattgataaatccatgtaaatggtaatgtggctgtcaggccctggtgagggatggagacccctcctggggctgcgctctccccctccccctctcggagagggtttggttatgtgggaaggatttatttggcataatctgttctttttccccaattaataatactcatgccacctcctaaagatttcccagagctctgcaaacacgaatttactgcatggaagccctgggctggggacggcttgattgttctcggggcctgggggtggggggcagggggcgctggcagcgcagacacccaccgagggagttggaagctagccccaggagtcctggcccccagcgtctgccattcatgctggatgtggaggctgcctggccccgtttccccctggctgagagggggcgcattcatagttctgtgttcccaacccccatctgagagtgtgggtggagaagttggtgcttcactcggagatgggaggcgggggtggtacctacgcagaacccagccggagggttctcctggggtcctgtctgtgggaagggagattttaaggcagaggagacaggctctcagcccctcctcctgccgctgtctgaactgaaaagccccacaaatgctgcctctgaccgtgggccgggggtgggggtgggggtggggtggcgggggttgagagcttttattt

SEQ ID NO: 12922 - DNA, 1600 bp, Homo sapiens
ccgacactgcggcccgcgtgctcgggggcgccggggaacttaggggaactccagctccctagcgagggggcgggaaggagggaagtggcgttggggtgggcggggggcgcgctggaaatgcacagagcggccccccacagtgtgcgccggctctggggacttggccgccaggcgtcccttgtacccggtgtagccccggacctggcggggcgacactgcgccttattttccatcgggcagcgcgggtttgaaagcccttggagatggtacccctagctccctggcctggctgttgtggaggggcgcatgagggtctctcaccagccgagggggagagccagccttgtccctcctaggcgtggggccacggggcgctgggcggggtccctcgggagagtcgcccctggtccccctcccccgcgggccggtgttcctggtgtctgggcctgcctcccgtggctggtgacgcctcattgggccgcctcctagtccctcccccgggctgtgcggatacttgggatgccactactttgcgaagttggaattcagagctgatcccacttgggcacgactgggaagacccagacccttgtctagagggcagcttcctcagaggcctgcggggagtgagggcacccgtggggtacgccctccccgccccagacacttgcaggaggagcaagccgagggcgggagggcacggcgggcgggagggagagacaggctgtacctgggagctgctgtcgcccgggcccaattagcgtggggcgcccggcgttatttttacattgtaggtttatttttttggaagcgagtgtcctcccgccgcctgtcgcgcgctccggctctccgagggtctggtgcaggcagcgggggcggatctgttctgtcggctcagcctcctcccttcctccccctcctcctctcccccgttggtgagaactggttttattgtgattattattatttttccctttttgcagatttggaggaaggatgtgtgagggagggaagaggggaggaggggataaggggaggaccctgtgggcggggtgggggagttctgggcgcgttgggatgtgttaccggtggccttgactttgccccttttcagccagatctgggtccttgcggcagctttgatataaggggctctccgggccagactgcgccgggagggcgacccggggcaggctgtgtacctcgtgggtggcctctttgggggtgctgaggaggggccgagaaatggcaagcagcagtgaggtgggatggcccactctgcacctcagctcctggggtttgactctgacctttgccactttcctggcagtgtgaccctggacagatgcttaacttctctgtgcctgtcaggtttcccatctgcaaaatgagggtcaaaatggtactgagttcacagagtggttgtgagagctgaccgtccggccataagaatcccttggtacttgtatgtgttactatgactactgtgtcggtattattattcctgggttctaagattgggcctttaatccaacgtggtctggaagccctgtgaaaaggggccaccttacctttggctgggggtggacagtggggggat

SEQ ID NO: 12923 - DNA, 1069 bp, Homo sapiens
gtcagtgtagagcagggagcttttcacttttagcatagatagagtggccagggccccatggctgcacctccctggacataaccaggatgtcctgtcatctgccccccaaacaaaactggggtctcccctttattttgccaacagaatccaatttttaggtgatgagacaagtgtttgacttgaaaagaccctcctgccctgcctcctggaaggtctggagcccagcccagcgccccggatcccctaggcatgtgaaacggggaatgcagtgtcctccagtggctggctgcagcttggggtgggcacctgggtggtggctggtggtccccctgcaggccactgctgccccctcttgggtcctgttctgagtctcaggcctgagtccctggggaaggccccacacctttgccctgtacctgggtatggggatggccctgaggggctgccttgcttgggagaaggggggaaaacagatatttttatataaataagaaaaagacagcccctctgggcagatgaggcctgctgtagggcagggggcttggtaaactgtgtgtccactggtctgtaacccttcagctgggtccttttgtgcagtgaacagcctggacaactgtccaggtggcccttcagggatatgttcctggacctttcttagcttctcaccgatctttcttccacgccaagtccatgttcctcagtcaaacaagtggcaaagaggaggaggaggaggggaaggaggaggaacctgcttcaccctctggcacctgcgggttttgttccacgtgtcttccttgggaaagacaaggggttcttttacagcctaggggtggtttcccctttctacttctgagtgagaccttctcaagtcacggctctttgggcccacatggctaaggtctagccacctgtgggtgtcctgtgctgcctcagtgggtggtgtgggggcggggctgacctcccccgcgcctggctcagtgcagcagaccctggcccctgtgcccgctctctgccctgagcaggagtttgattttcctaccccgtggtgaagcaagcacaggtgggcgga

SEQ ID NO: 12924 - DNA, 1799 bp, Homo sapiens
aaacagccccccagctaagtccactggttgtcggtctccatggcccatctccccaccttgcttcctcgctggcttaaattttcaagtggacgagcccttttcagcttggcttgtccacctcccaggtgtgtttcctgaagatgcttgtacttatgtctaagagcggcagctccccacatctcagccacctgcaatcgttgagggttgttggactctaaacttatgtgcctttcctgtttcctctttgccttttgcaaattgaagaaccgtgtaaaaccatttttatgtggcttcaacgtcaactataaattagcttggttatcttctaggagaaatgctatttattttggagtagtagtaaaaagggctcaaaggataaggaggccattcaggcctattctgaatccctgatgacatcagctcccaagggctctgtgctgcaggaagcaaaactgtaggtgggtaccaggtaatgccgtgcgcctccccgccccctcccatatcaagtagaatgctggcggcttaaaacatttggggtcctgctcattccttcagcctcaacttcacctggagtgtctacagactgaagatgcatatttgtgtattttgcttttggagaaactgcccttcctatgttctgagtgaatagcagtttttttgatcccagagggcaacttgtattctgtgggctggtgcctatttgcaaggtcacattagaaagacaggagcaaggcttaggcctgctgcttctggaatctcttgtgcaatagactcccctggggaagtctgctagaaatgcagatccctgggcagccttctagccttctggaataggatcatggtgggaccctggaatctgtattttaatggaccctaatgagattctgatgtagaaacatgtttgagaggcattgatctaaatctgggatgactggccaggtgcggtggctcacacctgtaatccagcactttgggaggccgaagcaggtggatcatttgaggtcaggagttcaagaccagcctggccaacatggtgaaaacctgtctctactaaaaatacaaaaaaaattagctgggtgtggtggcacacgcttgtaatcccagctactcaggaggctgaggcaggagaatcgcttgaacccgggagatggaggttgcagtgagccaagatcgtgccactgcactccagcctgggtgacagagtgagactccgtctcaaaaaaataaaactaaaataaataaataaataaatacatctgggatgactgaccaagaacaaagaatgtaggcatcaactgaacaccaactgtatacctgggactggatctgagggtaggattgccagattgagcacaaacaaacaaacgaaacacaagaaacaacagaagggtgcctgttaaatatgaatttctggtaagcaataagtaatttttattgtgttcctgtgcaatgataggacgcacgtatcctgaaaacctgtctgtagttcacctgaaattcacatttaactaggcgttctgattttatgtggccgccctatctgctgggaacataggctgatgcccctgggggttctgcgtttccttggccaggttcctgtagggctgaggtcatgggggagccgtggccagggatggtgtccttgccaggggaggtgacgggcagagctgcaggccctacaacttggggttgggcagggatgagtcgctctaccgtggtgcctctgataatagctgttattttagtttctgaaaaatgtgctgccctcaagagcttctgaggctaggcctacttgggtg

SEQ ID NO: 12925 - DNA, 1049 bp, Homo sapiens
ttcatagtccaagttccactcatctttctgttccattttcccaacacatggcttccatcctcaaggtcacctctggtcccagtgtctgcagagctccagcccttgcatctgcgtttcaggcatctgaaagggaggagggaaaaaaggttcacctcccagctgtgaaagcttctttttaagcagccctcccggccatcccacgtaacgcttctgcgaacatctcattaaccagaacttggtcacagagcctcacttgccacaagagaggctgaagtggagtctttaactgggtgcattgccatcctgagtaaaatttgggtcctgtttctaaaagggaccaatggattttggctgggtcactggtggtctctgccctgtaggagatgtgagtttttagtttaaaaagattattttcaagttgtcaagctctttgccaggggagattccttctggcagcacatcgaaacactggttccctcagcccatgccaatcaagtaccatggaccccttatccctgggggtatattccaagacccccagtggatgcctgaagctggggatagtactgaaccctgtatagcatatactatgcttcttcctatacacacacatctatgataaagttaatttataaattaggcatagccacaattaacaataactaagaatagggtaattataacaaatactataataaaagttatgtgaacatggtctctccctcaaaatatcttattgtactgtactgagggtaagaaatggcagaaatcaaaaccatggataaggagggatgactgagattgcagaatcaaatccctcctggcctcagagcttatgatcacaggttcaaagctgtgtgatgtcaaacagccctgtgggaaaacatctcaccttgtcaactaaagaaaaaaaaaaacaaaacgccttttaaagatttaaagttagtcttatttacaagtattattgagggctgtagactgagaccttcagcctggggacagttttgtcatatggctcctaaagtgtttcagctcattgtttatatttg

SEQ ID NO: 12926 - DNA, 1064 bp, Homo sapiens
aagccgtgatcacaccactgcattccagcctggcaacagagtgagaccctgtctcaaaaaaaaaaaaaaagttaaggatcttgagatgggagatgaacttggattgtcccaggggccacaatgctttcacaaggatctttgacagagggaggcaggagggtcagagtaggagatgtgacctcagaagcaggggttggagtgataaggggacaggagccaaggaatgcggaggcctcttagaagctgggaaacggaaggcaatggattccccctgagctccagaaggaagcaccctgcctgcaccgtgactttcatcccatctcaggggcagtcccagtttggacttctccccccgagaactgtaagataataactttgtattgatctgagccagtgttaattgttaattcttacagcagcagtgggaagctaatacaatgaaaatgcttccattaaagccaggtcattaacatgatagtataatctggtttgggtgggcttaaataaaatatttaaacttaaaataatgttgtgttaatatgtgaacttttgaaattgtcagtgtttttacaaaaagaccttaatgttctggaaaaagtataaatatggggtgcacattttttccttttgcttgaagctgtaatatgattcggtgaggcactgatttggccctccctgtattgccgcgacagagcctgcttgttttaaaataactttctgttttagaacagtttttttttttttgagaccaagtctcactctgtcgcccaggctggagtgcagtggcacaatctcggctcactagaacctctgccttccaggttcaagtgattctccttcctcagcctcccaagtagctgggaccacaggtgcctgacaccacacctggctaatttttgtacttttagtagagtcgggatttcactatgttggccaggctagtctccaactcctgacctcaagtgatccacctgccttggcctcccaaagtgctaggattccacaggtgtgagccaccgcgcccggcctagaacagttcaactttcagaaaaattgggaagata

SEQ ID NO: 12927 - DNA, 1047 bp, Homo sapiens
tcacgggccctgtaacttgctgaggagataccaagtcttgccttctgcacgtgcctccatacactttccccttttccacattgttctggggctcatgtcagacattgcctcatccgtcagtgtctctagtatagccacggcacttcatggtgcattggagtctggacgctggagggctcactaaaacacggatcaccaggccccagcccctgagtgtctgagtcggcagacctggcatggagcctgggaatctgcttttttatcgagttcccaagtgatgctgatgttgctggtttggagaccgccttttttttgggggggtggacagggtcttgctctgttgtgcagcctggagtgtagtggtgcaatcacagctcactgcagcctcgaccttctgggcccaagcaatcctcctgcctcagcctcccaagtagctgggactacaagtacatgccaccatgcctggctattgtaaaaaaattttgttctagagatgagatcttgctatgttgcccagactgttgaactcctgggctcaagtgatcctcctatctttgccttccaaagtgctgggattacaggcgtgagccaccacgctcagccagggaccacacttcaagaaccactgcccgaacaggtacctagtaaacaccaccacaatgataaagcaaaagaaaatccccaagcatgaccacagtactatgctcacaccaaaagtcgttctgtagggcagtaatgaggtttgaaaggtggacctgctccagtgttcagaaattgcccgagacctcatgcctggagtgggaggctctgcccggaccctcagccccttgttggttgggccccttttgggggcctcaggggctgtggctcagggaccagcacaagggactggcaccggtgacgtctgtttctggtcccggcccagcctggaagtttctgggaacctgaggaccctggagtggttctgacctctggctgcctccctgtccccccgtgtgtcccgtgggagctcactggcttgggaggcctgcttttgacaagacccct

SEQ ID NO: 12928 - DNA, 1028 bp, Homo sapiens
tcgatcagttacttgattaattaatgagttaattagctgattgagtaaagtatttattgagtacctgctatgtgccaggcatttttccaggtgctggagatacatcgataagcaaaacagggtcagcttctgtctctcgggagctggaggagatgaacaaggaaacagataagaccatttcacacaaagcaaggtggcctgacagagtgggctgggactcctgttttcaacagatgcaacagcaaaggcttctctgaggagtgggtttcagctgagcccagaagaggagagtggggagccatggaaggatctaggggaagcgtatcctagacagaggaacaggaagtgcaaagttcctgacacaagaaaaagctggggatgctcaatgaactgaaacaatgggggagagggcaggagatggaggcagagagatgggcaggcgccagttcatgtgggtccggaaaataacgacgacactccccagctcagttgcactgacacattccagggactgttctaagcactggcacattttttgacttgtttaatcctcatggtagcccttggaaaggggctcttctaatccccgtttcgtagatgaggagactgaggcacagaaaggcccaaaccacttgccccaggactccaatgtgggaaaccccagagcctggatttctctgaacctgtcccccggggctaccacagtctcacctcagccactctgacctccctcaggagttgggccctgccccttggggcactggaccatattcggcctccttagaggaaggcagtgccaggcaaagctgtctaacgagaacatagcaggtgctctgtaaatattggttcaggcgaagacatgttgcttaaggatggccctgcgagaaggctgctttcttctggagttaaataagaggtttagaaagcctccctcggagcactcaaggactgagcctgccttacccacgtgctggggacaccaccctcctgtccctgtgtaacccaggagtctcttctcagtaacttca

SEQ ID NO: 12929 - DNA, 1076 bp, Homo sapiens
tgttacaaacaatccaattctactcttttttttttttgagatggagttttgctcttgttgcccaggctggagtgcaatggtacgatctcagctcactgcaacctccgccgctcagattcaagtgattctcctgcctcagcctcctgagtagctgggaaaacaggcgcccaccaccatgcctagctaatttttgtatttttagtagagacgggatttcaccatgttggccaggctggtctcgaactcctgaccttgtgatctgcccgcctcggcctcccaaagtgctgggattacaggcgtgagccaccgcacccagcctccaattctacttttttagttattttactatgtacaattaagttattattgactctagtcaccccattgtgcaaacagtaggtcttagtcattctttcaaatgattttttttgtacctgtgaaccacccccaacttctcctttcttttaaattagaaaaaattattttcgagatagggtctcactgtgttgccagggttggtcttgaactcctgagctcaagttatcctcctgcttcagcctcccaaagtgctgagattacaggcgtgagccaccctgaccagcctgatatttatttttatatccctgttgtgtagaaataaagaaaaaaagagatatttattcaaattcagtaaaatattgtgtgtgtggctgtgtgtgttgtgtgcgtctctgcatgtgtttgtgtgtctgtgtgtgccaatgtgtgtgtctccgtgtgtgtgtgtcaatgtgtgtgtctgtgtgtgtgtttgtgtgtctgtgtgttgtatgtgtctctgcatgtgtttgtgtctgagtgtgttaatgtgtgtgtctgtgtgtgtcaatgtgtctgtgtttgtgtgtgtctctgcatgtgtttgtgtgtctgtgtgtgtcaatgtgtgtgtctgtgtgtgtgcaggggcatgtggagttctctgaactaaactccatgaggaatataatatttattaaaaggaaagtaatatgattgtactaatctgaaactcacatatgtattattaaaactcaaccacagcaattgtttagtcc

SEQ ID NO: 12930 - DNA, 1070 bp, Homo sapiens
aaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattga

SEQ ID NO: 12931 - DNA, 1004 bp, Homo sapiens
ttaaaaaatcagatcccattggctgaggagccaatggggcgaagctaccatctgtgggattatgactgaacgcctcttaagtcagaatcccgcccaggcggaacgatacggcagccccgcggcgcctcggttggcctcggtcggcctcggatggcctcggtcggcctcggtcggcctcggtcggcctcggtcggcctcggatggcctcggtcggcctcggtcggcctcggtcggcctcggatggcctcggttggcctcggtcggctcggttggcctcggatggcctcggatacctcggatagccggtccccgccggcgggccgccccgccccgcgctgggaccagggtccggtgcggagtgccctttgtcctgggaaacggggcgcggccggaaaggcggccgccctctcgcccgtcacgcaacgcacgttcgtggggaacctggcgctaaaccattcgtagacgacttgcttctgggtcggggtttcgtacgtagcagagcagctccctcgctgcgatctattgaaagtcagatctccacacaagggtttgtaaaaaaataataataataataaaaataaaaaataaaaaataaaaaaaccatcagatccccatggctgacagatgctttaaaggtagtgaccccatccctccaggctcagctgcttcctccactttctcctcctccaggaagccttccctgaccacagcagaccatgatggtctttcccttctctcacttccacgctctgaccccacagttggggtaagcaccagtttatcccaaagctaaggagctccggggcctctacggaaaatagaaaagtttcttaacgttaccctaataagttgtaacaaatgtagtggctaaaaacaatataaatttattatatgacagttcttttttttttttcttgatatagagtctcactctgttacccaaactggagtgcaatggcacgatctcggttcactgaaacctccgcctcccagattcaagcaat

SEQ ID NO: 12932 - DNA, 1085 bp, Homo sapiens
taggctattgaatgctgaatagatgaatttttgtaaattaaaggtactgtatcatcctcaaggatgagaattccaccttcagattactaaccttaggtttattaacaagtgtcagggtgcctgcgagtcctttgaattttttatgtaaaattctgtgtgcatttttctggtgacaaaaatgtttctagattgttacaggctcctgggcagcatctcctcccgctacagataaacctgataagaacaaatgcctaagtctctaaactctgatgaggagagttatccttttgaggatttccattctgttttcataatttttatgtgctgaaatgagttgtttatcttttgctgataaagctgggtattgctgactttctgaattattttggagttctcccttcattaatatttgaaaattattgactgatgaaacagcttagttacataataataaaagttgatattcttgaaccaactatgtattatctgctgtcatgaggaattcagtgttaagcattgctgaaatggaatttaatattctcaaacaatgctgccttcatagcagctttcatctacttttgccagactgaatgtattgatatagtacttaatagatttaaagaaattagtccctgggcttaagaaatctctgttctagagactgggacattttagaagactattgcattttcttttgttcaaatagataattaaagtgaggtcgtgtctgaatgaagtttttgctgtgccttctttataattcagcttctcttccagagctgtggcacatggggaaataagcatgggcagagaagaactgaatcaccgcagggctctagctgcaggctgcggttcagcagagtgcgcctgcagaagggctgtctgcaggaagtctttgcactggaggctgtgtctgcctgcctgtcctacctccccaaagcgcaggctcagctttggcctcagacctctctctccccccggggctggagtgccttctctgtgccccgtcaccacactggttgatgccaaggaagggagtcctcgttccctccctgtgggaaaggagacgtccttggtttccggag

SEQ ID NO: 12933 - DNA, 1045 bp, Homo sapiens
gcaggagaatggcgtgaacccgggaggcggagcttgcagtgagccgcgatcacaccactgcactccagcctggaaggtagcgagactccgtctcaaaaacgaaaaaataaaataaaaaaaaaaagttgggcctccaaagcctgaggaagcatgacatacccaacatttttacagttgtgacacttaatttcatctggcccaatctcagtttcaatccaggttgatctgtgttttgaagataatatagtgcttgatattaaatgagaaatgaaggcgtatttgttcaactcatcagaccagagtagaaatggttctacagctttttgagatacatacttctttgggaatccgtgagaaccagtggactcttttcctggagaatacacacacctacatgcggccttcacagagactcaggcacaggcgtcctgaaactggagctcgtcaacttgtgtgggaggagcagagggctcttgtgggtgttcgggtgtcacttgtgaccgtggcttcgtgttggacccttgtatgttgcaaaatagtgcacctaacaatatgtgtaacccagtaaagcttcagatgcatgttgatttcacagcttttaaatattttaattacataaagcgaaagtaatataaccagtaacctgtgtgaatgattctttgtgtgaaaatgggtttatttgttatttaaatgtttttagtgaaaggtatttaatatgatgtggtaaaccactgatagtatctgcattaggtacaaaaggactttaatttcctttttgaaaaaaagtagtacttgaagaagttaatgttttcgagtgaaagtatttataatgtctttggaatttattttcacttttgggtgtttttgtttttgattattttcccccactagactaagtccgtaaggacaggagccctcccctttagcccccaggtagagcaatgcagggcctacagcaggtactcgatcagtatttgttgaatcgaacttagttttcttgtccaaaatttggctaaaatattcagttatagttttcagcgcttct

SEQ ID NO: 12934 - DNA, 1047 bp, Homo sapiens
cccaagaagagagctcagaagtgtttgtgttactctttattgaggaataatttacagatagtaaaatttaccccttatatctgtacagttttgtgaattatgacaaacttactcaggttgtgtaaccaccagtgcagtcaaggcatagattatttccatccttccagagaagtctctgggaccttttgtagtcagtcccctcatggaatgttttgatcaacgtagaaatgcctggaggctgctgggtgggaggctgatcactcagccatcagagcgtcctgtgtctctgagccgtgcaccccattgtggcatggcactggttgctggacattcttctgcgggcccactcacacatctgcctgcctgcggcctgtctgtgtttgtcttactcatgctcttggagccgtagcgaatgtgtctaatattccttccacgtggtagattgaaacttcaccaaaatagccctgtgcgcctactttgctcctgaacatctctgatttctccggctgtccctgtgtggagttctggcagatctcaccagtctacatgacctattggaaatgccagtgggtcattgtggcattcagacacataattcaaaactgcaaatggtgggaccgcactaaagaatttttagtaattaaagtacaggaggctgaggtgggaggatcacttcagcccaggaggtcaggtcaaggcttcagtgagccatggttgcaccactacactgtagcctgggtgacaaagtgagaccctgtctcaaaaaaaaaaaaaaaaaatatagccccatcttagctgacactagtcttttgccagggccttatttgatcagacaaaagcagtgtttcggatcctagaggtctttttcaggaacaacccttaaagttttagtatccgtgtgggtggtagcccatagacatttctgcaagagaacagcattgttctgtggacatatttgggttttaaagcacaaatggcagtgtggagagggtttggagttacttttacttaggaagccgatttcctcttaggatagtctttgaaagt

SEQ ID NO: 12935 - DNA, 1036 bp, Homo sapiens
gacatttatgcaaaagccacaaaattacacctgaaattactctgtaaggagctctgggatgctgcgtgtgttaacattccattatttggcagtcagaactctcttaccgtctatttttattaggcaggatgtttgtgtaggatgtttattaggcaagatgttctatttttttcttcttagctttgctgaaaatattgtacgtgatttttcttcattgttatagtagtatttttcaatattttcatgattctaacatgtactttctgagttttttcctagtagctataatatggttagtttaatgtggttacactaaagataaaattacaatttgtagcgcggacacagtgaaatgcgcgacttttcatgggcactacttggcattaaggttgactaaaagaaggctcctctcagtgtgacccctggggagtggggcttgaagtcctgtgccccgggcctggctggccatttcaccctagtgtctgtaaataagaatgaacatagaaggatcctcattcataaaaagcagaccaaaatgaataccagcagttatctttgcataggaaggcagtggttaatgtccttaacttcacttttaaaatattaacatagcctttcatcctttagcaattggccttcctggggctggctgctgcccctccctgcagggtgtgccaggtgcaggcctgtcaccccggagcatgggtgggatgggctgctttaaggagacaggtggagtcttacaggtattcggtgagagggccctggcccagacctggagctggactccccagggtgtaccctttccactctcgctgtcaccaggagattagatgactcctgagtcctgtaccctagactccatgtagttgacagtcatcctgaaagccagatgtggcaggaaagtgcacacacatcgagcacccagacacgtggcaggcagcacaacagcagcaggagatgagagcacgctgcgtggagctgactccaggtggcccagctgccagcacactcacttgctgagcgggagggcgcg

SEQ ID NO: 12936 - DNA, 1045 bp, Homo sapiens
ttctcttgcaatcatactctatcgaatgcagtactgtttgtgaaagtgtcttataagcaatgaagtatcatatacgtgttgggagttttttttagtaattcctttaagtctgttaaattctaaaccctccatgtggctattccgaagtgagcaggtctatgcaaactcacccccaaaggctgagcgagctgagacgccaaagaaagaggctaacaaatccagtttctcgaaggaaacattggctagggacgtacgaacagaagcccccgagagacagagacggtggaccccacagccgcctgccctcagaaagtgttctttatacagcaggctttcagggtagaacgtgtgcagccggccctgtcttctgacttgcttgacaacacttgggaccactggtcaggctggatgagcatcttgatgagaggttgcctgtgccggaggcatcgtcttcagacctcattgcagaacagcttggcatgcacgagtcgagcatcggtcatcacggtggttttgcttcaggatggcgtcactctggccacacagcgggctgtcttcatacagtggtcttctccaaatccttgcacctaaaaccattttgtcccctttctttcttccttccgtcagccctgtcatcaggcaggtttcttaccttgtatcacaggatatcttttcctgtgctgtatgctttgtttcttcaaatggcaagtgagtttcttcttggaccagggcatgttacataggtccacagtgctttctctggaatggttggggctgtatgtgtttcagagttcagaatttttcagattttaggaagatagtacaatgtataagaggtgtattatgtaatccccaggtggggtctaggactgcaccctgtaatcaggcacattcacacagctctccagtgaaatgtgagtattcacagtaagggggaggagttaagattataaatagccatgactcagtttaggtcagattttgccgctcattgaattttgacatcgagcttaaggaaaacccagttttcataatgttgtggatt

SEQ ID NO: 12937 - DNA, 1052 bp, Homo sapiens
gatccataattcattagaagttgcaagcagtaatatcctgattttttttttttttttttgagacagagtctcactctgtcacccaggttgaagtgcagtggcacaatctcggctcactgcaacctccacctcctggactcaagcgactctcctgcctcagcctcctgagtagctgggactacaggcgcccgccaccacgcctggctaatttttgtatttttagtagagatggggtttcgccatgttggccaggctggtctcaaactcctgacctcaaatgatccgccagtctcagcctcccaaagtgctgggattacaagcatgaatatcctgattttattcttccttctttgtttagttgctggaatagttaaaaagaaacctttccccttcaactcttgaattgggtagtttggagaatttaactatgagcccacagtaaatacagaggacagcagagcttactgaatgtgttgcagggtgaaatcagcaaaatgtgcagtgtggcaggttctgtaggacgaatgacctggcttctccaaccaagggagccaaagcacattctgggtcacagatcatggaggacagagaggatcagcgttggactctctctctctctggtataattttcataggtcagttccctggggtcctccagagatgaccagggagagtctctgttgctgcttgtcgtccatcatcgtgaacacatggatttaaacacatctgatgttttcattgctgcattatccttaatgctcagatggtctctttggctagtagggtggactcttgagtccttttggtaggcccctcattgtctgtgacagcctttccactttttgctgtgacaaaagtccccatgctcatttcacccctttcctccctgggcctggcatcagccatttccccaggaagccctgctcctgtgtctgaagaatgtgatctagacaccgaggtcagcatgctggggaatgtattgctatacatgacgatgacctgaccattctttcctaggctttttcagtggactgggctaagatttttttaaa

SEQ ID NO: 12938 - DNA, 1040 bp, Homo sapiens
tttctttttttttaaagtttttgtagagatgggggtctctctatgttgcccaggctagtcttgaactcttggccacaagtgatccttctgccttggctcccaaagtgctgggattacaggcatgagccactgtgcctggcctataattactattttaaaatgaggaaggaggtaggagctggcagcagagcatcttgctccagggctcaccttgctgcttctgtagctggatctccatctactgctgtcttctaagaacacttgcgactttaacccatttatgcgtagtgttccattattggaacgctaagcttttgcgagttatttatatcctactgctcagggtcatcaccaaggtctgatttttcacacacacacattgcagcctctggcataaatgggttaatgaggaccaaactggagaattcaggatcatttcccgtctccagatccttagtttcgtcacatctgcaaagtatcttttgccctataaggtaactcccaggcccagggatcaggacctgaacatctttggggtcattattcagcctgccgtagaggtttttgaagataatgttatgactccatctagataaatcttgctaatgatatgttacattttgaaacaaatattgaatttaaacatttagaggtcaaagataataattatgaagccttggctgtatgagctatagatacctcctcccataagagtattattattattattttcttcttttttttttgagacagagtcttgctctgttgcccacgctggagtgcagtggtgtgatcttggttcactgcaacctctgcctcccgattcaagcgattcttgagcctcagcttcctgagtagctgggatcacaggtgtgtgccacctcacttggctaatttttgtacgtttagtagagaagaggtttctctatgttggccaggctggtcctgaactcctggcctcaagtgatccgcctgccttggcctcccacagtgctgggattacaggtgtgagccactgtgcctgcatgttttatgggctt

SEQ ID NO: 12939 - DNA, 1109 bp, Homo sapiens
gggcttctggctccctgagattgggctctgagacgagacgggttcccaaggccctggtggggctggagtctcacctgtttgcatggagaaatgggctggccccacagcctcacaggagcagtttgtgggctggtttccccaggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttctctaggttgtcactgtgtatttgtgcagagcgcctcagatcggggactgggtaccactgggcacgtgtttggcccctggatgctgctggggccgcctgcctggagaaacctgatgcctgctcagatggaggagtgctgaggcctccagagtggagatcaaatcaaattagggcaagcaggggaggagggaggctggctgactaggcttcattcctggaagcgaatctggagaaccctcaggaatgaggagtgatggggccaggggacagccgctcgtcccccaggaaggccacctagcaggaccaggggtcgcccggtgcagccgtgggcgccagtcagcctgggttcactgtgaggctagctgcgggcatttgagtagtggtggaggggtcagaaacgggaagctctggccctggttcccaagcagcggctcaaccagaagagccagtttctccaaaaatgagctggatatttgtgagccacacagcatgtgcaggccgtggggtgacctgaggccgatgcccgaggctgggaggccacagtcaagggaaatggggcccacggaaga

SEQ ID NO: 12940 - DNA, 1131 bp, Homo sapiens
caccacaaatcacgtaacttttatatgtactgagaaaacaagcgtgagccaaaaatcatgtaacttttatatgcactgagaaaccaaataatttgtgtgatttgctttattgtgatgttagtccattgaggtggtttgaaaccgaacttgccatatctccaagatacgcttgtattcaagaaccatttgttgaaaagactattctttttctatcgaatcatctttgtacctttttccataacttagtaaccttatctatgtgagtctctttctggattatgtattctttttttcgatcttgcattcaatttgctaatatctcgttgcgcatttttgtgtctgtgctcaggctgttattggtctgtagtttcttagtacggtctttggttctagtatcaggggatgctggcctcatagaatgggttgagtgctctctctcttcagtgttttgaaagatactgtgtagaatcagcagcatttcttccttaaatgtttagtaaattccccagggaagcctgtcctcaccgatggaaaactgctaatgtagagaagtcagctgaggcgtctaaagggactaaggaagggaggaaaggacaccaggaaactgtagcctaaggtccagagggttctggtccagacagagcagcagggaggccccgggagctccttcccgatgtgggctgtggtctctgcaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggtgcggctgagctccagcgggcccttcactgtggagcagaacatccgagggcactgcggtgtcttgagggcttctgcagctccagctctgtgggtcacacctgctgcccctctgactcacatggattggcaacaggccccttcccaggcctccccacaccatgttcggaatgttgtcctaggaagggctcaagtgcaggtgggaggccagagtgcgtgcagctgcactcaggaga

SEQ ID NO: 12941 - DNA, 1121 bp, Homo sapiens
aggtgacagcctcaaggtctggttgtggtgaagaagtgtttttagctcaccattttaattcctttattgacttttacatattttaaattcatttttattaaggtgtaatttatatacagtaaaatgtactctgtggcgtgcagttctgtgatttttcctaggtgaatggaattgcatcatcatcagcaggatacaggatagtcaccgcccgaaaacattccccgcactgccctcctcacctgacaccctttagccactggtgtgtcttccgtccctgcattttttttctcttctagagcgtcacataagtagagacattgtgcagccttttggatgtggcttcttagcaaaacacacctggaattggttcatccacgcgctcgtgtgtatcagaactccctttctgttgcgagcagtgtccattgtgtgggcaaaccacagcttgcttttcattcactggtggaaggacatttgcgttgctttcactttggggtgattaataacaaagctgctgtaaacattctgtaggtgtaggtttttgtgtgaacataaatttcaattctctgaggtcattttttaagtgtttgtttaacttgataagaaactgccaaactcttttctgaagtggctgcaccgtgtcagggtctcctcagcagtgtgtggcaagagttgctgttccacatcctcaccaggacttggtatcattgggtttttaaattgcagctattccagtaggtgtgtagtggtatcgcattgtgtttctgatttgcatttccctggcgactaatgatgtggagcttttttttggagatggagattcactctcattgcccaggctggggtgcagtggcgcgatctcagctcactgcaacctctgcctcctggttagctgggattacaggtgcctgccaccacgcccccccaattttttgtatttttagtggagacggagtttcaccatgttggccaggctggtctcgaactcctgacctcaagtgatccacctgcttcggcctcccaaagtgctgggattacaggcgtgagccaccacgcctggctgtggggcattttttaatgggcttctttgctgtcctggtgtctgtcctctttggtgaagtttt

SEQ ID NO: 12942 - DNA, 1038 bp, Homo sapiens
gcccggagtagtttttggagaagcttgctgatgccaggggccctgcctttgcttgtgttgggagctgtctttcacgcgctacccagtgagaggcttagtgtacatggccccatttatacagttttctctctgacaatgaactcaggtgtcagcgagtgttccttctcatttccacttctcacttctctaatttacttttagctcatctaaaggctgcagataaaattattaacaatgacattttagcctcatctgtgaggcaatctgaccagccatgggtcccctcagattctagggtgtttgcagcagcccgactcagggcctgtggtgtgtgtgcctctccacagcgtacatcgtggccgtgtaccactgcatgaaggacgggctgaggcgcagtgctccagggagcacccccgtgaggaggaggggggccagccagctctcccaggaggccgagggggcggtcggagcccttcccggtgagcagtcttttgtcttttgaggccactgccatgtgccagtgacctaactcctctgtgtgccatgggtggtccccggtgccagtcccccaggtgggaggtccccagtgccagacaggtcccagacccctccctcagcatccttatacttccaggaatgatcaccttctctcaggattatgtcgcaaatgagctcactcagagcttcttcaccatcactcagaagattcagaagaaagtcacaggctctcggaactccactgagctctcagagatgtttcctgtcctccccggttcccacttgctgctcaataaccctgccctggagttcatcaaatacgtgtgcaaggtgagagtgccagcgtgcgtgtgaggagaggacactaacgtacatgtgtaaggcgagaatgttactgtgtgcaaggtgaggctgtaatgcgtgcaccatgaacgtgctagcgtatgtgtgcaagataaggacaccgacatacctgtgcatggtaaggatgttaatgaatgcaggatgaggctttcagctgtgcaagggggaggtacctac

SEQ ID NO: 12943 - DNA, 1046 bp, Homo sapiens
gcgtgagcctctgcatccggcctagtgtggtgttctgatgtctaggcagtggctttgctgtgtccttcctgtcagggtccccggcccgtcacacacttgctgctttgtactgtgctgccctcccgtcctgctttagaacacacagagtttgggatgcggtgaagcctgaacaagtttaaggaatgaaatgggaagaaacagatgaggcatgagggtgaagggatgaaatttggaccgtgacttaaggtggggacagtgagaaggggaggcgacagtgacggatttggacccagccgtgtagggaaaacctgtgcccatttcagttggagcgtcccgcgtggcagcagcgtgggaggctgagggtacgagggtgtcgtgcaccttctctttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagtgagtgctcctcctccctgggctgtccaccgcgtcctcagctgggctggtcccttactccccagaaccagagacatggccagccagtgcctctgggataagtagtgtatttctgagtttgtggagcataacaatccaaaggatcccagagaaacacgcagctgctgctgcagcgtcgcctgcacatcctgcagagaacactaggtggcacctcctctcctgcccctttcctgcacaaagtcatgctacacattgtattgctgtgtgccttgttgttttagtgaaaatatgcctgtgtcaggagatctgtgtgaggacatgccatatgaaagaacatttagcctctctccagccttgtgccgttgttacaaatagcaaatcagtgagaggcttcatgcatgagctcatgcagatagatccgtggggtaattgctggggcgtagccctcttgcaggcctcagaggtgttgtaactcggga

SEQ ID NO: 12944 - DNA, 2259 bp, Homo sapiens
cccccaggggctctctttccgtttctctgactaggaaaatgtgatttctctcagtttttgccatctacaccctcaggttaaacccatgagagaatggaggaagatgaactgggaacctccccagatcagtgttgactgctgtattctgacagctcttgtctattctcagaggctgcaggttgcttttcaaaattgcgtccagaggccaggcatagtggctcacacctgcagttccagcgatttgggaggatcacttgagtccaggagtttgagaccagcctgggcctcatagtgagacctcctttctacaaaaaaaaaaaaaaaaaaaaaaagccatccgtggtggtgtgttccttgtcccagctactcaggaggctgaggctggaggaccacttgagcccaggagttggaggctgcagtgagctgtgatcacactgctgcactccagcctgggcaacagactaagaccctgtctgtaaaaaataaataaataacataaaaattacatccagagtttttagttgtaatcattgagagaggtggactgtggcgtggtgggtgtaccccgtcgctaggggcaccagaagtctaggactccgaatagcgtgtgctttgtgtgtgtaccacagacattaccacttacgcccagtgacgagatcatcgtcgtattctcgccaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggtgactccccagccaccctcgactgaactgggggaggctccagcagggtggtatggaggaaagaaacccgcccagggtgtgggctggggaacagcagcgacagtggactcgttcccacaggtgaggtgaatgtcagcagtgtgtctgccaaaagtggcctttgggcagtgggccgggcagctgcaggggcacagccacatcccgggcagaagtcacgtgggcagccagagcccccaccatccagcccttgccggcctgtctgcccgattcttccaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccaggtatggcctgcaccagccgcccatcatgtgcctgcctcccacacatctggggtgacggtcttgtttccttctccagggagtatccgccatatctacctgtaccaccacgcacaggcccacaaagcgctcttcgggatcttcatcccctcacagcgcagggcatccgtctttgtgctggacactgtgagtcctgggccctccatggcagcacattggctggggcagggtttggggaaggaggacatctcccagggtgcccaggccctccaggtcttgtcctcaagggcctttgcccatgagtgcttgtcgtgattgaattggcagtgccgtggcagtggtggagtctgccccagggctgcccccacttcctcctgcgcagggggaggctgacgtggcctgcgttggtctaggtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggtgagagtggttggggtcttgctgtgtgagccccatcttctttgaggctgggtccacccaggtcttttcttccattttgccttgacccaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtgagcacagtactgtcgttgtgggccagtggtccccaggcagagccggcctcggtggtctctgtgacccggcgatgtgccccggtgctgacctgtgccctggtgcagg

SEQ ID NO: 12945 - DNA, 1149 bp, Homo sapiens
acagcctagaactcttaatctcacgttatcctcccacctcagcctcctgagtagctgagactgcaagtgtgcaccaccacacctggctatgtattttttgtagaggctgggtctcactgttgcccaggctgatcttaaactcttgggctcaagtgatcctcctgcctgggccccccccaaagcactgggattacaggtgtgagccaccatgcctggcctatacacaactttattgaacatataaaaatttacctaagtaacaaaaagaggtaccatctttacagatgaaaggactcagtattaaaatatggcagtttgccccatattaattcataaaattcagtgtaattccaataaaaaagaatctgccaaaagctttttggatagaacttgacagacgaatcctaaaattcatataaagggtaaggataagaataaccaaagaattttgaagaataaggagggcacgttgatcttactatgtaacgagacacactatcatggcatcttgacaagatgagaggagagcagtagagccgattgggagcctagaaacagactcccctgttagtcggaagttggtaggtcacagatcgttaaggagagagtggactgcagtgagtgatgctggtgaaaatggtttttcatatttggagaagtaagttgttgtatcacactgagtgtgaaactaaggctgagtgtgatggctcatgcctgtaattgcagtgctttgggagtccaaggaaggaggatcagttgagcccagaagttccagacgagcctgggcaacatagggaggtctcgtctctacaaaaaaaatccggcacaacattaggcatggttgtgcatgcctgtagtcccagctacttgggaggctgaggtgggaggatcacttgagcctgggaggttgaggctgcggtgagccaagatgaccactgcactccagcctaggtgacagagcgagacccctgtgtctttaaaaaaaaaaaaaaaaaaaaaaaggaaactacaatctttggtaaacaactcaggagactatgatgctggggtgggaagggcttttttaaggcacatgtgaaaaacatcacaaagggaaagaatgatcaattaattaaaagttaaatcttgtgtagtctgtgacaagaaagg

SEQ ID NO: 12946 - DNA, 1124 bp, Homo sapiens
agtcacaattctctggaaatatatactaattgtaacaatgtagcctcacattaaataatgtaaacatttacctaattataagaagaatttacctccaatcagtttgggagatgttaacatccctccctcaattgatagttggagcagaccaaaaatcagcaaaaatatgtttggaatgacacaatcaactaactagatttagtcactagctataatacatttagtgaacaaatgtagtcttgcactaaaattagagaatacctatccttttcaagaatacataaaataatgaccatatatataccacagagtaagctgcaaccaattctagataacttaaatacagaccatgtttggaaatttaagaaaaaaaaaacacatttataacttgtggatcaaaaaagtcatagaacttagacaatacttggaactgaatgtaaatacaaatgctattaaaatttgtagtatgcagttaaacaggacttgtatacgcatttatatatctaaatgcatgtattagtaaagaaaaacaaatagaaaattaagtttccaactgaaaaagttagagaacaacagatccatcagaggaagtagacagaagttataaagagttataaaggtaaccaggcatggtggtgcacacctatagtcctagctactcggaaggctgagaggcaggaggattgcttgagcccaggaatttgaggttgtagtgggctatgatggcacctgtgaataggcacttcaccccagcctgggcaacacagggagaacccaactcaagaaagaaaagaaagaggttacaaaattgagccagaatgagtgaaacaaacaatacaaccaaaatgttgttctttgaaaagacttaggaaaatagtcacatctttttcttttcttttgagacagggtctcattgtgtcacccaggctggagtacagtggcgcagtcatggctcactgcagccttgacctcccaggctcaattgatccacctgcctcagcctcctgcatagctgggactataggcgcacaccaccacatccagctaatttttgtaattttttgtagagacaaggttttgtcatgttgtcctggctggtcacatctttttcaggacagagtttt

SEQ ID NO: 12947 - DNA, 1049 bp, Homo sapiens
agtgtgtgtgtccagcaccacgaagcaacacaaaacagctgcaacccctttgtcagcaaatcctctccctaccccgaaaccctggcaacccacaatgtgttttttgtactataattttgctttgtcgaaaatgtcatgtaaagggaagcatacggcctgtagcattttgggtctggcttcttggacctaacagatacacctgagtttcaccacttggttgcatgcatcagaacttccttccttcctgctgccaagtcgtgttagttatgtggaaaagcctcggtttgtcaatccatccactcctggagggacaccaggtggtttccaggtttgggccatcatgagtgaagctgccccctcttcactcttgtttctcaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtgggactctcatagcttttgtgctttagaaaggacatggattgagatagattaaatttagcccagaaaggaggttggatcaggagccaggatagaaacagacctgggttcttgtgatcttactgattccgtttgcaccagctctgtctgcccgcctgctgtattctggctctgtggctgcaggcccttcagccattttccttttagagaagcagtggcctaagggagagagacgtttgctgcctcgtggatgacaggtggagggttggaaagggaagaggcgggcagagaggatgaggcacagctggtggctccccagcgctccttgccactgctgtgcttgccttttttttttttttcaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctct

SEQ ID NO: 12948 - DNA, 1044 bp, Homo sapiens
ctcctaagtagctgggactacaggtgtgcgccaccatgcctagctaattttttgtattttttgtagagatggggtcttgccatgttgcctaggctggtctcaaactcctgggctcaagtgatccgcctgcctcggcctcccaaagtgctgggattacaggtgtgagccaccgtgcccgcccacctttttcggtatgagaaactagcagtgtatctgagctgttgctcctttgtggtgacgtagaagccatgttcttcagcacccctgtgccctggctccctctgctctgggagatctcacccacctgctctgcccatctccgtcgtgcttagattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgagctctgaggggctgcaagctttggcctctgtgagggcagtttcagtcggctcatgaagtgggcactcttggctccttgcctgggatcctctgagcaggcacttgcactcggatggtaacgtgcaattgtttttgacttggaagagttgatggccacgaaggatgcagaccatcatccaccctggtctgaggcctcagaaggaccctaaaggatgatttctaaagtgattatttagagcaggggtcagcaagctacagctggctggccgtttgagtacatcaagttttacgaacccaactgccttcgcctattgtttatctctttcccgctgtcatgggaggtgaggagttcctagaaactctaaggccttctcatctatggtattcaccatccggcccctcgtgtttaactgacgtatttcatccggtaggaacatggaaaatgcatagcaacacctctgttttgataccaacgggtcattattttatatctgatcagattgagccattttttttctgagagaccttcactgtagactcagcacggcccctgctgtgcggcc

SEQ ID NO: 12949 - DNA, 1377 bp, Homo sapiens
ctgctgccgtgtgcacgcatccagatggccacggagcagccccaggcatgtgagccacatcccggctccccctgctgccgtgtgcacgcatgtatgccagcccgctccacccagcaggctgtgtctccgggacacacgtgttttgtcctgtgccggtctccttactgtgtgtgcggcaggctggtcaggccaggctttgctttctgtgcttcacacttgaccctgggctcttgatttttgatggccctgctctctggcgttctctcctcagactctggccacgtattctgtgtcagatgctgtcgccacttactacctgtacatgaagtacgtccacccattcatctttgctctgtgcaccattattcccatggagcccgacgaggtgagcattatctgtcctgtcggcaccctggcctcctcagcccttgccccattccaaatgcactggagctgaatggaggtggatgtcccaggagtgctggcaccagaggcggcagtagaattctggtgtgtgacgtcagggatgtcctttgggaattctctggccctggtgtgaggaagaaaccacaggaggcagaatttgcagccatttaccacgaggttttctctcctttcacactgaagttcagcttaggttcctggactttgcctgcaagtcagggcctttggtgttgcttttggctggaagccttggtttctcttgcaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatggtgtgcttcttccctgggattcagattcttcccactcttgtgctgtggtaggacccagaagctgcaggggctgaaataaagccccttctccccatcctgtcccacggcccctcaccgggtgtggcttctctggcccagcaccccccgggggcttctttagggcagtgcactgcagattgtgcacatgagtccttccggagctttctcgggcacaacctgccacgtgcagccacagcgtcaaacctgaggcaggctagtgtgggtgtgtttcccctctgaccccgtcgtctcactgttgtgctagaatcctgccgcctttgacttcctgctgcagcgggttgagaagaccttgcgccacgcccttgaggaagaggagaaagtgcctgtggagcaagtcaccaactttgaagaggtaaccatcagggaggcaggaagagccagtctgtgtttggcgc

SEQ ID NO: 12950 - DNA, 1078 bp, Homo sapiens
ccttctcccacccaggaatatggctgcaacccttctggtcatagcgtggtccttatctaaagagtgggggacacatgagggaactttgagtgaatcaggtgggagatgtgaaggttcccagctctcctttcctctttaacgtcattgagggccacagagaggccactgtgagaagccggaggtgatgggcatctcttttagccatcagaataaagctttcaaggattatgagggagaaattgagagagatccccatttggaggccgttacagtgtggttcttgtgaataaggctggtagtgttaatgtaggggtggagtaaagacctagatgagagggtttgtttctaaagtgctgagtttcccgaaaggtaggaggaaagtttctctaactgtgtagaggatggtcttgtgtctgtgttgactgattctcttgtagaccgagattttagatgaagataagcgcttaggcagtgcagtggattactactttattcaagatgacggaagcagatttaaggtaagcccctgactgcgacaagctaaaacccacttttatgggtgttcatgtagctctgtgactgtcagggagggcatgggaggcttccagtgcacagcagcccatagcccagcagaactcgggcccctggaggccccatcagtcatcacgtaagatgtcctgagagaggtcagttcaggaagactctgaatggtgagaagtagcgtgtctttcagattcttgcccctgtgaaaagtgcgcattctgacttcctgtatgctaccaaggtcaaggctaccctggccctaggctgttcatgggatataggagcaagcaatgtgttttcacttttctctcgctttcttctttctcatcacccctggatgggttggtgactcttaacaggtggctttgccctataaaccgtatttctacattgcgaccagaaaggtgagtgtgtttcatagactcaggtcagacgacctgtgtgtcattctgtggtgggctttgcaactgggaaataggcaaggaaggaaatgtattttaccaatggaaagccttttcattctgatcctgattag

SEQ ID NO: 12951 - DNA, 1028 bp, Homo sapiens
attacgggtgcattcaactatttaaaagattaaacctttattatacagtatggtggtgtatcagtttcctattgctgcagtaacacatgatcacttagtgactatataaatttattctcttacggttttagaagtcagaagtcgtaatatgaaagtgtctggttggttatatttattgtgatggttcccgggggagaatctgtttccttgctgcttcttcatcttcagaaccaagggttgcatctcctctcccccctaccctctctctcccatccctttctccttcctgactctagctctcctgcctcactctacaaggattcttgtgattacactgcgcccacccagctaagcagaatctcaaggcccttaatttagtcagatctgcaaagacccttttgtcttgtaagataacattcacaggtttgggggattaggatgtgggtctttcatggggggtgtcatcctgcctgcctaccacaagtggttataatctttcatgagaagtaaggatcctagtcttggaatatggtcattctgctcttgagttgaaggtgatccaaggaataccttcagacaaaggaagggtcttcctttctttttttatcttgttctttttttattttattttttttttagacggagtctcgctctgtcgcccaggctggagtgcagtggcatgatcccagctcactgcaagctctgcctcctggattcacgccattctcctgcctcagcctcccgagtagctgggactacaggcgcccgccaccacgcccggctaatttttcgtatttttagtagagacggggtttcaccatgttagccaggatggtctcaaactcctggcctcaagtcatccaccctccttggcctcccaaagtgctgggattacagttgtgagccactgcgcctggccctcaacctttttttgaggtaattgtagattgattctcatgcatttgtcagaaatgatacagagattcccgtatcacttcaccataacatcttgtgtaagtagagtacaa

SEQ ID NO: 12952 - DNA, 1286 bp, Homo sapiens
cgagagtctgctccggattttcaaaccacactgtcagaaatgctttgcaacgctgacattaagcattgctttgtgatggtatttaggaagcaattctgtctgagagatccttgcctatgtgtgacagtaaaacactgtcgcctctaagatctgccccagcagctgtttgctgaggagaaggcagctctgtgagatccatgttcctgtgggctgagctacacggcacctccagagctcctacacctccttcctggtccttctgaggctcatgcgaagcccaggcatggtcagcatctgtggtcacgctggggcctcggtcacgttgtagcttcacatgccacagagcctgctacagggctggctgcatcctgcatcccacccttcccgtcactcagagagagacccacgcttgtgtgaagatgaggaaggactctaaagtgttatgagagacaaataggatcagaaagccaggcacaaaactgtccagagaccgtgagtcccatctgtagacagaaattgttaaaagggactcaaatcaatatgccaaaaaagtaaacattagtattttatgagtaaagtgtaggtaaattgtaccgtatacctaccatgcaccctatactgtacatactgtatgtcttcttttcctgtgccactgaaagagggaaaaaactgccaattaacctgtaaaatgccaacatacataggatgcatccaaatataagatagtaatatgtaagacagagtatttgaattgccctaattttcagtatggaaaattagtactcttgaatggaaattcttcagtaccttcagtactcttgaatggaaattgtcgtactttttcttaactttcattttaggttcaggggtaagtgtgcaggtttgttatataggtaacctgcatgtcaccggggtttggggtacggattatttcacctggtgatcagtatagtacccaggaggtagtttttccatcctctccctcctcctcactccctccaccctcaaccaggccctgctgacttcttgttccttctttgtgtccatgtgtgctcagcgtttggctcccactcataagtgagagccatgtttggttttcttgcctgtgtcagttcccttagggtcatggcctccagctccagccatgttacttcagaggacatgatcttgttcttaatatcctgtggtatatatgtaccacattttctttatccagttgaccgttgatgggcatacagcacttttacaattagaaaaaaattaaaagcataaaaactatgataagc

SEQ ID NO: 12953 - DNA, 1064 bp, Homo sapiens
agagacgtggtttcaccatgttggccgggctggtctcgaactcctgacctcagatgatccgcccgcctcagcctcccaaaatgctgggattacaggcgtgagccaccgcgtccagccaagaaaaaaagtttttaatgaaagaaacagaaactgatgccattatataatgaaccctagtacccatcacccagcttcagcaggtgttagtattttgtgactctttgatttttttgtcttgggcctaggtgaaatgacaatggatgctctgttggctcgattgaaacttctgaatccagatgaccttagagaagaaatcgtcaaagccggattgaaatgtggacccattacatcaactacaaggttcatttttgagaaaaaattggctcaggctttactggagcaaggaggaaggctgtcttctttctaccaccatgaggcaggtgtcacagctctcagccaggacccacaaaggattttgaagccagctgaagggaacccaactgatcaggctggtttttctgaagacagagattttggttacagtgtgggcctgaatcctccagaggaggaagctgtgacatccaagacctgctcggtgccccctagtgacaccgacacctacagagctggagcgactgcgtctaaggagccgcccctgtactatggggtgtgtccagtgtatgaggacgtcccagcgagaaatggtaatgggaccgtgtgtaggatttcctcacacagatagcacatacgcggaggggcgggatgacgtctgaaaatggaaaactacagattaagaaggaaaaaatccaatcccctccatctcatcaccccagttaaccattgttaacatttttatgtagaacttttctgaaatatttgtgaatttaacatgagaactgttaaaatttgtgaggtaaattggattctatgagatatgctggactgagatattaatattaactggctgctgctgttggttaggaactttgttgattagtcatctccgcctttttaaaatgcagtgtaacctgcacatcttttatgttaatgaatgcaaatggcca

SEQ ID NO: 12954 - DNA, 1849 bp, Homo sapiens
attccggccgcggaaagggcagttgcggggacttggcttcccgggccgggggcggaggggccacgccgggttcgggggtgagagctttcccgggccctggagcagcctccggggaaggcggcgggggcccggcgaggcgttagcggagactcttgctgcggtctctcgagacctggggagggatggcccaaaggagggcggcgcggggaggaaacccctgggtcccggatgtgtttggaacgtgaagccattgcggttactggtcatggaacataaggcagagacggaaaaggcaaatgtaactcaggggtttggggccagaggaagagggagaaggtggccatttattgctttgcggtagactgtcgggtctgggtgatgtggagatcagaggtgggttttggtcgttttaagtttgaggtaactgatacagtgaactgtgtatttcagctccatccccttttcctggcatacaactcttgaaatcccgggaacctccaaagtgatgtcttttgtaggctgagtggactggtggccggcagcccctagggagcttctggatggggctggtcgcaggaaagaccaaggcagggttagaggttctggggactttcagccccacccccaacctctggggaggagagaggggtgaaggttgcgttgatcaccagtggctgatgaatcacgcctgtgaaatgaagttcctgtaaaaacccaaaagggctgggttcagggagcttccagatagtacgtgggggttcctggaggcggtgcccagagaggccctgaatttccaagcgcttccccccggttttacgtcacgcatctcttcacctgtattctttgtaatcctttatactctgctggtaagtgtaagtaaaacatgtctgtgagttcgggagccactctagcaaattaccgcaacctgaggaggtcaccgggttacgccccgtcggtcccaagcgcaggtcaaacaacctgggcactggaagtggggggcagtcttgcggggctgagccgttaacctgtgggggtctgctggtatctccaggaagacgctgtcagaatagatgactgaattaggatgacagacgacacccagcctgtgtccactgcagaactgacgacctgcgtgatttgtggggagaaaatccccacatacctggtgtccgaagcatgttgcaagactagtgggagaaactgagtttgtttttactctaaattgtcagactgttagtcactgcggagaggtgctttctgatgattgagtggggattcctgtccaattgtgtgagtttgtgtctcggccctaccacttttttttttttttttttttgaaatgtagtctcgccctgtggcccaggctggagtgcagtggcgcgatctcggctcactgcaagctccgcctcccgggttcaagcgattctcctgcatcagcctcccgagtagctgggattacaggcgcctgccaccacgcccggctaatttttgtatttttaatagagacggggtttcaccatgttggccaggatggtctcgaattcctgacctcaggtgatccacctgcctcagcttcccaaaatgctgggattacaggtgtgagccatcgcaccgggccctaccacttattgctgtgggcttaacctgttttcagcctgctcttttaggaatggggatgatagtgatacctggttaggcttttttgggagttgggtaagtgcagcacttggtatgtgttaagcacctctgagtgctgttactgtcaccagcggcatcatccaggcagagctgcggacaaggtggcggcgggtgagggtggtgttttgagaatggctgaaataaaaaaata

SEQ ID NO: 12955 - DNA, 1050 bp, Homo sapiens
cgtggggttttcttgtcaaataaactcggccgggcacggtggctcacacctataatcccagcgctttgggaggctgaggcaggaggatcgcttgagcacaggagtttgagaccagcctgggcaacataattagaccctgtatttacaaataatacaaaaataaaacccaggcatggtagcacgtgcctgtggacacagatgcttgagacactgaggtgggaggatcgcctcagcctgggaggtgaggctgaaactgcagtgagtcatgattttgctgctgcactccagcccgggcgatagagactctgtgtctgaaattcaataaataaatcaagtgcttcctctcacctggttgctttgtaaaatgttggggagattgattcagttgccattttctttgggctcactaagggctggggtggggaggtcgcaaaggccgggcagagctggcccctcgccacgctgttgcagctgaggaatagcacagctgcgagccgatgtcttgtgtccgtccgggcttcacccctcgcaagtggtgacttttggcaaatttctcacctttttgatcctcagcaaaatgaggccaaattgaggtgaatgagaaccttctcatgtaagggttaagttaggtggtactggaacatgcttggcaagggcctggtaccatcgaggcagcaagtgggcggggtgtgagagcacacctgtgcctgcatgtatccgtgcatgtgtgaggtgtgagcatgtgtgtgtgcagcgtgtggagtgtttgtgtgcatggtgtgtgggatgtgagcatatgtgtgcatgcagtgtggggtgtatgtgtgcatgcagtgtgaggtgtgagcacatgtgcatgtgtggtgtggggtgtgaacacgtggggtgtgagcatgtgcgtgtggggtgtgagcacgtgtgtgtgtggtgtgtgggatgtgaacatgtgcacgtggtgtgtgttacatgagtgtgtgtatgtgatgtgtggtgcgtgagcatgtgtgtggtatttattacaactggtgctgcttgcttgccacagatggt

SEQ ID NO: 12956 - DNA, 1032 bp, Homo sapiens
tcatggccgctgcctgcacagccatctccagaggacagaaatgcagcagccttgatagctgttctcctttagctgtggggcgctggacaatttcttacctctctgagccgcatcttttttttttttgaggtggaattttgctcttgtcgcccagggtggagtgcagtggtgcgatcttggctcactgcaacctctgcctaccaagttcaagcaattctcctgcctcagcctcccgagtagctgggattacaggcactcgtcaccataccctgctaattttttgtatttttagtagagacggggtctcgccatgttggccaggccagtctcaaactcttgacctcaggtgatccgcctgcctcggcctcccaaagtgctgggattacaggcgtgagcctcatctttataaaatggggatagtgtcacctactcgatagccttgtggaaaaattaaagaagaagaaatggtgtaaaaccccaaggcagtgtatggagggaggttctgtgctggatgttgctgggctggtctcgttgccgatcttgccagttgtacagggagctctctgcagcctcacgtggtttctcatctcctgcgactgctcccacctctctgtggcattagctgggctgcccggctgggatgagaagaatcacgttgcgtcagccatagtgcttcaagggcttagtagagaagaactgaaaagaatttcaagtttcaagttaggaatttgtgttttccctaagaagtgtaccccgatgtgaggctgtgttcactgcgggggcctctggtctcttacccggtagcaccaagcaccgctcttgtgagagcatgtccgggtctcactcccgaaaggaggcagctgtcgccacacgagaaagtcggggaggctctgctcaccagtgggtccaagtccttctcacggggttgctggcctgggctgggcctggcctcggtctcctggttggggggcggccaagctgcccatcctgggccctcagtctgcagtcggtagacaggatgaggaggtggat

SEQ ID NO: 12957 - DNA, 1063 bp, Homo sapiens
gccgggcggcctccggggctgccagagcagcagggtgaggggctcggaggccgcggcgcctcggggctcgggctcccgctcccgctcccgctcccgcagtgcatgggcgggggaggctcgaggggcggcggcggggcctgggcgcgtccctgcagcgtggcgggacggccccgttccagtcacccccgcctcgctgcggtggcctcgggcctgggcgcccgccttcagctgcggcggagctggctctgtaaatgccggtgcccgcgagccctcctgaatgcttgtctgcgcccgacgagcgcggcctgtcccgaagctgtccactgccaccactcgggcagtgcttgctttagcctggccctttgcagctgaaaggcgtgacatggtgtcgggtggttcgtgggaagtcggggtttcaggagtccgtgtacttccttgtttgtctttgtcgctggccgacttgtcttcattccaggtggccagagcgagtggggccgggcgttgtcacgggtatgaacccgacgaatgtcagtcgtgtggcgggtcctgggtattgtgggtctgggtcactgcccccgcggagcccacctaggacagggacacccagggtcgccagcgagagggtaccgggcggtggttgggtggggtccgctactctaagtgggagcctggggggcgggcgacttccgtgctaaggcctctatgacgagaagcaagccaggcaaaattgtgagaaaagcgcgcctcaggcagaaagtttgaagaccctgagggcggaggatgtggccacagtgtaatggcaaagggggaaagcgatggcggtaaggatgttggtgtaggcaggtgctggattcttaagaggttggagtttattgtcactgggccagtgtaagccatttacagatgactcatggattttttttttttttttaagagactgggtgtgttgctgtattgcccaggctggtgtggaactcctggcctcaagcgatcctcccaccccagcctcccaaagtgctggtgttacaggtgtgagcagccacacccgtcgtcgtggattatt

SEQ ID NO: 12958 - DNA, 1050 bp, Homo sapiens
cccgtgaactctgcaaacagatgaaaggaactctgcacattttaaatgctccttatctgggaaggtgtatttcgcatagaatgaacgtaggagccgctgaggaagggcctccttgcttttccgcgggaactcaagagtgacaaccttccaacttctgggccagaaacacttgctgtctctgttgtttgtgttcctgaagtcataatctactcgcctctgtctttcctgaaaacacagaggccgtgtggcctctgatttcttttcattaaccaagactgacttaaagggtttttaggttgaacgatggctgggcccctgtaggcccttccgtggtggggctgctgcggaccttggtcgagggtcgcggttgcatctgtgggactgtctggacactgttcctcttgcactttcagtttgcagccctgcatgcacacgttctgcgcggcttgctactcgggctggatggagcgctcgtccctgtgtcctacctgccgctgtcccgtggagcggatctgtaaaaaccacatcctcaacaacctcgtggaagcatacctcatccagcatccaggcaagtgagggcatccacaccagcacccgggcacgtgagggcggtccctccaccaccacccaggcacgtgagggcatccacccagcagcacccgggcacgtgagggctgtccctccaccagcacccgggcacgtgagggtggtccctccaccagcacccgggcacgtgagggcatccacaccagcacccaggcacgtgagggcggtccctccaccaccacctgggcacgtgagggcatccacccagcagcacccgggcacgtgagggctgtccctccaccagcacccgggcacgtgagggctgtccctccaccagcacccgggcacgtgagggtggtccctccaccagcacccgggcacgtgagggtggtccctccaccagcacccaggcacgtgagggcatccacaccagcacccgggcacgtgagggtggtccctccaccagcacctgggcaagcgagggtggtccctccaccagcaccc

SEQ ID NO: 12959 - DNA, 1049 bp, Homo sapiens
atgtcccctccccccagcccctggcagctgcgtgtgctttcggcctctggatttttctgttctagacacttcacagacatggaatcatgcgtgctcttttttgttgttgttgagacggagtctcgctctgtcgctcaggctggagtgcagtggtgcgatctcggctcactgcaagctccgcctcccaggttcacgccattctcctgcctcagcctcccgagtagctgggactacaggtgcctgcaaccacgcccagctaatttttttttgttttttgtttgtttgttttgagatggagtctcgctctgtcacccaggctggagtgcggtggcgcgatctcggctcactgcaagctccgcctcccacgccattctcctgggtccacgccattttcctgcctcagcctctgagtagctgggactacaggcacccgtcaccacgcctggctaattttttgtatttttagtagagacggagtttcaccgtgttagccaggatggtctcgatctcctgacctcgtgatctgtccgatcggcctcccaaagtgctaggattacaggcgtgagctgccgcgcccagccgtgactgggctctttcacttagcgtggtgttttcagagttcatccagaagaggatgttatttaaaactagttttgcagatgctgttccttacggcatgactcttacctcttccatggtcattgggaagaaattccatctgggtgcagcgtgacgggaatgttttctgttttcttttagggtttgtcacgtggaggatgtgtacatatggattctctaaattggatcgcgctatacatattatttttttttaattttcttagctattctctattctagattatgttttgaattagcttttccagtttaatagaaaaatctttttgagatttttgatttggggagaattgacagttttacagagcccaggaaaatggtgtttctccttgtttgttaagctcttcctgttcttcagtgaagtctcacggctttcttcgtgtcgtctgggctcattcttagtcctggagtgc

SEQ ID NO: 12960 - DNA, 1060 bp, Homo sapiens
ttgcataaatgcaatcacactacacatactgttgtagcgtcagcttttttctttctttcttttttttttttgagatggagtttcactgtgttgcaggctgaagtgcagtggtacgatctcggctcactgcgacctccgactcccaggttccagccattctcctgccccagcctcccgagtagctggcattgtaggcacacactaccaagcccggctatttttttgtgtttttagtagagacgggatttcaccatgctggccaggctggtctcgaactcctgatctcaggtgatctgcctgcctcagcctcccaaagtgctgggattacaggcgtgagccatcgcgcccggccagcttttttcacttacggtgttttatggagcgcttcacatgtcactgcatctacatccagctcatcttttcattatcttaggatagtttctttgtcacttcccttattggtggacatttattgttttgactttttcttactataaataacactgcagtgactctttcccaaactctgccttcatgtctgttttcttgggatgatttctcggaagggaagtctgtgtcagtgttactcagaatgtgcctattcctttttttctcttttttgagacggagtctcgctctgtggctcaggctgaagtgctgttggtgcgatctcggctcactgcaacctccgccacccgggttcaagcgattctcctgcctcagcctcccgagtagctgggattacaggtgcccgccgccacgcctagctcagatggggtttcacaatgctagccaggctggacttgaactcctggcctcaggtgatccacctgcctcagcctccccaagtgctgggattgcaagtgtgagcccccacacccggccagaatgtgcgtcttttaaatctgctgcaagtggcaggtggtcttctagcagtatgttgagagtgtgctgttctcactgcaggattttttttgtttggtaaagatcaggctctgtgagattctttggtaactgatagtttcagggatagaagactaggaagtaggttttaatagga

SEQ ID NO: 12961 - DNA, 1033 bp, Homo sapiens
gggagataacttgttttggctatgtccccacccaaatctcatcttgaattgcagctcccacaattcccacatattgtgggagggacccagtgggagataactgaatcttgggagtggtttccctgatactgttctcatggtagtgaataagtctcatgagatctggtgatttgacaaggggtttcctttttgcttggtgctctgattctctcttgccaccagcatgtcagaagtgcctttcacccaccatgattatgaggcctccccagccacatggaactgtgagtccattaaacctcttttactttataaattactcagtcttgggtatgtctttatcagcagcgtgaaaatggactaatacagtaagtatatgaaaaatttgatttatacaatgaatacggtgggtttaactgatataggacaccacacaaaatgggatataatctaaagtggcacttactggaaaatgcattaccccaaatgcctctattaggaaaacaggatcaatggaaatgtaagtgttaagcatccaacccaagagattaggaagaatcctagaaaatatccaaataaaagtagcaaaaaggaaataatgaagatgaaaatgagaattaacagataataaatccacatctaaaagcttctttcttgaaaagactagtgaggcagggcgcggtggctaacgcctgtaatcccagtactttgggaggccaaggcagatggatcacgaggtcaggagatcaagaccagcctggccaacatggtgaaaccccgtctctaccaaagatgcaaaaaattagccaggtgtggtggtgtgtgcctgtaatcccagctacttgggaagctgaggcaggggaattgcttgaaccctggaggtggaggttgcagtgagccgagattgtgccgttgcactccagcctgggcgacagggtgagacgctgtctgaaataaataaataaataaagactaatgaaatgcaaaacttccattgctagattagaaatagacccagaatagtcaacacagtatt

SEQ ID NO: 12962 - DNA, 1047 bp, Homo sapiens
tttaaaaagcaaacagtgtaaaaaaagtcatctcccagaagacactactcgttacatattggatgactcattgaggtgaaaaccttattagtgttgtgatagtagagaagcttttagtcaaaagtcagtttattaaatgtttagaatacctaaacaggaagaaaattctattgttttttataacaaagtggaagatttcaagaaaggacaactcactgtacacttgagaataatacctacagaggttcatactgaagagtagtctcaataatgtaaagaatttgacaagcatgatgctattgaaatagttctgtaaggaagtggtgttctttatacatcaattattacaaaaagcagtgaattgtaagtgtgaggtgtgtttacttagatgtgaagagttctccttactgctgtgatggaataacaagggtcagatttcctctcctgccttaaacaactggaagctatacaatacgtataataggtaatggtttttagacataggacaagcacaggtttgtgatcctcaggagactgcagacagagtgaggtgagcaccatggtttctcagcctgcccccgcatggcagttcctaggttgcagttcagggaagggaaacaataaatctcgctgaattgaagagacaggactggcagttggggaggccacagcagctagaatttccaggggaaagtactggagagatgggatccttctagatacagggctcaagaagtctgctgggagtcccctgagtcctttgacttagtactgacttgcactgaggccaggaaaagaagcactggaaagcagcaggctgaacaattcctggaactcatgcagggctgggaatagtttatgttctcagcagccagagtggaaacagagtggaaacacatggagcatcaggtagaattctcagaaaggttttgttttagtagtgcagctaattaactctagattaaaagctactctggacctacagtgtccggcatccaaaaaaactaatgtgttatgcaaagaagcaataaaatatgacttataacc

SEQ ID NO: 12963 - DNA, 1015 bp, Homo sapiens
tgaaaccccgtctctactaaaaatacaaaaattagctgggcatggtggtgggcgcctgtaatcccacctactcaggaggctgaggcaggagaattgcttgaacccaggaggcagaggttgcagtgaaccgagattttgccactgcactccagcctgatgacagagtgagactccatcttaaaaaagataataataagttagtggcctttgggtatctgtgattagtggtctatactgtgccagtctgtggagtctgtggtcaggtgtttctggaggctgttgtggggccactagagttaccgcctggggtctttgttggatggtcactggggaacccatagtgtgtgtctctgaaggccctggaggggcggcctcttggggagagagactgggtggcctgtgaagtcagccattgtggtcctgtgggagtgatgggggcacatggggtgagtgagagtggggttgatggggttcggtggttgtgtggtctggaggtctgtgaagcaggcctattggattcagtgatctggggatgtcttgggatgtggacctggagaattctcaggtggtcactgtgagtgactgggggacttgggatgctggaggttggcaggggcttggagctgcggagttcagtggtttgtgtctggggtgtgtgtgtgatggaggccctctctgggacttggtaatccggggaacttggcagggccgtgttggtgggtctggaagcagatccgaatgtgaatgggtcgtgggttggctcaggcaagcctctcgtgagtgacaggtctttttgccctttggccctctccttgtagcttgtgaccgctgatcagtgatcactctttttacgtgattatttccttttttaaaagttctcagtgaccccgttggccttaaggtcttctccttgtagaatttcccccttgctgtttgtacctcctaggcctcttccatccctcctgatgacctccggctcccccacccaagacctttgcatctgaggtgcctggag

SEQ ID NO: 12964 - DNA, 1012 bp, Homo sapiens
ctgctatagttctccaacatcacatccttgtataaattcttctgagagggatccagtagctgccactccttttgggtgaagtccacagataaatcgtcaaatgagaatgactcctgtaagagcacaatcctggtaaatctgaagcagttaacaccgtatgatgtgagaaaaaaatattggagctttagcacttcattctcataacaagttatacaaaatgcctactatgtctctacctttgcatattttgtgtgataaaatgtcattgtgcattcttccatccttccatttatacaactgttaacctaaagattaaagagagcctctccagaagaaaatgatgtttgtttgggaacagagtactgccatgagaagacaggtgccatagtaaactacatgtgtatccagggaggtaaagaaagacgaaggtgtctacagccagtacggtcataccaccctcaacgcgcccagtctcgtccgttctcggaagctaagcagggtcgggcctggttagtacttagatgggaagaaagacaaaagtttttaaaggaaaaaaatgaggtgcatcacataattgttttgaaacagttatccttggctacaaagatcaataacaagggtgacaccagtccaaagctggacaggcagctgctgggcagatgtcccaataaaagtattttttgtgtaaggcttcaatggcctttgtacgaggctgtggcttttgcagtcttttgtgataatttttatcaggcatgcaagtgtgagaacacttttttcacaggcttcccaagctctacctgtaggggttaaaaaaattaacactagtgactccattttgattctgacaactttcacagaagacacgcaaactggaataggtgactttaaaccccctgaaccaccaataaaatctttactgaacctcaaatttggcactggaagaggtagtagcaaaagaaagaaaataggataggcaaggtggctcacacctataatcccagcactttggagg

SEQ ID NO: 12965 - DNA, 1033 bp, Homo sapiens
ctgtctctaaagaaataagtaattttttttttttttttgagacagagtctcgctctgttgcccaggctggagtgcagtggtgtgatctcggctcactgcaacctccgcctcccgggttcacgccattctcgtgcctcagcctcccgagtagctgggactataggtgcccaccaccacacctggctaatattttgtacttttagtagagacgaggtttcatcatgttagccaggatggtctcaatctcctgaactcatgatctgcccaccttggcctcccatagtgccaggattacaggcgtgagccaccacacccagccaaaaattaaataaattttaaaaatgaaggtcaacagtctaaatacactaacttaagacattgtcagagtgcatcacaaaacaagacccaactatatgttgtgtacaagaaacctagtttaaatatgaagatgcatatagatttagaataagtgagtacagaaaggtataccatactaacacttatcaaaagaaagagacgtagctaaattaatttcagacacagcagacttcagagcaaggttaaagaagagcattgcataatgataaaggagtcaatactccaagaaagaaatcataaaaatccttagtgtgcatgtgcctaacaacaaaccatcaaaatacattaggcagagcctgataaaacagcaaggagaaacagatgaatgcactattacacttggggacttcaacacccctctttcagaactggacagatccagcaggcagaaaatcgttaagaacacagctgaacttaacagcaccatcaatcaactgatatcagtagactacttcattcaacagattacacattcatctccaattcccaagacattcacgaagatagacgcaattcttagtcataacacacatcttaacaaatttcaaagaatagaaatcatataatatgtgctgtcagaccacaatggaatgaaaccagaaatcagtaacagaaagattaaaaggaaaatctcaaaacacatggatattgaaca

SEQ ID NO: 12966 - DNA, 1081 bp, Homo sapiens
aacaatactgcaatcaataatattgtttatatattgtgctttcctatcaactgttctctacacttcccagggtgatccatctaaagtactaacctgatcacataacatttcacgtttaatcttcttctggcctttttctccagttaagataaaatctttttacaagaccttgctcaaactcttgccttttcaggccttatctctggttattccctttatcttcactgtctccctaatttaacctgtcctatttatcctttaggtattgtgtccttcatctgctttaacaatacttgtcacactttcacactgtattgcctgtttgtgtattgtgccctctacactgtaagttttggtaaggtgggaactttgtctaaatttttcattgttttattacttggcccagtgtaggtgttcagttaaatatttacggttcttcagcaaattttgtgccttttcttttacttaccattctagtggaagtttaacttaaaagctatttaagtgattgtaaggtaaaagttgcaaggaggtgggtgcaatggcctgtgcctgtagtcctatctgctctggaggctgacgtgggaggattgcttgagcccaggagtttgagaccagcctgagtaacatgagactccattatagtaaaaatgcatggaattaatttttcttctaggtataggaaaatgttgcaccataacaggtgtgcagaaactaagactgttaggacaacagcagtttaatgttatttatattatgtccctctcctagtccttctcctctcttccctcatcccactcaccaccaccccattcactacacagacttattttttgtagagcaagtgttcatattctgttccattatgtattataatatgaaaagggatgagttgaccaagtattggtgggtgtgtcgtatacttgctttagactaccaatggaagcgtaaattagtacaaacttactgggtgggtgtggtggctcacatctgtaatcccagcactttgagaggctgaggtgagtagattgcttgagcccaggagtttgaaaccagcctaggcaacatggcaaaaccccat

SEQ ID NO: 12967 - DNA, 1035 bp, Homo sapiens
aaaatatatattttgtagagacaggctcttcctacattgctcagactggtctgaaactcctgggctcaagcagtcctcctgcctttgcctcccaaagtgctaggattccaggcatgagttaccatgcctggctcttactgattttttttaaagcactacataaatacagtcaacgcagtcaccatattgtagaaaaacagaagtatatacagttaaatgttttatgttggatgtacacatttgaagaggaacatagaaaaaaagtatggaaaaggaatgttgaccgagcttttatgcttaagcagcagatgaagatagaaccaagatcactgaaagcaagtgtttagaacagcaaaaagagtatcccaacatttcagcattggaactacagaaagttttcagacagaggggaagttaccaattttaaatgctaagtaaagcatgagattttgctgcttgatcttgcagatactgaccagattagttctaacaaaatatggaaggagtggcatacggtggaagaaagaaggcagtagctgctgttgtagttattcatgttagcctcagaggatggtgagacatccagatgaagaggttggtacgcaattctagaattgaggaggtgtctagatagagatataaattgtagtgacatcagtaaagagacaataacaggctttggaaggtgagtaagaatgaaaagggaaggtctgccacctaccctgaagacatacatttaaaggaactatagtagagagataagaggaaaacaagaagagtggagtttcactgaaccaagacaaacaagtttcaaaaaggaaggtgaagttggccaggtgtggtggttcacgcctgtaatcctggcactttgagaggctgaggcaggcggatcacaaggtcagatcgagaccatcctggccaacatggtgaaaccctggttctactaaaatacaaaaattagccgggtgtggtggcacatgcctgtagtcccagctactcaggagctgaggcagaagaatcacttgaacctgggag

SEQ ID NO: 12968 - DNA, 1031 bp, Homo sapiens
tattctaaacatggaatgcacttcacacataatatgtttcctgtacctaacaatttgcatatggcacagaatgcctgtgaatgtaataaagatgaaacgctgtgtcatcaatcatcccttaagaaacaaggacaaactcatactgaaaagaaacatgaatgcaatcaatgtggaaaagccttcaaaaggatttctaatcttactttatacaagaaaagtcacatgggtgagaaacaatatgaatgtaaagaatgtggtaaagtgttcaatgattcctcaaccttaaggagacatgtaagaactcacactggagagaaaccctatgaatgtaatcaatgtggaaaagctttcagtcaaaaaacatcccttaaggctcacatgagaactcacactggagagaaaccttatgaatgtaatcagtgtggaaaatcctttggcacaagctcttaccttatagtgcacaagagaatacacactggagaaaaactctatgaatgcagtgagtgtggaaaagccttcaacacgagctctcaccttaaagttcataagaaaattcataccggagagaatgtttatgaatgcagtgactgtgggaaagttttcagtggggtctcatcccttagaatgcatataagaactcacactggagagaaaccctatgaatgtaaggaatgtaggaaagccttcagtgtttcctcttcccttaggaggcatgtgagaattcacactggagagaaaccctatgaatgtattcaatgtggaaaagccttcagtcagagctcttcacttattatacacaagagaattcatactgagagagaaaccctgtaagtgttatgaatgtggaattgctgttttcattgtcttaaggtggattccaagctccttgtctcagtctttgttctctaaaagaacgatttaaggttacaaatggctctttttttaatataacattttctgtaaatactaattatgactttttttgatccatggctgtttagaattaggtatttttaatatgtgaggtaggt

SEQ ID NO: 12969 - DNA, 1029 bp, Homo sapiens
gtttttggtttgttgttgttgttgttgttttgagacggagttgtcacccaggctggagtgcagaggcgtgatctcggcttactgcaacctccgcctcccgggttctagtgattctcctgcctcagcctcccaagtagctgggattaaaggcacgcaccaccacacctggctaatttttgtatttttagtagagatggggtttcgcaatgttggctaggctggtctcgaactcctggtctcaggtgatctgcctgccttggcctcccaaactgctggggttacaggtgtgagtgaccatgcctggcctgtttgtttgatttttgctctcttaaccttatcatccagcagaggatgaattcttttgtttaaggattgttggatatgataatgtttctaattttttgaggaatctccacactgatttctatagtagttgcaccattttatattcctaccagcagtgcacaaggattccagtttctccacatatttgccacttgttattttctggcttttaattttttatagtggcccatcctaatgagtgtaaggtatttcattgtgattttgatttacatttctctagtgattactgatgttaaaacatcttttcgtatgcttcttggccatttgtacatcttctcaaaagaaatgtcttcgtcttttgctctttttaaaatcaggttatttggtttttgttgttcagtggtaggagttctttgtatcttctggatactaaacccttatcataaatataatttaaatagttccttctagtctgtatgttgcctttaatttgttgattatttcctttgctatacagaaatttttgagtttcgtgtggcctcatttgtctgtttttgcttttgttgcctatgcttttggtatcatagccaagaaaccattgccaaatccaatgtcatgaagatttccccgttttcttccaggagttttagagttttccatctttcatttagatcttttattttttgagtcagagtttcactcttgttgccctggctgaagtgc

SEQ ID NO: 12970 - DNA, 1031 bp, Homo sapiens
atccaatttgccagtctgtgtcttttaattggagcatttagcccatttacatttaaggttaatattgttatgtgtgaatttgatcctgtcattatgatgttagctggttattttgctcgttagttgatgcagtttcttcccagtctcgatggtctttacaatttggcatgtttttgcagtggctggtaccggttgttcctttccatgtttagtgcttccttcaggagctcttgtagagcaggcctggtggtgagaaaatctctcagcatttgcttgtctgtaaaggattttatttctccttcacttctgaagcttagtttggctggacgtgaaattctgggttgaaaattattttctttaagaatgttgaatattggcccccactctcttctggcttgtagaatttctgccgagagatcagctgttagtctgatgggcttccctttgtgggtaacctgacctttctctctggctgcccttaacattttctccttcatttcaccttcggtgaatctgagaattatgtgtgttggagttgctcttcttgaggattatctttgtggcattctctgtatttcctgaatctgaatgttggcttgccttgctagactggggaagttctcctggataatatcctgcagagtgttttccaacttggttccattctccccgtcactttcaggtacaccaatgagacgtagatttggtcttttcacatagtcccatatttcttggaggctttgtttgtttctttttattcttttttctctaaacttctcttctctcttcatttcattcatttgatcttccatcactgataccctttcttgcagttgatcgaatcagctactgaggcttgtgcgttcgtcacgtagttctcgtgccttggttttcagctccatcaggtcctttaaggacttctctgcattggttattctagttagccattcgtctaatcttttttcaaggtttttaacttctttgctatgggtttgaacttcctcctttagctcggagtagtttgatcgtct

SEQ ID NO: 12971 - DNA, 1050 bp, Homo sapiens
ctgcacccagtgtcccgcacccactgtcctgcacccactgtccgacagtccccagtgagatgcacccagtacctcagttggaaatgcagaaatcattcgtcttctgcattgctcatgctgggagctgcagactggagctgttcgtattcggccatcttggctccacctcagtcacttttcttttgttgctttcaaaattctctttgcaattttgacaatatgtgattatagtatgactctatataggttttgctgagattatttttattggagtttgttgagcttcttgaatttgtatggcaatttctttcctcaaatttgggaaatttggggtctgatatgggttggctgtgtctcacccaaatctcatcttgaattgtaactctcacaattcccatgtgttgtgggaggaacctggtggaggtgattgaattataagggtgggtctttcctgtgatgttctcatgatggtgagtgagtctcatgagatctgatggtttttaaaaaaacgggagttttcctgcacaagctctcttctcttgtctgctacaatgtgagatgcgcctttcacctttcgccatgattgtgaggtctccccagccacatggaactgtaagtccaatatatctctttcttttgtaaactgcccagcctcaggtatgtctttatcagcagcatgaaaacagactaatacagggtcattatttcttcaagtaggatctcaatgctgtctctcttctatgtttgggatatccgtagtccatatgttgtttcattcgatgttgtcccataagctccttaagttcccttcatttttcttcatttttttccctctgactcaataatttcaaatgaactgttttcaaagttactgactctttcttctctttgatcaagtatgaaccctccagtcaatttttccattcagttattatattcttcagctccagaattttcatttggttcttttctatagtttctgtctctttgttgataccctcattttgtacatgcattgttttcctgattttgttttgtggtgtatgttct

SEQ ID NO: 12972 - DNA, 1031 bp, Homo sapiens
ggcatttaaaccgctgtttccatcagcactccaagtcaggagagatagaaatctgctccttgggcgaactgtcaaaaggcctgcgcattggactcatggttggttcccttctctttttctctcttgagggagaagaggattggaaattttcttccaattataccacagtgtgctagggataataggtagggtgacaaataatctctccttggccacactttagtcagattcctctgaaccctctacttaaccaggacttgacctttgagctcctgtattcatctttgcatcacaaaactatttcttgcagttttagcaagaatcctccactcttgacatctaatcaaattcatcatcctccaccatcctccagatgacattcgatcatcctggtctgccttcagcaagaatcctgtcaaatcagttttaccagaatgtcacccttcccttgacgttgcctcttagtaattttccatccaatgcccgcctctacccccaccccaccaccaccctgcactctgctctttgactgtaaatccccacttgtcttgctgtaactatgacaattgtccttgctgttctctaccagtggcaagtaaaatgccacaccgtttcctacctgtttcattgcatctcttggctttgtgcacctttgggtgctgcaaactctcaactggtttttggagttctcaggcaattttgtccatatgatgttgttaagttgatgtctctatgggagaatgagggtctggggtttcctattctccatcttgcttatatcactcagcacactgttacttcataagtacatcaaaactggacttttttgttttgtttttttggagatggagtctcactctgttgcccaggctggagtggagtgatgcgatctcggctcacggcaacctccacctcttgggttcaagcaattctcctgcctcagcctcccaagtagctggtattacaggcgcacgccatcatgcctgggtaatttttgtatttttagtagaaacggggtttcaccatgttag

SEQ ID NO: 12973 - DNA, 1047 bp, Homo sapiens
aaaagcagtcttttttttttttttttttaaacagggtcttactctgtctcccagcctggagtgcagtggtgtgtgatcacagttcactgcaaccatgacctcctgggctctaacaatcctcccacctcagcctacctagtagctgggactataggcatgcagcatggtgcctggttaatttttttaacttttgctgacatgatgtctcactatgttatgttgcctaggctggtctcaaactcctgacctcaagcaatcttcccacttcggcctttaaaatcacgctgggattacaggcgtgagccaccatgcctggtttataacaatctcttaattggctttcctgactttaactccttcaatttaatctccatagtgtaggtagagcaattctaaaatgcatatgtggccctgtcattctgccacttaaaacctttcagtgtctctctactgtcttagaaataaattctagcctcttttacaaaggttacacagctatttattgtttacaatcccctgctcacccctccagactcacaaaacaaatagttatttggtccaaaatgtcaataatgtgtgtcagggttgagaaatctagtcctagaggatgggctccagaaaatgaaggagtcagccatgaaagaggaagaaacggaacccccacaataagagatccaacaggagaaggaagcaaaagaaatccccaggatttatacattataaattaagagcagtgaccaacaccaagttattcctgctgctgttggacatctccaactttgaaggcttccacattagcctggtgcttatctttccttctttcattttcctaatggttaggctattcctgtgcccactgtcagtggtgacggggcagcctgagaatcatattctgggatttctgtcagctttagccttggagctggtccagagaggaacaaacttcagatgctctgaaagtcttaatatgggccaggcatggtggctcacacctgtaatctcagcactttgggagtccaaggcaggcacactgcttgagcccaggcg

SEQ ID NO: 12974 - DNA, 1940 bp, Homo sapiens
aattctactaataagaatttcacttctagaaatttatcttacagaaatatagacacacacacatgcactatatatatcacagtttatacgtagcaccatatattatatatgtagcagttgtaaaacaatatgcaatagagcccattttaaagattatgttcacatggggtcaggcacagtggctcacgcctgtaatctcagcactttgagaggccgagacaggtgggtcacttgaggtcaggagtttcagaccagcctgggcaacatggcaaaacctcatctctacaaaaatacaaaaattagccaggcgtagtggcctgtgcctgtagtcccagctacccaggagactgaggtgggaggatcacttgagcccaggagttcaaggttgtactgagctatgaccataccactgcactccagcccgaatgaccaaaaaaaaaaaaaaaaagattatgtgtgtgttggtgcttctatgtgtataggctaaaaatttgtgatgtcatattacaaattggttatctttgatgaatgggaactttatttctaaaatatatatggtgtatatatgtatatagtattttagtgtgtatatatatatgtatatatatatacacactaaaatagtatatactgaaatggcatatatatatattagagacagggtcttgctctgttgcctaggctggagtgtagcagcaggatcatagctcattgcaccatgaaactcctggctttaaacattcctcccaccctggcctctcgaagtgttggaattggtgtgagccatggtgcccaacattttttttttagagacaggatctgatatggttagcctttgtgtcctcaccgaaaatctcatcttgaattgtattcctcataatccccacgtgtcaagggaagagtcaggtggaggtaattgaatcctgggggcagtttcccccatgctgttctcatgatagtgagtgaattctcacgagatctgatggttttataaggggctctcccctgcttcgctcgtctcttcttcctgctgccttgagaaggtgcctgacttcctctttgccttccaccatgattgtaagtttcctgttgggaacaggccccccgacatctggccataaactggccctaaaactggccataaacaaaatctctgcagcactgtgacatgttcatgatggtcataacgtccacgctggaaggttgtgggtttactggaatgagggcaaggaacacctggcccacccagggtggaaaaccgcttaaagccattcttaaaccacaaacaataccatgagcgatctgtgccttaaggacatgctcctgctgcagataactagcccaaccgatcccattatttcggcccatcccttcgtttcccataagggatacttttagttaatctaatatctatagaaacaatgctaatgactggcttactcttaataaataacgtgggtaaatctctgttcgggggtctcagctctgaaggctgtgagacccctgatttcccacttcacacctctatatttctgtgtgtgtgtccttaattcctctagcgccgctgggctagggtctccctgactgagctggtcttggcaagtggcatccatcttggggccacaaatacaggttgaagggttgccagagcgatggttggagaacgtggaactagctggaggacacccgagtactcttaaagcaatccccggggtgagtaagaaggggagctcagaagcatcagggtaacaatgggacaagtgtgggctgtggttcattccaccttttggaactttttcacactgatggggaggaggaaggagagtataacaaagtaacagaagaggttacagagcaggtttatttgccagctaaagctaaagcagcaaaggagggagaggttcatccctacccttctgcactccctccttattattttg

SEQ ID NO: 12975 - DNA, 2025 bp, Homo sapiens
tgccgtaagtattccttcaacaagagctgacacagagaacaattattcttattgggcatatttatcaatcttggctggcaataatgcctggatgtaatcactctatcacacagttacacatgctttctgatctcagtatttaccataataaatctgctcctataattgaggcataccgccctcaaaaacctatttgtacacaggattggacccagttagacaaaatgaacatacttgtttaggaagattgcattgcagaacaggcagaggtgctgcacaacgattcctatggaatcattattaattggtcccctaaggggatgtttagcttgaattgcacctctcagtctgtgtgccactgctacactatgtttagatgatctgaacaaaatggtcagatggtagaaatgataaaaagtacggcaagagttcctcttatctgaaaccatggcggtatagtggcacctcaacctcagatgatatggcccgttgtaggagctaaacataagataaggatttgtggcttaataagatcaaaaatttgggaaagaataaaaaagcatctagaaagacactctacaaatttgtctttagatattgcaaaattaaaagaacaaatatttaaagcatcccaggcacacctgaccttaatgccaggaactggagtgcttgaaggagctgcagacagattagcagctagtaacccattaaaatggataaaaacacttggaagctctgtgatttcaatgatgattgtgcttttaatttgtgttgtttgtatagtctgcagatgcggatcctgactcccgcgagaagtagctcaccatgacaaagctgccttggcttttattgctttgcaaatcaaagaaggggaacatgttgggaacagcacccccccccccaaaatctggccataaactggccccaaaactggccataaacaaaatctctgcagcattgtgacatgttcatgatggccatgacacccacgctggaaggttgtgggtttactggaatgagggcaaggaacacctggcccacccagagcggaaaaccgcttaaaggcattcttaaaccacaaacaatagcatgagcgatctgtgccttaaggacatgctcctgctgcagataactagccaaacccatccctttatttcggcccatcccttcatttcccataagggatacttttagttaatctaatatctatagaaacaatgctaatgtctggcttgctgttaataaatacgtgggtaaatctctgttcggggctctcagctctgaaggctgtgagacccctgatttcccacttcacacctctatatttctgtgtgtgtgtctttaattcctctagcgccactgggttagggtttcgccagccaagctggtcttgccatttcctgaggcctccccagccaagctgaactgtgagtcagttaaacctctttcttttataaattacccagtctctggcagttcttcatagcagtatgaaaacggactaatacaggatctcactctgtgtcacccaggctggagtgcagtggtgctcaggcaagccacagtccttttgcctcagcctcccaaatagctgggactacaggtgcgtgccaccatgcccagctagttttttttttttttttttatctttgtagagatggtttctcactatattgcccaggctggtcttgaacccttggcctcaacatctcaggtgatcctccacctcagcctcccaaagcactcactggaattacaggtatgagtcaccatgcctgacagacagacagacatatatatatatgtgtgtgtgttttttttgagacgaggtcacactctgtcacccaggttggagtgcagaggcacaatctcaggtcactgcaacctttgcctcccaggctcaagggatcctcccacctcagcctccctagtagctggggccactggcatgagccaccacgcccagccaattttttgtatttttggaagagacagagttttgccatgttgcccagcctggtcacg

SEQ ID NO: 12976 - DNA, 1033 bp, Homo sapiens
cagtccttatggtgatgtttgtccagtcatttttggttatctgaagttcatgctttagtaccggacgtctcaaagtgtggactccggcaggagcatcagtccccagcagaggtgcatgcaagagtttgcaacccacctctgtggtaggaaggctcttgagaacaatattcactgacttcttttgtttcctaacagtgtgttggcagcctttctatctgaatgccagttgcagattccttagtgcacattttcttttctcaggtgtcttactgtgttaatccattgttatctggcacaaaacattgctcttgatgaccagttgagtttatttgtcttgtaagtgacttggggtctttttgcctgatgctccaaagtttttgtttgttttctcttctgttttatagacatgtctttttggtatgcttttattgcttttaggatagtcaacctggctaattaaaaaaaaatttttttttagatcttttgtttctgtcttctctggcctacttggtttggaatctaatcctagcagtttttcctccttgtggggcttggtcctggaagtcctgaggagagcttcactggtcccttttgcagggcctgggaggggtcagccacctctccccttctccgccttgcccagtgcacagcaggccccaccccacagctgctctctcaggcagcagcagcctgggcttttccagattgttgccttcgcttcccctgagtgaccatccacaccacatgggccttaccactgttttagttttggtaaggcctgtgtggtagggacttgggacttactaaaaccaaaagctgtctgtggggagttttgttttgctgtcctagttgccttgttttttatgaggtgattcagggagattggaaaggttaagccagtgccaccatattcccacttgttaaccttggtggtgtccatttcttaggcagtgcagggaagacatttttaaagtatatctggccaggcgccgtggctcacccctgtaatcctagcactttgggaggccgagag

SEQ ID NO: 12977 - DNA, 1033 bp, Homo sapiens
tcctcctttgctattttacaatgacagcttacctatttatctttatgccttcagagtaccatggcttctaaatgtggatcgttcatattacttcccaaagaaaattggggattttatcaattaaaagaccccattatacaatgacttgtgttaaaagtgtacataaagctttggttaagacaccacaaatttcataaacaacattgtgggttttttatacttcagacaaatgtatgttaacaaggctattgtgtgttccagatggcaggcagcagattctgagtttgggcatggacctgcagttggaatggatgaagttggaagatttccaaaagcaccttgatgggaaagatgagaattttgctgcaacagatgcaattccaagtagtgagtagttttggaaatattgaaatccctttcacaaatctagatttataaaatctaacttattttttctttcattttagatgtgttaagggatgctgtgaaaaatggggattatattactgtaaaagttgcacttaattcaaatgaagaatataacctggaccaagaggtaatatgtcgttgaaaaatctcatgaaaggaaaatggaaagtaacacttgaaagaattcagtttaacttttcatttattttaattacaaaaggctgggcgtggtggtgcacacctgtaatcccagcactttgggaggccgaggcaggaggattgcttgagcccaggaattcaagaccagcctgggctccatggtgaaaccccaactctacaaaaaatacaaaaattagctggacatggtggtgtacacctttggtcccagttacttgggtggctgaggtgacaggatcacctgagcctgggaggtcaaggctgtggtaagtggagatcacaccactgcaccccagcctgggcaacagagcaagactcccatctcaaaaaaaaaaaaaataatgcacgttcactttgtaaaataaaaaaattgtagaaccctataaatgtacaattatagtccctttaattccaaccccctcccctc

SEQ ID NO: 12978 - DNA, 1027 bp, Homo sapiens
ggccccaaatatgtattttgcgctgttttgccccacttacgcaggagggggctgttgtgcgcatggtgggggtaataatagaaggaccgaacctccttgacctcttattcccttctctgcctccttctggcagaaagggttgggttctcccaccaggttgtgtgtttttgatacatttttcttttttcctcctatcccaggaccaagaatcgccttcagccctgtctggtgcatccttggcagaaagtgaggaggaaaacacccccattgtgagtcctttgcccctaatttgttgctaatagaggacattgtcaggttgtaggggttaagctatgggacctggccctccccgttgttttgagggggaggagctttcccttgggtggcagctgcccccagggcgaagcctgggtaatggctggtgaggcagctgggagtgggcgctgctgtttccaccgctgcagacatcgctcctgctgctgcaataccaacctcagcaaccagacgacgggcttctgcagctgctcacgttacccgggaggaggggtggtgcgaaggagggcatatttctggtgccctctagagttccaaaatgggaattaaagttatttcttgttgaatgctgtgcatgcaacctgaacattttttcttccttaaacaatggctaattgattgaaggaattggaaacatagaaataatcatttatatttttgtttatgtctgctggaaacacatattttgacacttatggctcatgagttgctagatctttttcatgtatttgcttaggaaagggagtcaactcctctagtactatcttgttcaccaagtagtatgctgatcagtccagtgtactgatctagttaatttcttcgttccccatcttccatgttgatcatctttaacttaacgatcatttttgaatgtgttaccagagaattatttaatttgttggttttaaggcaactatgtaatgtgctagagaggaagatgaagatagccagtcatattttccttcaggcaatt

SEQ ID NO: 12979 - DNA, 1051 bp, Homo sapiens
ctagtgaatttcaaggtcagattagtttttgtgaatttataagttagtctaaagagtttttaaaaatttatccataaaaatgtttttttatattacaagttaatgttaaattgtaatcaggataaatttgctaggaatataactaattgttgcaacttcatatgcaaatgttgggaaagatctgttaaaactcttgcattaaacttatttgtctctaaccatgcatttaggttggataagaaaaatacttaagttagtgggtgcagcgcaccagcatggcacatgtatacatatgtaactaacctgcacaatgtgcacatgtaccctaaaacttaaagtataataaaaaaaaaaaaagaaaaatacttacatagctattctaagtaacattgggatgcacagttagaagttgcagacagaataatgtttgtaaaatgtgactataatacagtgagacaaattctttttactttatagccatacatgtgtatattactctctgccgtagtcacctggataccatctctggacttactagtgtaagaattgacaactaaatttttgggttttgttacttaacattaaaaaatgacttctcttctaatactggaacagttttataatcattcatttcaaagaggtatgtctttttcctaggaagaatagtgtttcttggaatatcaagttggactagacagagtgttcagggtaataatcaggggactgatttaacaaattggatattacaacacctgttatatattagatagtcataaaatatgtgttctgttaattatgggctagcagtttctttggctctgcttggaagagcatttcatctagacttagtgaattgtgtttctagttctatagaactaaggaaaggtttgggtggaagtgaaaatataagttaaatgaaaattttattttatcctcctgtttagatttgtactttttttcgttccaggcttgtcatatcttattttaatcattttaattatttctggccctgatatggtatctgaattcttttttttttttttttttttga

SEQ ID NO: 12980 - DNA, 1146 bp, Homo sapiens
tgggattatggtcgtgagccaccgcgcccagcctgcttgtttttttacctaaagaaaaatttgcacttgttttaattagttataggaaaatcatgattataaaatttaacaagttttagctttataactttactatgaatattgtctcactttattttgatttttgtctgtcttattattgtatagtcctgtttcttagccaaataagtgttaactcctgcctaggaagtcattccatcctatgtctctgtacggttttacattgcttatggaagagaagcttctgttccagttagtctctcttccatgacacagactcctgacttctgttatttcatgttttctttatttgtatatcacattttcctttttcaaggaccttactcttctgttttcattcagtcttcctcctggacttacctgttcatttgtctttccttttcctaactccttttgctttttttaaaaaaagagcacagtatctgtaatagcatcctatataaaagtctgattatactgtccttttagggggtatgtttccaaattacagtaaactcgtgaatttggtgagatcatgatatgtgagtatggttctagagatatatgagggcctcacatggaaagggaactagtgagtactaagagaagattggaagggtaacgacttaattttgcagattttctgccaaaaaaagccatttttctcattgtagcatgacatgagttggagtcatacagattcaggcttaaatctgccctgctcatgaagggagttttggggtgatagagtgttatataaaactggattgtggtgattgttgcagaagtatatacatttaatacatttatcaaatctttcacttaaaataagtaaattttactacacgtacattatgctttaatataactattaaaaacaattttgctccagtatttaccagtttgcgatatcaggcaagtcatgtaacatctgagctgtagttcagtcagttaacaaatgagtatggtaatgcctggtttcctgagattgttgaggtgaggactaaaaataatacagggtatgcagctggccaatagtaggtgctcagttaatagcagctgcaattcttaaactgtctgtttatatggaccaaacataatgaattt

SEQ ID NO: 12981 - DNA, 1279 bp, Homo sapiens
attgtacagagtaatttactcaactgcaaagtggggtcgtaatatagtataaggtcttttcaaggaacttgtgatgagagtgctgtcaagcatgtttttcataattggtagttattgtgttagatgtatgatgaaattcagaggcaaaagtataactcaagatatgaaggaagggattgaataaaagagatcagcaaaataagacttactgaggactgctttctttagttaagatttattgagggttgccttctttgcttcaggctcactttatttactagataatttaaaaaataaaaagctattgaattgtaagtgataagattttttattttctgaaatttgtctaataaggaaattctgatactctatgctctgtattcctttgactttttttttttcttttttaaagcaatctgaaacatttgaacatctcaagaaaaaaatgctggttaaaaaagagttttgagtcttatgaaacagaggcaagagatttttacttagtaatagtctgtattagagaaatagattcttagtacctgaagtctaccttattggatctctggtctcatttgcttattgatgcaagtattgttgtttctttaggttagatgaggtcttaatcatggaacatttgaagtcacgtaaagaaggtaatgtttttttaaaagccctctactccatctgtttaaacattatggaaaatttgttatcaaaaacagtcattacactagatcatagatttggaacaccaacaagtggtcataagaataaatgaatgtttgatgatttgtttccaaattaacgtgtgtagttgaagtttatttatgctgttgtagtttttaaactatgtttggagaaggaagtatgggtttatttaccttctttggtaaaggggatcacagggatagggtatgataacctttcattagggactaaaatcaggtcatgttactaactgtaattacgcagatgaatatagaagtaaaaaaaattaggaccaaagacaaaggatagagataaattatattttagcttgtttcatcttttgaggaagttattctaattttccatttttaacagggaaatgggcttgggggtgaagtgattgtcctatgcacacaagaagagagagagccagaattcagtgtgggtcagggaggagtgaaaaaaccccaaaccaaaaaaaaaaaaaaaaaaaaaagggcatcctctcagaaaggttatttgttaaagaaaaatattcattcagtaaatatttattggccaggcttttatt

SEQ ID NO: 12982 - DNA, 1020 bp, Homo sapiens
cagtttatgtttcttgtttgtaggcactggagtttctcttccattatctgtgtggtgaggtactgacctgacaaaaatttccttaaatgtctgcagagaaaagagaaaatggtcatgtctcagtaaatctgtgatagatgctacagggaaagctgctcctgcccagaaggctgaaaccaaggaagtgtctgctccagaccagcccaaacacacaatcccaaattttggtaaaagttcctatcagccctgtgtacagccagctgtgccaagaacatagtatgctattcccaaagctgagttgggatgaggaatgagggatagtggctggtttgtactattcacttatgaatgatcaccagcgtctccctggattgctcctgtatttgttttaggtgtacagtcaggttctagagatccaaagtagttggtttcaatcattttttcccactcaatggttgcttgggtggaagtacttatacctagaacttcttgccacaccatttcgcctaaagtctctgtcttcatctgtattttttcttttttaaaaatttgttatttcatctgttttttttatgtcagatttacaaggatcttgtaactttaaaattataaaaataaatgttcggtattcttgtaatttatttttacattaaattttttattaaataatttttaaatttaagactttatcttgtattaacgtttatgtatgatgaggggtaggtggctccccaaatttttatttttatgttggaatttctttcggtgtgagacaagaattcaaagtaatatttctcagttgcttcccagttgttttatactacttttctgaaaaatttatataccctattgaaatttcattgtatactaaattccttgatatattgggtctgtttcagactttttttgtctgtttggtccgtcttttcttattccctacctcactgttttatttattgtagcttcataatatgccagtttcttctgttactcatctctttttagaattttcctgttctt

SEQ ID NO: 12983 - DNA, 1055 bp, Homo sapiens
atgagatgttctgatacaggcatgcattgtgtgataatcacatcatggagaatggaatatcccttcaactatttatcctttgtgttgcaaataatccagttatactcttattttaaaatgtacaattagattattattgactatagtcaccctgttgtgctatcaaataataggtcttattctgtttttctgtgcccattaacccccacctcgccactacccttctcagcctttgctaagcatccttctactctatctccatgagtgttctgtaacttttaaaagtcatcagtataccttgtagattttttttcatgtcagtaagagatcttgcttttaaaataccctaatctgttcactttttctcatctcccatcaccaccctttttcagccactgtcatctctcacttggaccatttcaatggccatctagtttgtttctttgcttccagtttttccctcttgttcccacatagcagccacagtgatctatttaaaacctgagattgtatcacctctttgctggaaacatggcagtgtttcctgttccagtaaaatccaaactttcacctttagttagaattaatgctttctaagcttaggcagggctgtttacctgttttgattactgatttttgccatgtgcctagaaagtatcttgtgcatactaggtgctctgtaaatctgttaaatgtaattaatgaattagctagttggccttgatgtgttattctctgcctgtttatctcattttatcctcctctttgcttcttactttgatctgccacattggctttattctgctgcttggattggccaacttcattccctctaggctttgcagaagctgttttctttgcctggaatatcctgtccccagttttctcacagctgaatcttatcatttcgtatttcagtgtaaatgtcacttgcttaaagagatgttctctgatcaccaaactagttatctcttcaccttctgttattctgtttaaaagtttttaaatttagtttaaaaaaaagtgataaatcacgtggcccaaaattaagaaaa

SEQ ID NO: 12984 - DNA, 1513 bp, Homo sapiens
ttatatgatacagtgaataaatgggataagtgtataatgaagtaattattttttgtcagattttgattttttttttttcctgttcagatgtgtgggaggatttatccatatttttagtgataaattttatggagtaaatagtgtacccctgaaaggaggtggtggtggtggtaggaatatattgcatatgattaccatgaatatattgcatatgattaattatccaataaaaattggataattgccttccttgttatcctgcaaaagttaacatgtaaactatatgaaatgattaatgaatggatatcacatattttcctgaatgttagacaagaatcacttcatttagaataaaaataaaataaaagtaccctttaaatcaatggtttcagttagagtaacataaaaagtcatactgacattttaattcttttttctatcttcctaacaggttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgaagaactacaaggaaatgattccaaaattactccttcctcaaaagagttggcatctcagaagggaagtgtaagtgagacaattgtcattgatgatgaagaggacatggaaacaaatcaagggcaagagaaaaattcctccaattttattgaacgaagacctcctgagactaaaaacagaaccaatgatgtggatttctccacttccagtttttcaagaagtaaggtaaatgcaggaatgggtaatagtggtatcaccacagaaccagactctgaaattcagattgctaatgttacaactttagaaacaggtgtaagctctgtgaatgatggccaattagaaaatactgacgggcgagatatgaacttaatgattacacatgtaacatcactgcagaataccaacttgggagatgtctctaacggactgcagtcaagtaattttggtgttaatatacaaacatacaccccatctttaacttcacagaccaagactggagtaggaccttttaatcctggtagaatgaatgtggcaggagacgtttttcagaatggagaatctgcaactcatcataatcctggtaagcagtaagagatactctacttcatgtaaatgaatttaaacttttggctgctgcttttttcattgtagtaactggtattaccttgtttagtttcatcatgtgaaatatgtgaattatattgaattttatcttaagtttggtattttaataagaattgtaaaaccatgtatagtatttttctgtggattactaaaaagttaat

SEQ ID NO: 12985 - DNA, 1027 bp, Homo sapiens
tctggagtgcagtggtttgaacttggctcactgcagcctctgcctcacaggctcaagagatcctcccatctcagcctcccgagtatctaggaccataagaatgtgccaccatgcctggttaatttttaaaaaatattttttgtggagacagggtttcgctatgttgcccaggctgctctcaaactgctcaagcaatccacctgcttcagacccccaaagtgctgggattacaagtgtgagccaccgtgcccagccacaaaacagccttattgctgatgtggagaaagtttaagtggtctggatagaagatcaaaccaactatgacatttccttaagccaaagcttaatccagagttaggcgctaactctttttcagttttatgagaactgagagagataaggaaacaaaagaaaagtttgaagctagtaaaggttggttcatgaggtttaaggaaataagtcatctccataacataaacgtgcaaggtgaagctgcaagtgctgacgtagaagttgtagcaagttctccagaagatctaagataattgatgtaggtggcaacatgaaacaacggattttcagtgtagacaaaacaactgatggctctcttgttagaggttaatatacttagtgactgtaagttgaagccagtgctcatttaccattctgaaaattgtagggtccttaagaatgatgataaatgtactctgcctgtgctttatcagtggaacaacaaagccccgatgacagcatgtgtgtttacagcatggtttactgaatagtttaaactagtgttgagaccttttgttcagcagaaatgattccttttaaactattactgcccagtacacctggtcatccaagagctctgatggagatgtacaaggagatgagtgttgttttcatacctgctaccacaatattcattctgtagcctgtggatcaaggagtaattttgacttttaagtcttactatttaagaaatacattttgtaaggctataactgccatagatagtgattcctct

SEQ ID NO: 12986 - DNA, 1044 bp, Homo sapiens
aatagtgggtgaggttatttggggatggggtgtgtgggtatatttaagttcagttatccctctagaacgtataccatattccccataacccagatacctcttactttctacttatccaggggagggaattgaacaggttatacctcagtaaattaatccttaacattaattccatataactaataacagcttttctttttttagttttcccaatatttgaaatcctttttagtgaatttaaagataaattgagtagcggcaaagatttaatagtataaaatatttttgcttctcaaaagtctttatttccaaacatattttattaggaatgtctaataaaaatgatttattagatccaagaatgatgtttgatttgcaggacttagtctatagaaatgaaaaatgtcacttatgactcttatatttgatttcttttaaaatggaattttaatatgtaccacttatttttcagagatataactacaatgaaaggaaccattgttgctcaagtggattcaagtgagtccttccaggaattctgtagtacatcttgtttatctctctatgaagacaaacagaatcctactaaaggagctctaaataaatcaagatgtacaatctgtggtaaactaactgaggtttgtattttttttctttatcatttaattctaacaaataggaatattttaaacttcatttaagaactattagataatcttttatcagttccttaaaaatgaatatatataaagactatcttataaatatcctattatgtaatctgattctcccataggatcttatcttataaatatccttttatataatctgattctcccagaggatgatttcggaaaaatcattgtgttaattgccttgtttttccctgaggttgggaacactcacagacaaaaccatagtgttgaggttgatttttgtctagtaatatatttatttaaacaagcaggcagactacacaagaaatactacaaataattttgctgagaagtagaacgattggaatattttttgataacctcacat

SEQ ID NO: 12987 - DNA, 1107 bp, Homo sapiens
ctcgaactcctgaccccaggtgatccacctgcctcagcctcccaaagtggtgggattacaggcgtgaaccactgcacccgtccaggttaatgttattttaaggactttttgatttctagttttattccattgctcattggaaaggtagtctgtgtgatttcaatcttcataaatttatttattaaatgttttatcagaaattattattgctttaaagatctttttgttgtctgtggagaaggttatatgaactttctccctctttagttttttttttttttttttaaagacaagtttcgctctgttgcccaggctggagtgcattggcgtaattttggctcactgcaacttccacctcctgggttcaagtgattctcctgcctcagcctcctgagtagctgggattacaggcgtgcaccaccacgctgagctaatttttgtgtttttactagagatggggattcaccatgttggccaggctggtctcacactcctgagctcaagtggtctccgtgcctcggcctcccaaagtgctgggattacaggcatgagctaccacacctggccttagatttattaaggtgtgagttatatagtagtcctttctcacgcaaagttttgttttttgtggtttcaattactcacagtcagctgcagtttccaaataggtgagcagactacaataagataatttcagaaagtaattaattataggtgagtagactacaattaagataatttgagagagattaattataactaactataattgttgttgttttttgttttgttttgagacagggtcttgctctgttgcccaagctggagtgcagtggtgcaatctcagctcactgcagtctacttttcctgggttcaaatgattctccttgcttcagcctcctgagtggctgggattacaggcacatgccaccatgcccgactaatttttgtatttttggtagcgattgggtttcaccatgttgtccatgctggtctcaaactcctgacctcaagtgatttgcccacctcggccttccaaagtgctgggattacaggcgtgagccatcattcccgcccaattgttgttaatctcttgctgtggctaat

SEQ ID NO: 12988 - DNA, 1035 bp, Homo sapiens
ttgtctttttgcatctgggttattttacctgaaagctgaaacataatgctttcagtttcatccatagtatagccacgatcagaacatcattactttttatggctgaatagtattcattatatgtatatgccacattctgtttatcgatttgttgtccctatgatagatgttgctttgttgccacctttgactattgtgaataatgctgcagtgaatattggtgtataaatttgatataagtatcctggttttccattcttttggatgagtgtggatttgctcagtcatagggtaattctgtgttttaccttttgaagaattgtcaaactattttacacaaccgtaccattttatgttctcagcagcaatgtacaaggcttctgttttctctatatctttgccaacacttgttattttccatgttttaagcttttgatttttcttgtagatatcttagtgcatgtgcggtggtatctcatggttttgatttgcatttccctaatgactaatgacaatgaacaatttttctttgttgttgttgttttttttatttttgagacagagtctcgctctgttacccaggttggagtgcaggtgcacaatcttggctcactgcaacctctgcttcctgggctcaagggattcttctgtctcagcctcccgagtagctgggaccacaggcacgggccactacgcctgtctaattttttgtatttttttggagacatagggtttcattcgccatgttgttcaggcctggtctcgaactcctaagctcaagccatctgcctgccttggccttccaaagtgctaggattacagtgtgagccaccgtacctggccagtgagcaatttttcatttgcttgttggccatttgtgtatcatctttggagaagtatctattcaagtcctgtctctgtttttgaattgggttttgtagttcagttcttttttctctttttgttttttgtttgtctgtttgtttgtttgtttgtttttgagatggagtctccctctgttgcccaggctggagt

SEQ ID NO: 12989 - DNA, 1026 bp, Homo sapiens
ctaggcctcaagctttggcagccacaggactcacttgatttgtttcccttttgttaggtatacagttctgtgctaccttgtgtgtagagtttgaaaaccattgtttttttgtgtgtgtgtctaattttctagttgttaaaggtgggtgggaggtttaaatctaatttctgttagttgggagtggaagttacctctgctttaatctaaatagttccctagtttttgtttgtcttttatgacttgacattttgaataccactttggagagcatccctcaattcgtgtttgtttgatagttcctcaagattagattgaggtaatgcatttttggcatgaatacctcataagcggtgttgtgtccctcttcgtgcacatcaggaagcacatgatgtctatgttttccattattgtgtgttaacttgtttaaggggatgtctgtcaggtttctccagggtaaagttgctatttttccctctgtatctgtttaagttaagcaaacttttcacccactatttttagcatctgttgtcaattagaaaaaaatccttaaattacaaagttagaataagtctgctaaaagaaaaattgtaaattaaacagtaatagagaaaagtaaaacatgatggtatatacatttttaaaccgttttttctctgcacagacaaatcttgcaatatgaagagatgatttccaggttttattgaataaatgaattgtaatttttacttgaaattatcttatttagtataataaatattacaatattatgtcattgtttgagttttattgccacttcttctaatcaaggttcttcactatttcagtgctttggattcctttggtaataaggacagattcattctcagaatgttattaaatgcataaaatacctatgattacaaagacaaccaattatatcaaaatacagttaccaaaatattttttaaatttttgaaatgtgctgctttattttaatgtatttaggaataaaatccagtggttaataactataattttgaagtaaag

SEQ ID NO: 12990 - DNA, 1034 bp, Homo sapiens
tactgggtattttgtctgtaagctcctgcttaccttgttccttggattgagtttcagtgtgctcctgcttctcagtgatcttcatgcctttccatattctgaattctatttctgttatttcagccatctctgcctgattcagaacccttactggagaggtagtacagttatttggaagaaagaaggcactctggctttttgagttgtcagggttcttgtgcgagttctttttcatctttgtgggcttacattccttcaacctttgaagttgctgacctttgctttttattattattatttttttttatttttttgagatagggtcttgctatgttgcccagactggagtgccgtggcatgatcttggcttactgcagcgtccacctgccaggttcaagtgattgtcctgcctcagcttcctgagtagttgggattacaggcacatgccacaacacccagctcatttttgtatttctagtagagatggggtttcaccatgttggccaaactggtctcgaactcctgaccttaagtgatccacctgcctctgcctcccaaagtgctggaattacagacatggaccactgtgcccagccaatttttttttcttgtatcctatatttgatgaccttgagggtttaactgtggaataaggtggattcagccaagtgactgtgttctggaaggttttaagggaccggtgctaagttcctaactcctggactgtgtgctttaactccggggtacttatatcagtctcaacttgattctgtctcctggagcgcaggtatccactgtgctggggagactgacgtgtttggggccgctgatcactacacttgatggatggtgtcagtcacagcatttggtagtgcggtgacagcaggatccatcctcattggcatgtgccagcagcagtgcagcgtgatggggtgcacacttgttggctgtggtagggtgctagttggtgctggggtgcctgcctcccagcctgcacttgccacagtggtggatgcaatgtggctagggggtgg

SEQ ID NO: 12991 - DNA, 1532 bp, Homo sapiens
ccagcactttgggaggccaaggcgggcagatcacttgaggtcaggagttcaagaccagcctggccaacatggtaaaaccccgtctctactaaaaatacaaaaattagccatgcatggtggtgcatgcctgtaatctcagctactcgggaggctgaggcaggaaaatcacttgaacccgggaggcggaggttgcagtgaggtaagatggcaccactacactccagcccgggcgacagagcaagactctgtgtcaaaaaaaaaaaaaaaaaaaaaaagcatgtgaagacagacattatcatgacttcaaatttgttaaggcctctaaagaaacaaatgaaatagtcgaatatggagaacagtatttagtttactttatcaaggtattggtattaaaatgatactactaggagaattgcaggagttctggggcagttctttaatatctgcaattcaccatgttaactagcatattgtaaataaaaaaaggaagatgctttccaagttaagagctgtaaagtaattcccaagttgttaagagctgtgaagtaattgagactaagaggtttgatgtactaaaaaaagttacttcattactttactgttgcttctatatgatgtaaactttaaaaattaaggctcaaattttagaaatacacagaggacaaacatacactctaaaacgtgtttatttcagtctaaacaaatgttttgtttatggatattagtgtttttgagaaatcactcagaaaatgttacttcatggccttgcaatgcttgatgttagtttagcacatacaagtgcacttttatacccattgtttaggaggttttatttttaaaattttcttttggataatctcaaaacaataaaggcatttagtgagtacaaatttggaaatcccattttatttttatatctattttcattgtttatcttattgtttgagacagaaattgttaccatgtgatgatgatttccctgttgttttactgtacaaatatctgcctaattgtaaaattatgaatataaaattttaatattgtataataatctttcttggaggatttttttgttgttgttcacagcagatactgaatgtatttctctgtttggcttctttctttgaatgaatgatctcccagctttaaaaaatattactggggctgggtgcagtggcttatgcttgtaatcccagcactttgggagtatgaggtgggagaatcacttgaggcaagaagttcaagaccagcctggggaacatagtgagagcccatctctgcaaaaaaaaaaaaaaaagttaaaaattagccaggtgtgatttcatacccctatagtcccagatactcagcaggctgaggcaagagaattgcttgagcccaggagttcgaggtgagctatgattacaccactgcacttaagcctgggtgacagagcaagaccctgtctcaaaaaggaaaacaaaaaattactgagagcggtggctcacatctttaatctctgccctttgggaggctgaggtgagagggttgtt

SEQ ID NO: 12992 - DNA, 1032 bp, Homo sapiens
caaaggtacgttctttgacaaaagaccatgttattgtagatgtcgtgtgttccaccttgctatgttttttaaaagatagttatttctgttttcatttatgcagaattcagtgatgaggatttaatgaagcagtgcatttcagaatatacaagaaatactttagtcaaataccgggttacaatcatctagttatgtttaatgtcagtattctgtaccttaaatacattatatattcatgccttattttaaacagatctttgtataatatacataataggttatatattatactaatctgaggaataaaggtaagaatatttttgttagatggtagaaatttataaagcaagtagcaatgctgatgtttctgtacgatcaatatgcagcacaatctttgaagtgtgaagagttgtctctcttcattcatccttggttttgctgcctgcagccattattgtaatcaaatggtaactttattctctgtgctttctacttgagtcagactgtattttcttatacccccccatgcattccttctattcactgttgccatggtatcatcttgaaaatgtggtaaactaattatggggtcccccccttttatggtttatctttttttatttaaatactcacaagtttatatattagtacattaaaacctatgacccttacaaatcattccggcttatcagaaaaataagcttcaagccaaaggaaaaaaagtgcttcatcacagaaacttaaaaatcaacagctagccaatctggctattatttcatgtttagccatgaacatttcttaaatggtagtacacacacattgtatttttaccttctcttacctttgcactttagattgagagacaactacctatagtataaataacttctacttttttgtttatttaaatttagttttatgctttaaaaattgttttacttgacaagacactgaatgagctgtgttttctggtctatatcatggtttgcttctagatttaaaatagagatttattaaattctttctcttcta

SEQ ID NO: 12993 - DNA, 1142 bp, Homo sapiens
caggctttgatttgttttccaaagaagtaatgaatggtggcaatattaaattcttaatacaaatgccctctaatagtcttaacagtatgatttatgggctttaaattaataatattagacttgtataatttttctttataaacagctatatccattttttttaaaatttttttgaaattatttttaggaaaataatatttaatattcaaatattgccttaaatatatatttttggtcaccggagaattcctatgctttgcatagtacccaatcaccttttatccctgcattcttttttaaaaaaaatttgtagcgaatcactccattgtgctcagaaagctgtattgagaagtcataaaggatttctgcttaaaatgtctgtaaaatacccctatctttttcgtattcatggttctcccctggaaaattaggtttgtttggtgaaatagggagcaaatggataggaaagtttaaaaagatgtatatatcagtcaaaaatgaaaagttgaaactatccaagacatgaaagggactgggtcaggataggctgaatgaccttttgccagttattgaaaatgaaatttctgtttagctgataggttggattaaggtttttgagtcagagtttagtacctggctgttacttagatttgtttgaacctgtgacttgtttttttttttttttccccctccctcttagtttgctatccttgatttcacaatgacaagaaaaccacaaaatagatgatgcagtatttttaaaaccagagacttgtgtcccatttatttcattttttatgatgtcttaatagttcttttttgcaaatggctagggaatgcggcttagagtggagttgtgttggtgttggtaaggaatgatggtcattaatgatctttttaaattggccaccatattttagctgaattccaaacacttcactaggagtttgcatgagtggatgtcaaagaaacaaaagttcacaacctccaaaattttgattatggcattaaagttggaattattagtattgagttctcacttactgttttttcatgctgaaaaaatacatgcctattttgtttacatttgtaaattggtattaatcttgccccttttttctttgggtagagggaaattatct

SEQ ID NO: 12994 - DNA, 1021 bp, Homo sapiens
aaagccatttatccagcagagggagtgagagtatcagagagccataataactgttggatcttctttttctgaaataaatttaaaagtacccaagtattttcatagttcaggtttgcaaccttgattttgtacttaaaagttagattgtctttttatatttttctaaaatcattctgatggtatcctttgaaggtgatataaatctatagaatgaataattgctaccactttgctagtagttaggatagattcatattgatccttatagattaagagtatggtgaacatagggataatagcataatttggttatcctcttctgcttttgtgtgttcccttcttaggactgaaaatccttcattgacactaggaagtattgaaaattagacataaaaataaaaatgtttctctttgcttctccatagggttcagcaccacccccttctccaacacctaacaaagagatgaagaacaaagcagttctttgcaaacctttaacaatgacaaaagctacttactgtaaacctcacatgcagaccaaatcttgtcagacaggtaacttaggacaatgtgacttacatacttccccataccttcatctcacctaatgaaatacatgcttttcttgaatgacacctccaggatagattcatttggtcaatttgtcattttctgttgattttgcttacgtaattttagatattacctggagaatacagcatctcattttaaatcattatgatcaatctctgataaaggcctagaatacaaattatgtcaaaagtgaaaaaatactatctcgaaaatttccttggggataagactactaaaattataatgcttcctctgagaaaatcatctctttgcatgtggtttgtaatggtaacagttctgtttccttcctgtcagaatgaggtgaaattgttcaaatatgtattttttatgaaatttacagtgttacctgtgtattctaattatttgattaaataagcctttggggaggttgttgaggagagtatgg

SEQ ID NO: 12995 - DNA, 1018 bp, Homo sapiens
agatgataatataggtccaccattccacaaacctctgaaaagcagaatttttttcatgaaaacacagtaaacagtaaaacctaacttaaaggattgtgaagctgttgttgtctttattactcttggtgttaatattcgtccatagaacattaaccatagaatttactatagaattgttaatgtttctaaacaagtacagagtgtttacccacaccactctaggaatattaatgtattataattatgtacatgccctgtttcccctgtaaaatccaaacaatgatgaattccaaaacatgtgactccagtggttctggctgaggggttgaagatccatgtgtgtattttccctcctcttcttttattatacctaggagggagggggagactaggagtagcatttatactgtaccaggtgtagatgaaattgtcttggtcctctagtttcagaacaatttatttaaggagaacatttatattttagaaataattctgttatctagatcaattattttttaaagtgctgtagagagcactagcgttgtgccatatcaactcagcaggaagagagtttgagttctaggctcctcttgttttaattcattcctacttttgggggctgtgttttggggttatgtatggaatttcatttagaaatttcatttctggtagaaacaaggcttaaaaacatatttagataataaaacttttaaaatcaataaaaacaacaaaataaggggttctctgccccactgatctctagtctacctagttcctctccctaaggacgtgctttttgctcttttagctatttcccctggcattacttgcaaaatataactgatttttatatattcatcagttcactattctagtaggtggtcttgttttgttattttttaaatatatcttagaattttctatatacacaatcatgtcacctatgaataaggacagttttacctctttctgatctttctttgctttgctttactacattgcttgaaaccttccccca

SEQ ID NO: 12996 - DNA, 1541 bp, Homo sapiens
gggcaagatagtaaataatttaggccttgcagaccaagaggtaaaaatttagactgtaatatagctacttatatataactgctttaagttgtaaccatttataaaagaataaaaaacaatccttagctcataggtttgtgggattgggcccatggagctagctaggtctgtatagttggcctagacactcatgtagctaaaggtgtatcattttaatttttctcttgtattgagtctgagttgtattatttcctttcttaatttgctctctttttatccagtttcttaagatgtaagcttagataattgattttagtgtttcttctttttcaggaaagcatttaaaactaaaattttctctaaaactagtttacttacatcacgaatttttatatgttgtgttttaattttccttgacttaaggaaaatgctatcacaggaagttgaatctctggattgccttttattaaatgattatttaaataattaggacttcaataccgttaagaggttttgagagctaagtggattgtgtaataaattatgaagtatgtcttaaatagtttttttttctctcagtttttgttgtagtaaaatatacataacataaaatttacggttttaagcatttttaagggtgcggtgcagtggcattaagtacattcacattgttgtgcaaccagcatcaccatctatctctagaactcttttcatcttgcagaactgaaactctgtactcattaaataataactctccatttccttctctactgagccctgtaagccacttttctactttctatctctatgattttgactaccataggcacctcatataagtggaatcatgcagtatttgtcctttttagtctggcttatttcatgtagcataatatactcaaggttcatctgtgttgtgtagcatatgtcagaatttgtgtgtgtgtgtgtgtgtgtgtgtgtgtgtgtgtgtgtgtgagagagacagagagacagggtctcactctggcgcccaggctggagtccagtggcatgaactttgcttagtataccctcaacctcccaggctcaagtgatcctcctgcctcagccctttaggtggctgggaatgtgggcacgtaccaccatacctggctaactaacttctctattttttgtagagatggggtttcgccatgttgaccagtctggtctcgaactcctgggcccaagcaatccaccttcctcagcctcccaaagtgctggaattaacaggcatgagccactgtgcccggcttccttcctttttttttttttgagacggagtcttactctgtcgcccaggctggagtgcagtggcgcgatctcagctcactgcaagctccgcctcctgggttcacgccattctcctgcctcagcctcccgagtagctggcactacaggcgcctgcaaccacgcccggctaattttttgtatttttagtagagacgaggtttcaccgtgttagccgggacggtctcgatctcctgacctcgtgatccgcctgccttggcctcccaaag

SEQ ID NO: 12997 - DNA, 1823 bp, Homo sapiens
aggaatttatatttaaaaaaaaaaaagatacttttattggctgggcgcggtgtctcatgcctgtaatcccagcactttgggaggctgaggcaggcagatcacaacgtcaagagatggagaccatcctggccaacatagtgaaaccccgtctctactaaaaatacaaaaattagccgggtgtggtggcacgtgcctgtaatctcagctactcgggaggctgaggcaggagaatcgcttgaaccctggaggcagaggttgcatgagccgggattgcgccactgcattccagcctggcaacagagtaagactctgtctcaaaaaaaaaaaaaaaaaaaaaaaaaaaggatacttaatgaattcaaatcccataattgaagactttctgtgatgatttttttttaagaaatctactcttcagacaggcctattctatctataagttgctgctcttcttcgcagcttctcctttgcctctgttcctgaaaccacacacaggatttcttctgtagattctcattggttgcaagggctttggtgctaagggagccatatgtgtatagattagatgtttgtaagttgtgactgcctatggtggaaaataacagcaacaataatatggcattgcttcccatactaccacaataagtaataaaacattttgtaattcattctgtaacaagaacagcagatcatttatcatggattgcctagagaaaccttttcaggaggattaagtgttcgcacttcatttaggaactgcttttagtagagctgagttgggaacttagtttttggtttattattgctaaggttctaaatgttacatagaaattttctctttgtactagatttacagatgaaaataattatttcagaatcatttccctcattttttattacacatgttgctttatgataaaagcaaaaaatataaattgctattctaaacttggggattttactttagtgattgttttatgtaatacccaactaagtttgtatatttagaaatccagaaacaatgcaaaagtttatagtcccgttaaatagctggaatcatgatgttatattttaagcaatcactgctgttctcattcataacaatgaggatctccaggtagtttaggaaatgctatttttagagcatcaaccctttaactaacccaaaagcaggggagaaacctagcattgtcactttcttgatttgccaggcttttatcagttggtctatcattgtatttgaaagacattaattaggagtttttgttctactattttagaattttgctgactaatattcctttgactagtttgaataacattggatcaactcagatgatggcattcttatgttttgattagtgtatacatggtgtacattttttcttttacttttcacttatctgttcttttatttaaaataggctttttgtagacagcatattgtcgaaccttgcctttaaaaaaattgaatccgacaatatctgtctcttttttttttttccttgagactgggcctcggtctgtcccaggctagagtgcagtggtgtgatctcatggctcactgcagctttgacctcccaggctcaagtgattctcctgcctcagcccgtcaagtcgctggagctacaggcacatgccaccacgcctggctaatttttgtattttttgtagagacggggtttcaccatcttgcccaggctggtcttgaactcctgagctcaagctgtctgcttggcttggcctcccaaagtgctgagattataggtgtgagccaccactcccaccccagtatctgtcttttaattgctgtttagaccagg

SEQ ID NO: 12998 - DNA, 1058 bp, Homo sapiens
gaagatgatgagccagtatttgaacaaattgaaaacacagccaatccttccagatgtcctgtgaaaatgtttgaatgctacttgtctaaaaggtgagtgttaatgatacttaacttttaaaaatgttggtagaagttggctggtttaaatttaacattaccaagaagtgacttttttagatggattctttctcagatttcttctctctcagttatacccaagttcattcagttataatcttttattttgaaatacccagtttatacatcatacttagagtttaagcatgtgttaagaaatctctctctactaatgaaatttctactgctgtcattttcttttggagatggggtcttgctctctcaccgaggctggagtacagtggcacgtgatcatagctcattgcaacctcaaactcctgggcttaagccatcctcccaccctctgcctcctgagttgctgggactgcaggcatgtgcctccatagctggctaatttttgtattttttgtagagacaggatctcactgtgttgcccaggctggtcttgaactcctgacctcaagccatcctcgtgcctcagcctcccaaagtgctggaattacaggcatgagccattgcgcctgtcattgtcttttaaattacagcaattccaatgacagcaaagcaagggacacaaactttttcttaaacggtcagatggtaaatattttaggcttttgggcctatggaatcactattgtaactaatcggttctcttgtgactagaaagcagccatatactatatataaattcatggcatgtggctgtgttataataaaacttcacataagcaggtggctggctgtagtttgccaatgcccggtgtaaaggtatgctcaaaggtagtatagataggtggaaatgtaagtgaagtatttacatttaagagaaaacagtcaagcaggtatgaaaaatggaatcatgttctggaattttttttcccctcaatctcagaccaacaggcattttaaaaagtttaagccaataaaacgtttagagaccatagattattttat

SEQ ID NO: 12999 - DNA, 1108 bp, Homo sapiens
atttgcaaccagaatgctctagttctacagatagccctgtctggtatacgtctacttcactggaccgaaacaccttggaaaatatgcttgtacgggttcttctagtaaaagatatttatgataaagacaattatgaactggatgaagacacagactaaaaaggaacgttgcagaagcaatcgggataaaacagcattagatagtcatgctgctagatctttattatggaaaacatttcaagtttactccttctgttttgagttttgtagcagtgtacccacgctgggtattaccatgtaaataatctgtgagtgaaagttgccattattctatgtagtggttttaggatacttaacaaatacattcaaattctttttttattattatttatttgattaggtatgtttgtaactttttacattacagaatatgaatgagaatgtgccatgtataatttttttcttgtagtaagaaacatccatattgcacaactctactgttgcaaagcttccttggaagggggctcttttactgggttcttaaccagatggttgtgtatgggtagcactactaaaagtttagaacttgcagtgtctttcggaatttttaaaataaactgtaaactaataggctggggtttttgttttgttttggggttttgttttgtttggttttacattttagttactgaagccttacaaggttatgtagagagataccatcttctgtaccaaaaatagacaagagaatgctgtcaatattggtgtactgtaatgtgaatctatgctggtgaaaacaattttttgttccccttattaaaaccttagtgtccttttctcatttgtggctttctgcatcacccaatcaataaaaaacaaatatatatatgtatatatatgtatgtatgtgtgtgtgtatatatatatatatatatatatatataaatgattgtaagttgaaaacaagatcatcaagacatttcctttgtaaaaatgtctggtgaaagtataaaattctgttttcttctatgccagccataagtatctgaaatcctcttcatttatagaggtttgatttttatttctttttttccctcttaaggatacag

SEQ ID NO: 13000 - DNA, 1025 bp, Homo sapiens
ctcaagcgatcctcctgcctcagccttctgagtagctaggactaacaggtgcactccaccatgcttggctaatttttgtattttttgtagaaaaggggtttcaccatgtttcccaggctggtcttgaactcctgagctccagcaatcctcctacctcagcctcccaaagtgctgggcttacaggagtgaaccaccatgccccgccccataggtaattcttaatcatcgtattacttagcattttaaactgcagcgcatgacttcctttatgaaacatatttttaaacttagttgcctgtattctatggtctcctgatttttctcctacttcatatggctcttctcagtattctttgctaataccatccttagcccctaaccttttaaagtcaggatgtccagagctcagttcttgagcctcttatctaacttaaatctttggggttcttaggtagtctcaacggctttaaaagccaccaatacactgaaaactctactacatgtattgactgtatatctccaacttcgggaatagatgaataatgaccttattttgttctagtgttttagctgtattaactcagttagtacaactaccctgtaagccaaagggcagaaaacctttctattaagggccagagagtaactatttgaggctttgtgagcttcctaatgtgccccgaattccttctggtgggtttttggtctcgctgacttcaagaatgaagccgcagacctcgtggttagtgttacagctcttaaaggtggcgcatccgagtttatgccttcaaatgttcagatgtgtccggagtttcttctttccggtgagttcgcagtctcgctgacttcaggagtgaagccctagaccctggtggtgcgtgttacagctcataaaggtagtaaggacccaaagggtaagcaccagtaagatttattgtgaagaggaaaagaactatgattccacaccatggaaatggacccgagaagttgcggcgggtgggggtgggggtgggggggcaggcagg

SEQ ID NO: 13001 - DNA, 1110 bp, Homo sapiens
ggacgggcgtcgctgaccgcttggcgatgtcccaagtcccagtcacgcctgacggggaaacttaaaacccagttagattactgcgccagctctggaatcgcacagcagagatggtgcacatcgctctttaattttcttgttaggtgaagcacttcaaattgcctgatgaaagttgaatcaggaatgaagataaaagtacacaacaatgcagaaagcggtacttagcctcacaaagatggaaacattccaaaaacgtgaagtactgttgtcccaagattctttctaagcctaaaattacacttttactagtccgattttctggttgtgagttttttttgtttgttttttttttttcgagaaactgcagtaggcttcttggaagtagaccaagggtgtccaatctttggcttccctgggccacatcggaagaagaattgtcttgggccacacatgaaattcacaaacactaaggtagccgatgagctttaaaaaaaatcgcaaaaaagaatctcataatgcttccagaaagtttacgaatttgtgttgggccacattcaaagccgtcctgtgccacgtgcgggccggggttggaaaagcttgaagtagactgtccatagtcagtagaagagtattaaaaaacatacctttcacttaaaaaaaaaaaaggttttgccagcatttgatttatattaaacataggtggcatcatccccagattatttcaacatggaaaagtttgttacatgtataagctgctttggaaattgcctggagaatccagaaaccctgggttgtataacaacagttgttctgccacccatagctattagccatgcttgattcccttcaactttcctggcctcactttccacatcttttaatatttgtatgttccacaagatgtctattcaactaaagtctcaagtcaaaccttttaaaaatctggttacaacctagcagaaaggatttctcattctaaaagttgcttccttctataacttatgtgtcaactaagctgacttaaatagggttcataatcagaaattatggttcagaatagtggttctcaaagtggtccccagaccagtagcctcagcatcacttgggttt

SEQ ID NO: 13002 - DNA, 1049 bp, Homo sapiens
atttgcaaatattttctttcattttgtagattgcttttcacactgatgtgtcctttgatacaccaaagttttttagtttgatgtagtcccaattgtccatctttacttgtgttgcttgtgcttttggtgtcatattcaagaaataattgccaagaacaatgtcatgaagcttttcccctatgttttcttctagcattttttgtagttttaggtcttacctttagatgtttaatccattttgtgttcatttttatatatggtataagataaaggtccaaattcattattttgcacatggatatttagttctcccaacactatttgctgtacagaccgtcccttccctgttgaatggtcttggtaccattgttgaagatcatttaaccatatatgtaagggtttgtttctgggctttctatgctgttctattggtctatttgtctgcctttatgccagtaaccacactgttttgattagtgtagctttataatatgttttaaaatcaggaaatgtgaaccttccaactttgttctttttcacagttgttttagctacttggggtcccttgatattccatatgaattttaggatgaatctctatttctgtaaaaaaaaaaaatgtcatttggatagtaaggatttgataaggattgtattgaatacactgggtggtatggacatcttaacaatattaagtctttcagtctatgaacctatgaacacaggatgcctttccatttgtttatgtcttctttaattcatcaatgttttgtagttttcagtgtatctagtaagtgaattttaaagtatttgagatcaaatgatttcttatgttattcaaactaaatatttttattaggcatcagaatattgtttacctaaaaattcattgttttaaaaatatttgcttttctaatttttaaagtggcataaatattgatccctcaaaacattggggcttaatttacagattacccttccttgtattaatattaattaatactcaattaattttctacgagtacatgaattgctagagtagttttttt

SEQ ID NO: 13003 - DNA, 1073 bp, Homo sapiens
tgctgggattacaggcgtgagccaccgcgcctggtctactttaatggtcttaaattgctggtatatttacaaattattgtggagtggagtgactattctgttccagacgttgttctagcactgtggatgtagcagaaaacaaaagagaccaaaatccttgatgtcgtggaacttgtttctagtgggaaaagacaataaacaaataatgtcagtagttataagtgctatgaaggcaaaacaggtaaggagctagagaatgtgggaggggctggtatttgagacagggttgtcatggaacggctttctgttaaattagcatttgagcagagacctgaaagaatagacagaagcaagccatgacgatatggaggtcaatgtggttgaagcacagtggacgatgtgatggggagagagaggcagagtgggtgggccaggacctgtggatcctcacaggccttaggtcagggcttcaaattatatttctggggagatgatgagccattggaggattttgtgtggaagaataatacaatttgacatatgttttcaaaaggttctaaagtgtgattaactcaagcttctgtacctgaggtccaaatcaaaagattgttttggctgctgtatggagaataagctggagtgggcagtaccgaaatgcaaaatcacagtattcacttggactaatgatttagcagtggaggtgggcaggatggattctgaatatgtatcaaaggtatcagtgccagcacttgctggccatttagatgtgagacttgagggagagagtgtcaagggtaattgcacaaatatagctctgggagctggaaggatgccatccactgagatgtaggaaactggggaagaagcagcttttggagggaaaaatcaaaacctttttttagatatgttgtgtttgagctaccttttcgatgtccaagaggatgtattaaataggcacttagggagaagttgggggccatcttcatataaatttatttcagtatatttagcacatatttttgtgctctgttattatatatattatcagtaatacttttgaaaaaatggagtgt

SEQ ID NO: 13004 - DNA, 1053 bp, Homo sapiens
ttctttatccattcatttgttccccagaacttttaccaactattttttatgtgctggggatacaacagatatatcaacttgatttctgcctcctaggactcacaaatagttaactgatataggttaataaatgagataactgaaaaatgtgcaaagtgctgtcaaaatacagaggatctcttaactctgcccaaactaggggacgattgacataattaggttttacagaggaagtaacatttgaagtggccttgaagggtacggagggttttaccaggaaggaaaggcaggaacaggcactgcaggtagacagtagcattagtaagggcagagttagagggatgcagagtctatttcaaaaggtagtctattgtggaaaatgtagcagattgaagatgtgttttcttatactacaaaccaaaaaaagacagtttataaaaactataaatgcggctgggtgcggtggcacacgcctgtaatcccagcactttgggaggccaagacgggcgaatcacgagccaggagttcaagaccagcctgaccaacatgaggaaacccttgtctctactaaaaatacaaaaaattagctgggcatagtggtgggcacctgtgatcccagctactcaggaggctgaggcaggagaattgcttgaacccaggaggcagaggttgcagtgagctgatattgcgccagtgcactccagcccaggtgacagagcaagactccatcttaaaaaaaaaaaaaaattataaatgtacaagaacaaagagataattaaattttaggaatgttttctgcttagcagattagaagaactgcagaggtatgtaggtagtggagacgtcagcagaagcaaaacaattcttgacatagaaccccaggaaatcccgggaattggaggcatcagaaaatgggaggggtgctggctgcttctgaaaacaggagggttggctgcaagtctggatgtgatacagctagattttcaaatgccctacctaaatcgtacagcaggaatttaggcagaatgcaatgatgttgttggtggatgatgt

SEQ ID NO: 13005 - DNA, 1025 bp, Homo sapiens
tttatgtagttagccccttaaccttacttaatttattctgtgaatagagccttttataagactcactttcttgaactcctggcctcaaattctcctcctgcctcagcttcctgagtagctgagattacaggctcaggccaccacacccagcttaaaagtcactttcttaccaaaaaaaaaaaaaaaaaaaaaaaaaaacctcatatttaaaaactacgtcactctaaaatgttacaaataggtcatcttcttagtatgcattgccttgtaaaaacattggtcaagtcgggatgtagtcggccaccaactagaaatgtgttaagattttttttgcagacttgcttaataaggcaaggagggggtcaggttgttctggggccagcagaagggtctaaaatacagggtagtgaaaagagattagagattgtgagtttcctttaaatgcttaactgtcattattaagacagccacattttgtggggcgagccaaactgctgagcttggaatagcatatgcttggaatctgaatatgaataaggcccaggtgccacactttacacacagatcctttgctaaagaggcactatttgtctaacaggcaaggaccaggctggcagtcaggaaggctgggttttggtgctgatcttgtcaccaactatgcactcttgaacaagtcacttcacttcactatcctaagcctgttttctcatctgaaaaataaaggggttagacttagccttttaaatgacatttttgtatatttctactggctataaaattattacaaatatctatgtctgacggtaagatagtctaaatattcaggaaaactccaagtatagctctcctaaaaatgatatgttgcgtgttaaaaaaagaaaaaaaagaaaagaagaagggggaggaaaaaataaaatgaaaaaaacttcaaaaatgcacggctgagttggtagcaaagaaggaaattctttggaggccaaaaagatctagaaagtttaaatccaatgtgcaggagctggcattgc

SEQ ID NO: 13006 - DNA, 2006 bp, Homo sapiens
ttagtaaaagaagtctacccagaagctagaaagaagggcactcacttcaattttgcaatcgtttttacagatgttaaaagacctggctatcggtaggtaacttctcatttttaagtcctgtaatctctttgtttttagtatgttttaactgatacagataactccttcaatgaatcttgttagtgggagaatatgggtttatattaatacgtggtttggcttaataaagtagttaaattttggaagtgtgttataaaatgatggagaaaatccagtgccatattcactttgtagtacatactgggtttcattgatttggatccattaacagttgattttctttcttacagagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagaccgagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacagtacgacagtgtattgtaaattccctttagtttgttacagtagccaattgaaaatgtatatcccaaaatttaaaaaaaaaagtaccagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaagtg

SEQ ID NO: 13007 - DNA, 1030 bp, Homo sapiens
tgtgggaggacaaatacagactgaagtatgggctttatctcagggtcttccaacataaaacatactactgggagatttccttaaacctctgcagtgggggcagtgcgggcagcctctgagctactgttcctttgccatggagtggctccgtgggtgagcaggttgggaggaggtaggcctccacactcactctctccctgacttctgggatccatgtgtgggagtctggcccttcttggtgagtgttttttgatgggtaatgactatctacgtttcactagcattcgggaaggcccatgtgaatggtaacagaaacccttcgattgatgtaaatcttcagtgtttttatcttgaaccaactgaggaacaggagtatccttgagtctctgagtaggaactggtgggtggttcttacaagaaagagatgaatctgaactataaggaagcttataatagagttattttctattactttttcctcatctagttttcttttgacattttagaccattaggacatcttgaccaagctctaggggaaaggggtagagaggaaaaagaaaagagtaaagcctcttggtacagactatgtttgaagtttcgttcctcaaacgtgtgaacttgtgcacgcaatacagcaagggagacacgggaatgataaagaaggataagacgtgaaagatacagtctaactgctaatattgtttcgtgtatgtaccttttaataagagtaaagcttcccagctaaattgggttggggctctcggtggaatttccgatatcagctagtacaagagaaagtggagccaggggtgggtgggctgggaatggcattcagccaggctggggacttgctggaaaggcaaattctcaggctgtattccaggagtactcgggactggtcccagtgctgttttaaccaacgctccaggtgattctgagcactcgctagttggagaaccactgggttagggagctaaggtctctcaacgctgcttgagaagggctgccacaaccgccagtgaaggaga

SEQ ID NO: 13008 - DNA, 1016 bp, Homo sapiens
agctaatgtaatcgtctcctggaatgccccataatggccctgcagcagtttctgcaggctccgcctctctgcaggcagcagtctgcgagttcagaggaaaatgagctccctgctctcgggaaggtgaagtcagcctaggacagcggcaggactgcagctccctctggacaaggggcctgtgcagcagacctcaccaggtacctttccccacagaacctacacagaagcacaaggtcctttgctccttctttgataaggtgtcctctctcgtggttgatttcaaactgtgttgagctaagaaccctttctttaaatgaaaggtgttatggaagcctaaacaacacattattcaataacgatttcttgaaataagtgtgtgtcaaatgcagtgtcgagaactgggtacctggtggtaacccaaacagactttatctctgccttcatagagcttgctttagtgggcaaatacagccataaatgagtaaatatttactaactcttcattatggtcagtgtcgtgaaggaaaaaaatgtgggatggcctttcggttgcattattaggaacgatttccaggtcaggaagtgatgcttctgcacccagcagtacctgtcagtgtgaaatctggggtggagaccaggtcagagctttggatggctgatgacacccaggaggaagaggcagcctctacacgcaggtgggacagtgagcccctgccttgtggtctgtgctgagcttccccacaatgcaagccaaggcatcagctcccacccacaccccaagggacctgcaggaaaccaggctgcatttcaacaacaagcagaaagcacagagctttacacacaatctaaatacatcaaccatttgaagatgctaaactccatacaagagcatcaccagactccacaaaagaaaaaacttataactgaggaaaccgagctaatagtcaaatcagaacagaaacttataatctgtatacttcgtattttggagagatgtgggtgggtatctatatgtc

SEQ ID NO: 13009 - DNA, 1076 bp, Homo sapiens
cctggacagatcccagggtgcacctctccaagacatgtctgttcccatgacatctggaggaaagagacataagacttaacgtaagtttccttagagttcatttgagttaatctatctatgtattcctgggggcagcacatgaaaactaccaatattaataagtaccacacatggggtatctcccatatgccgggcactttttatacaggcatagctgattttaattgcacttggctttattgtgctttgcagagattgcattttttacaaactgaaggtttatggcaacatggcatcgagcaagtctacaggtgctcacttcctgtctctgtcacattttggtagttttttgcaatatttcaacctttttcattgttattatatatgctatactcatctgtaatcagtgatctttggtgttactactgtaattgtttttgggcatgataagccacacccacataagacaatgaattaatcaattaatgttgtgtgtgttctgactgctcgactgaggctgttctctctctctctctctctctttctttaagcttccttattccctaagacacaacaatattgaaattaggccaattaataaccctaccatggcctctaaatattcaagtgaaagaaaagtggtatgtctctcaactttaatcaaaagctagaaatgattaagcttagtgaggaaggcatgttgaaagccaagacagcctgaaacctagccctcttgtgccaaacagccaggctgtgaaagcaaagaaaaatttcttgaaaaaaattaaaagtgctactgcagtgaacacacgtatgataagaaagcgaaacagccttattgctgatatggagaaagtgtgcgtggtgtggatagaagagcaaaccaaccgcaatgttcccttaagccaaagcctaatccagagcaagaccctatctctttggttctattaaggctgagagaggtgaggaagctgcagaagtgaagttggaacctagtagaggttggttcataaggtttaaggaaagaagccatctccgtaacatcaagtgcaagatgaggtggcaagtgctccaga

SEQ ID NO: 13010 - DNA, 1030 bp, Homo sapiens
taaagacatgggtagttcagtgcctgaacacccatcagggcagaggtctgccctaggcagtggatgtccaagaaagcacaataatgctcacatatttaaaacataagtcatatccacgataatacatttttgggatgataaaccaatgttaacctcatccaaaacttccctcacagacatgtccggaataatgtttgacccaatacgtgggcacccagtggcccagccaagatgacatgttaaattgtccatcacactatcttaatgtttcacagtttcctggagcttaaaacgtcagatattgacctcagtacctcccccgtctctcagcacaaaaccctgcacactctgccttctacaacacatctcagacccatgcccacctctcagccccaccaggcctggcttgctttgggtctcatgacatcctgagttccaaccactgcctgtgtggcctcaggccagcagcatttcctccctgcacttttccccacatgacacctttctgtctctctgatgtcaggctcttgcctaaaatctgtctgcggtctcctctcagggtgaaatttccactcatgagcctgtcacggaggcctacctaacagagccctgacctgcccctccaggcccattttatcttccgccccaggagccacctgcagatctgaacacctctggcctctttctacctctgtgctgcaccttccttcccctctgtctgcctcctccctcgactaaccccagacccactaaacactcacagccatgtgaactgaactcaccacacacatatctcatttctacggtgtgtgtttgaaagttccccctttgccttcctttgatactccagtaggtaggaggagtatctcattactgttggtagcagtggtattttgggaccccccagttggcttccactgacaacacttctgctgggcgggggaggggtgcctcattactgctccccatgtggtctctaatgtcaccatgggaggtgtgaggcctcattatcgctggatggtgataaaaa

SEQ ID NO: 13011 - DNA, 1055 bp, Homo sapiens
agaaatgtggacctcagactgagggcttttctggggaccaagtactactccacagctccagctcttggtggcatggacctggcttacaatcaccgtatgcgggacacagctcctcttctgactgcagcgcactcggcccgacgtgacctccacccctagtgcctgcgatctgactgcccgacatgacctccacccctagtgcctgcgatctgactctgcccgacgtgacctccacccctagtgcctgcgatctgactctgcccgacgtgacctccacccctagtgcctgcgatctgactctgcccgacgtgacctccacccctagtgcctgtgatctgactctgcccgacgtgacctccacccctagtgcctgtgatctgactctgcccgacgtgacctccacccctagtgcctgcgatctgactctgcccgacgtgacctccacccctagtgcctgcgatctgactctgcccgacatgacctccacccctagtgcctgcgatctgactgcccgacgtgacctccacccctagtgcctgtgatctgactctgcccgacgtgacctccacccctagtgcctgtgatctgactctgcccgacgtgacctccacccctagtgcctgtgatctgactccgtcctgggtcttaggctctggctgcagccctgcccgcaggctccaggtcctctgcaaggacctaactgctgaggacaagcccacaagtgaggaaacagatgctcctctagctgacactaaagataagatgcctctagaaaaacaaactcctgttatacaggaacaggatgataaatgcgataagctccatgtttgtggtaatttcctacttagcaattttctcttgctgtgtcttttacaaaccatataacatagataaacctcttatttctttcttagagcctttaattttggtcatttttctctgggtcgaatttcctcaatagtggacaaaagtcacctttttttcttttttctttttttgagacagggccttgctctgttacccaggctggagtgcagcttgtgccatcttggctc

SEQ ID NO: 13012 - DNA, 1049 bp, Homo sapiens
ctttacagctgttagactcattcctcacagcaatttcaggaggtaggtactatcattctgccccatttagagatgaggaaactgagactcagggttaagtaacttattccaggttgcacagctcataagtagtggtctcaataacaacagcagcagtaacagcatcagcaactgctccgggcgctgggctcagcactttgtgttagcccagttagtcctcacaatgcccctgtgagatgggttctatttttgtctccttatggatgtgtagcatcaaagtgacaatgttaagaaatgcttcacaatttgtctgcctttttcagtagttagtgtagcatcccactagacgattctatccagactaattgctcgaatatggtatgtactgattgacttgtcaatttctttgtctcatattttgtgtaaatgctttggcattatccccgttttttcttattagttttaattccacctaaattacacattttttgcttttagaacttaatacattttttaaaatgtaagatcgtatcatgaaagaaataacctgaagcatgtgcttcaaagaatgtgatttttatcttctcaccctaaccctgtgtctacacaagcagtaagttgcatggttgagtaattgctggttgattttgagatatgccagcaggaaaaaaagttatgaccaagtagctggaaaagtgaaaaaagctgtttgaattcacttcaaatgggtcattcactcaacaaaggtaaatgatttttcattgccccggcaatgtgacctgcccaggcagtggacgtggttcatctgggttcagccacttccggggcacccgtcagctcacccctgatagccgctcagcctgcagcggaggcagctctgccccctctgcctccttggttgttgtcgttgttgtttttcttgagctgtttgcccatggttctggttctgtgctctggtttctttctaagtcagatgatccacttgggatctgttagttttggaaacttcaactttaaaggaaacagaaccgctgtttctctacctgatg

SEQ ID NO: 13013 - DNA, 1049 bp, Homo sapiens
taaacgtttcttctctggcagatggagccaaatctgtctctcctgtggggtgtacagtgtgtcctctttaatcaggcttctggcaggacagaaagtccctttgttctgtgcctcagtcagcaaaccggtcccagggatttgaatctcagagtggagtgcagacattttgccactgctcagctccttctgaagccttccctggcaccctgggtctgtaattcaggccactttgaataaccaggcggctcacatcctcactcttaggtcttcgtgccctggccccatgaattcctggattttcctttcctagtccccagacaggatcatatggtggcatctctgccttcccagagaagttcctctctgtgagtcacctgccctcactgtgtgtcactaaatggaacttagttcacttcatccattccttcttttctctcatttaacaaataaatgagaaaagagaactccattgcatgctggggatacaactgtatatgagaaaattgtgccttttcctctttatgttaacattagttactccttttgactatgtattttgtgtagatataaaaggtatttgtttcaagttatcaaccagcatcaattttgaataggaagaagagtggcctctcactctttttaatcctaagtacaaacctggtcaatagaaacccacaggaagggaaccggtgagtggcctctatgtggcagagcacgcttgtctgtgccacagcagggctcaggagagccgcacttcacggctcaggggagagcgaagggcaggagggaggacggaggaggctgctctatcccacacacaggtcgctcatgcctttctggggagcattgttttgatgtcattttcaatgcatgggctctgtcctcttgctttttgctatggtaaaagtcccctctgaactaattgaaagttagtgcgtcatttgataaggtcacatagtacttctctttccaagagtgtcatggaattttgcagtccatattagtgtgtcctttaccaaaatgcattattttctattcttcatttgaag

SEQ ID NO: 13014 - DNA, 1034 bp, Homo sapiens
acattttgccacacgatgaatcacacagtaagtctcctctgtagcttatttaaatgatgtagatggtgagaggagttgatgcggaaagtgttaagacttttggtaatgttgacatggtgcgaaaatgtattttgcacatgagaaggaaatcaattttgggaaccagagggcagattgggttgaactgtgtctcccaaaatagatgctgaagtcctaaccctcggtgcctgtacatgtgaccttatttgaaaatatggagtttgcaattatgattaagatgggtcatactagattagggaagctgttcttgtaagaagaggaaaatttggctgatacaggaggaggacagccacctgaagatggaggcggggactggagtgatgctgccaccagctgccagaagctggaagcagcaaggctgcatcctcctgtatcccctttggagggaggatggccctgctgctacggtgatctcaaacttccagcctacagaactgtgagaaagtccgtttctgttgtttaaagactcccagtttgtgtactttattagggcgatcctagaaaacaagtagagattcatgtctggcaaataatgatcaaacaatgatttgttggatagaatggtgattaaaacctaggttagaaaatgagcaaaatgggagggaaagcaccaggacaaatagctaatgcatgcagggcttaatacctgcataggtgatgggttgacagatgcagcaaaccaccacagcacatttttatgtaacaaacctgcacgttctgcatatgtattccagaacttaaaaatacattttttaaaaaaagacaaaatgagcagtgtctacagctttctggagtgtgacagcatcaccagcttaaagctgttactagtactaaatggaataaacatttccctctaatttccccttaatgtcctcagaaacacagatgagggatacatcttcatatgactcctcagagcactaaaatgatatcaaaacactcttcccacaagaaatgcacagacaaaggattct

SEQ ID NO: 13015 - DNA, 1119 bp, Homo sapiens
tttctgatacaccccaaaaacagctggaaagatcaggcccaaaatgctccattgaaatctgattggtttgtttcttctgtgctaaatggaccaattgtggggagaggcaaagtcacataaaggaaatagaagcttggcttggtggctgtgaggaaactgctagataggtttattttaaatattttctatttattttaatgttacaattttatgaaaagcttggttgctttaagaaccaaaaggcaggaagggtacaggggaaaagatctaggctgtggtcataatacttagaggactgtgtgtcaaagcctgggtcatggaactgtaagaatcatcttggatgcttgttgaaaatgtgccttctgggtggggggacctgatgcagcctcaactgtaatcagactatatacctcaggcctctccccgtcccggaggttagatgtcattgtgcagtaatgatgctgtaggccatgcctggaagaatggatgtaaacagtagatgtcagcatgaatgagtctctggtgcctgccttctataccggaatgtcctgaacagctctggagcagacctgggctataagatttgggagaagagcatgaacaggtttgtggggggcacattttgggtgtaaagccattatttcaacatgtcccaaagtactatttgatgcagcttggcagcacaaaaatgcctgtgcacccgtagggagtgtgatcctgaggactttggcgagaacatcgtggcctcacaaatgggaactcagggttaacatagaaaaaccaggttttgactgcagctttccacgggtacatttagtgattctgaataaggatttctgcttgctcagggttgtgaaaaacggatcaacattgtaggggaggattagataactcgaaaactgtcccatcgcaagatatctcagaatgccagcacacagcagggcaaggaaggcagaatggcatctgccaaatactgtgacgggacaaagctaggaggtgggtgcacagatatttgctctatagaccttattctttctttatgcttaaaatgtttttaaaaatgttttaaaatttaaaagcctaattgaagttagctgtgtgtggtggtgcacacctgta

SEQ ID NO: 13016 - DNA, 1105 bp, Homo sapiens
cattgtcacttgagggattctgtgcctgcctcagactgtctcccaccccagcatgccaggtctgccctgaagacccaccagcatccatctgcaccctccaagaggactctacctgtccaatccaggagaggggaagggccagcctttcccctccacccccattcataccagagcaggctttgtttcttaacactggcaagctctccttagagagaagtagagcacaggtccgaaatggccagactggagagtttcaatggagggaggcaagctgccttcctgggttcctgggccacccagtctcctgccctcttctcctctctcagcccttcccggttgcaccccccacccaccccaactccaactttagcagcaggaaaggggacatctttactcactgtctgggacagatgcacggggagggcaggcttttattgtcttattccaatgggggcaggaggctggcaatgagatgtgttgtggtattgctgatcagaacgttgatcacatcttttgcagaaaatgttgctctgtgtgataggaacagtccattgtacttgagtgttaatgcgacaattcagtctcattacacaggattcttaggtcaggccctagctcttagtcaccatgggtgatgtagagattggtaaatgtgccctgagtcctaaacaacttgcacatgtacttttaaacacatccgggttgtgtgttgtgactctatagctaaaagaaaaatagcctctggttcagaaatgtgctccacttccacccttcctggggggtggagtgctcttctgtaacgtataaaagtctttctcattcatcaggaatggcctatttagggatttatgtggatttgcagattctgctatcacaagtgtaataccgatgatacttcatgctggtttgtaagcataaatgtatatgtaatacttactgtgtatcttttgtgtactagatgctgaagatggagagattgatcagagacagtcccattttcatgaagagactcatattcttgtctagagggagaggcccatatgtaaaagcaaagcagtgaaaagtagtgagtgtggcagtcagttaggggagaagatgagagttc

SEQ ID NO: 13017 - DNA, 1657 bp, Homo sapiens
ttagctatttgttttttggttggctgtgctcatagtgttgtatttgagaaactattgcctaatccaaggccgtgaagattttctccctatttttgtctaagagttttatagtttcagctcttagatttaggcctgtgctctattttgcatatggtgtaagggaagatctcatttcattcttttgcatgtagaaatgcatttgtcccagtgtcatttgttgaaaggatgattctttcaccattgaatggtcttagtattcttgttgaaaatgaattgagcatgactataaaattttatttctgaacctttagttctattttcattgatctatatgtctatccttgtgctagtaccacactgtcttgattcctgtggctttatagtaagctttgaaattaggaagtctaaaatctcaaaatttgttttcttttcaagattgtttaggctattctgattcccttgaattttcttattaattataggatcagcttgcaaatcatgcaaagtcgtcagccaggattttgataggattgtactgaatctgtagctgaatttgggatgcattgccattttaacaataccaagtctctccaatttatgaatccatttactgaggtcttaaatatctttcaaaaatgttttctagcttacagagtatatgttttatacttctcctgttaaatttaggcctaaatattttgttctttctgatgctattatagatgggatagttttcataatttttttttgattattgattgcaagtctatagacatgtgatggatttttttttctatgcagccatgcatcacttaatgacagggatacgttctgataaatgcattgctaggcaatttcatctctgtgcgaacattgtcagagtgtacttacacaaagctagatggtacagcctacaacacacccaggctctctagtgtagcctgttgcttctaggctacaatcctatacagcatgtgactgtactgaatactgtaggcagctgtaacacaatggtaagtgtttctgtgtctaaacatggaaaaggtacagaaaaatacggtataaaagttttttttttaaatgacttgtctatgtagggcacttatgaatggagtttccaggactggaagttgctctgggtgagtcagtgagtgaggaatgaatgcgaaggcctaggacattgctgttcgctgctctaaactttagaaatactgtccacttagtccactctaaatgtatttaatatatgtgctgctgaagcaagcactctaaatttattgaaacttttttcataataaattgaccttagttactataagcttgttactttataaattttaatttttaaaatcttttactgttttgtgataacacctagcttaaaacacaaatatattatacagctgtacaaatataatttctttatagccttattcttctctactgtccctattccataatcttttttttattaaaatttgttttgcacttcttaagcttttttgttttgtactttttaagcttttttgttaaaaatgaagacagaaacgtacacattagcctaggtctacatagggtcagcatcatccatatcactgtctaccacctccatccacatcttgtcccactagaaggtcttcaggggaagtaacacgca

SEQ ID NO: 13018 - DNA, 1086 bp, Homo sapiens
ttctctgcttgtgttttgaggtgttcgtctcctcctccttgcagctctgcttggtgactgtgatgcctgctactctagttctcctcctgccccttcagtctctgtgccagttcctcttcctcctcctacccgctgaaacagcgtcttcctcagaatactgtttccagcagttcccatggcctcacctatcacctcatctgcactcactccagacatcttgagagtcaagacctgaagtcctgtctgttagtacatatttaatgtggtaggcacttgagtattgaatgaaaactcaggcaccttcctctcactaggtctgcacacctgccctggccccagagcacacagataggcttacccgcttctacggtgtgattgggtcaggctgttggagaagcagagagaagatttgttgtggaaggggtgccatggagacagatcttgaagatctcaaggattttgagagggtgacatgggaaaaaaaggccttctgcatgggtggaactgcctaaaactaggttaggcaacaggaggcacttccagagcccagcaggtggtcctgggagcactggtagagatggacaggaggaaaaggattctttcctccccctgctgttctcaaaacaccaagcactgtaaccggcacattataagtgctctttaaggttttgagagaagttgaaagtcaaggtgtgtgggctgagagccctggggggccaggctgaggagcttgacacataatccaggaagggacaggagccactgagcattgttgaggagggcagtgactgactggggaggaccttcaggaagctttgtctggcatgtgggcgctggatggataggagagtagaaaagtggacaagtgagtacactgagggggaagtgacggagctctgaggaaggggagttgcaggggaaatggacaggagggaatgactccagtgagctgggggcacaagggaaagtaggtgagggtgggggagagagatgacaaaggccagtgttggaggaactgggagaacggaggcattgttgacacaggcggtggccatgttgtttgtactgggggcctggtgagcagat

SEQ ID NO: 13019 - DNA, 1027 bp, Homo sapiens
agatagacatcatgagcctctggcttaggtgcccaagaactgtactcaggacaagccgatttcaggaattcgacttgaacacagatgtgatcacagtggtatcaagagtagatattttaaaggtgctatccccgtttctctattaaacctcagttaggcttttagttgtctcagatagaggtgtaagactttaatttcatttcatttttaattttaaaaggtcagcgtttttgttgaaactagattgctgcacttaaaagtatggggtaagggaattaagagatgaaaagacagctcttgccaaggttatttgatgaaataaaaggaggccaccagaggaggtgagaggacagcactgttctggtctctgctttcagttctgcgtgttaagtgagatcatgtggtatttgtctctctgtgcctggctcatttcactcagcataatatcctccagctttatcagtgttgctgcaaatgacaggacatccttttcatgactgaatagtactccgttgtgtgtgtatacaccacattttctttatccattcatccattcagggacacttaggtcaattgcgtatcttggctactgtgaatagtgctgccatgaacaagggggtgtagacgtctttttgaggtgttgatttcgtttttttggatatatacccagtattgggattgctgtatcatatggtagttctatatttagttttctgaggcgcctccatgctgttttccacaggggctgtactaattcacaatcctgccagtagtgtgtgagggtctcctttcttgcacatccttaccaccgcttgtaacctctggtctttttgataataaccatcctaacaggtgtgaggtggtatctcactgtgagtttgatttgcatttccctgagaattttgatgttgagcacctttttcatatatctcttggccatttgtgtgtcttctttgaaaaaatgttcagttcctttgtacattttgtgattgagttatttgtttattgagggctttgtttgtttttg

SEQ ID NO: 13020 - DNA, 1054 bp, Homo sapiens
tatgcgtgtgaggtgcttgcaagagctgccacttcctggtacctcctcacagattttgctttctttttgcagccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacggtgagtctcagagtccctttcctttcagagctgctatgggcccatctgaccgtttccagctaacctgaggcagcaggttctgcaccttcgcgcctcccttgggccagggcgcgtttgtctgggagtgaggacggctcatctcaggagaatggtgcatcatttgctgtctggggtagatgctctgtgtgccaggctggtggctctaagtttgagaagtttgcccctcctgtggtgtccgtgtacatacattcctgcatgtggagatccctaaagaaccgagacccaggctagaaatccgagatcaacacgtcagcagggtcagtttcttctgagggctgtgagggagggtctgctccaggctgctttccttgcgtctggtgccctcagtgttccttggcctgtaggagcattgcctcatctctgccttcatgttcacatggcattctcccctgtgtctgtctgtgttcagatttcccctttttataaagacaccaggcttactgcatgtgggcccaacttagtgacctcatcttaatgtgattatctacctaagactatttccaaataaggtcacactcatgggtactgggggttaggacttcaccatcttttggggggacacaattcaatcaaaaacgtataccatgtttgtaacaatatgcaacgtgtacccatatggcagaagattttgaaagaacaggcagaaataacagtagcattgttagggtggtaggaatgtagagcacttctcctcccaccccgtacctgtgtacacacagcctttccctgctttctgtaacactggtttttgttgttatgttaaaaatgttttaattt

SEQ ID NO: 13021 - DNA, 1042 bp, Homo sapiens
aactctggattctgcctgtcaataagaaagcaagtaaaaagtgtcacagatgtgtgaaattggtccttgtttataccggagtttaccatgagaatgaagagttcatctcaaaaaaaaaaaaaaaaaaaaggccaggcacggtggctcatgtctgtaatcccagcactttgggaggctgaggtcggcagatcacttgagcccacaagtttgagaccagcctggccaacatggcaaaaccccatctctactaaaaatacaaaaaaattagccaagagttgtcgtgcgttcctgtagtaccagctactcaggaggctgagatgggaggattgcttgagcctgggaggcagaggttgcagcgggccaagatcgcaccactgcacccagcctgggcaacagagtgagacctcctctccgctaaaaaaaaagagagactgaaaagttagagatatgagtgaggaataagatacttaaattttgaaaataaatgtcttagtgataaatccagcatgctacatttccccttttaccacaagaacaaacaaaggactattttaaaagaaatgctgagttctaaacagaacactttctaccacagaaacaggtcctcttccccgtacgatcaaggttactgctcttccactactcaggtccacgtcaggagctttgtcagggcaggaaattcataaaaggagagcatatcctagctagccactggggagcaaggttagcatccttggggtggaccatccatatgggtaagctgtagttttgataagaatctgcaggctgcccgtgagcatctcgtctcatgcctggccttgtgcactctgagctgggtgctgggcctcccaagaacccctggggcccaacaggcacgtgcaagtgaccctgcaggaatgctgctacctccttgctaagcccaagagaacggggaagaccacagctcccaaaggtcttagggagtcttatgggggctcttcttgtgaacagatcagtgcatctttctgctgctgtctgcagggagggggcagagcaaggggct

SEQ ID NO: 13022 - DNA, 1058 bp, Homo sapiens
actgcctagtggctcccaggaggacgccatgtcagggagggcgggtttatgggttgtctgccatcttatgctgtcctgtcctgttctcctgtcagtgtgagttgaagccgagcctgagacaggctcatagcaggatcgctttgctggcagacacacctggctttgaatccagccccgcaacttggggaaagttacttaacatctttgagccacggtttcctccttcataaccagacagcaacactccaagatgcttgtgaggctctcaagaggatttattccagcgctgagcgcagtgcctggcgcacattaagatgccaggaagccggatgggtgattgctcaggtctgtccagccagttgggcagccgtcagaaactgggagggctgacgagacaccagcccagagagctgtcagggagcggcagagcagaggagagggcccaggatggatcggcaggtgtcagccaggatggacgggaggagccgtgctcagagccagcagccccaggacgagcagctcctggctaggaacagaagacaggcactgtgggacaagtcaaaggtaaaacctaagagctcaccgcaagatacaaagaagcccagagccaacgacgccccagctctgaactggagacgggacagaggctgagttttgagagcaggagggagtggagctgctggcttggttgtggggtctggagccaatggggtgttggctgcccagggtgcagggccctaagttgaatactgatgtgaagctatacattaagagaatgattcttcaaagctccttagacattaataacagattattagtgagagttaatatgtcagtttctaggattccttttgatcttattgttgtccacatgtttaaaagattgaaaaatactatttgtgaagaatggcttgaaagtctagattagatatactagtgacttttccaacactaacagtttacattctggaacatgaaacatatttcatactttaattcagtcacccaacactgactattaagcatgttccttgtccttgagaaagtcatagctagga

SEQ ID NO: 13023 - DNA, 1006 bp, Homo sapiens
ttatggttattatccacattttcatcaacgctctaaggaaagatgtctaattactggctggcgaatggcagagctggaggcacccatgtatttctccctccaaatctggtgttcctttggccaccctgcagctttagctttttttttaggaaatcattctggaagatacctccagcttttggcattcttgagcagaacgtgtggagcataactccttagtgagtcagcgtctttactgagatggccagtgatgtgtatcgttgggcgctaaggagatgggcaaaatcacctgctcccgtggccaggggatggaggagccacatctgttcctgactttttaattgttaacgatctcaagatcatgctatgttctcttcaattgctgtaaagtgtaaagttagatgcaaaacttactcgaattgtgaataaagtatgaatgatccacactggagggagatgtgagggacttccaatagcatatgtgcataactttagtaggcttggctctgtgacatctagtacggctgccagaaaccatttttggagcaaatatttcagaattcaagtttgctagataactgacctgctgctaagtgagcagctagtacttttttaaaaaggggcctgcctgcctgcctgccttcctccctccctccctcccttttttcttgcattttgctcttgttgcccaggctggagtgcagtgatgtaatctcggctcactgcacctccgccttccaggttcaagcaattctcctgcctcagcctcccaagtagctgggattacagacatgtgccaccacatctggcttttttttttttttttttgagacagagttttgctcttgttcccagactggagtgcaatggcacgatctccgctcactgcaacctccaccacctgagttcaagtgattctccagcctcagcctcccgagtagctgggattacaggagcccaccaccacgcctggctaatttttgtatttttagtagagatggggttt

SEQ ID NO: 13024 - DNA, 1050 bp, Homo sapiens
gatgttataaagggcaagccagtacgcatcatgtggtctcagcgtgatccatcacttcgaaaaagtggagtgggcaacatattcgttaaaaatctggataagtccattaataataaagcactgtatgatacagtttctgcttttggtaacatcctttcgtgtaacgtggtttgtgatgaaaatggttccaagggttatggatttgtacactttgagacacacgaagcagctgaaagagctattaaaaaaatgaacggaatgctcctaaatggtcgcaaagtatttgttggacaatttaagtctcgtaaagaacgagaagctgaacttggagctagggcaaaagagttccccaatgtttacatcaagaattttggagaagacatggatgatgagcgccttaaggatctctttggcaagttcgggcccgccttaagtgtgaaagtaatgaccgatgaaagtggaaaatccaaaggatttggatttgtaagctttgaaaggcatgaagatgcacagaaagctgtagatgagatgaatggaaaggagctcaatggaaaacaaatttacgttggtcgagctcagaaaaaagtggaacggcagacggaacttaagcgcacatttgaacagatgaagcaagataggatcaccagataccaggttgttaatctttatgtgaaaaatcttgatgatggtattgatgatgaacgtctccggaaagcgttttctccatttggtacaatcactagtgcaaaggttatgatggaaggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggcttacctcactaacgagtatatgcagagaatggcaagtgtacgagctgtgcccaaccagcgagcacctccttcaggttacttcatgacagctgtcccacagactcagaaccatgctgcatactatcctcctagccaaattgctcga

SEQ ID NO: 13025 - DNA, 1044 bp, Homo sapiens
ttaggcatagaatgaacattgaatgaatgaatgaaattatagcatactgtggagttttatgatagataattccgatttcattgcagcatttgcggttttggatatgacggtgttttaataactttgtggtttttaaccagcttttcaagcttttgtgccacatgggaccttatctgtttttgttaaaaaaaacaaaaacacttttttacagtgtttattagtggtaattttctgcagtatgtgcagattagtatatctgatgcgagaatgttgtgttgtaataactcaatttgtcttttacttaaattacaaaacgtaggtagcatgttccttgtttttgtgcaacccattagttcaggtggcgacaaaaacataactatccagaaagaaacaaagtggtgagacattttaatgagagatttaagctttagaactcaattttttttaagataaaggtggaggggttcataaagttaaggagtgtgcacactgtcaacaagatacttcctgaagcttaaaagatgtggctgtagatttaaaaggcaaatacttaagcatgacctgcagtttaaaaagggagggaggaggaaccacggactacacagtcaattcagaaatttgaattttcatccatacctccgttattcttactctactcgctcaacaacaggttctgataatgttacttctgccatttctgtttgtctttatttccagttccacaaccctgcttaggctattgtcattcgtggaacaaatatttattggacagattcccatgtgcaaggctctgttttaggtattaagagtcttgctctcttgatccttacattcttatgaaaataattttgattcttgtcagatttttaaccagctgtctttcttgttttagatgaaaactactccaatcaacttcttcaatctgttctgccacattttagccagagtaattgaaaaacaaaattcccattgctctctctttaatcattacccgccatcgttagaatgaagtttaaaaaagaaaaaaaaacttaccatagtctg

SEQ ID NO: 13026 - DNA, 1033 bp, Homo sapiens
cctaatgataacagtcataacaacatttattgaagttaattcatcctgtgctctgaacccttatatttaaaaaaaaattctgctggccgggtgcggtggctcacgcctgtaatcccagcactttgggaggccgaggcaggtggatcacgaggtcaggagattgagaccatcctggctaacatggtgaaaccctgtctctagtaaaaatacaaaaaattagctgggtgtggtggcaggcacctatagtctgagctactccggaggctgaggtaggagaatggggtgaacccgggagccggagcttgcggagtgccactgcactccagcctgggcaacagagtgagactccgtctcaaaaaaaaaaaaaaaaaaaaaatctgctaagtgggtactgttaattcctgttttgcagatgaggaaatagaggctcagaaaggttaagtaatggcacacaagtaccagaacatggggggattggtactggaacccagccacactactgctgccagggcttttgagactttaaaaatgacattgggttctcccatggtgattattctttatggaagggcagcaaaggaaataataaagataaatatgtaggataaagagaatttgccattatgctgtatagtctcccttaaatctcctacataattttggaagtgtcaacttgtcaaaatttgcttattttcacagtttgtcttcccaccttttcatagcaaatctgaacccctgagtcttgataagagtagttgaaaagttgtgaagtttgttcactttcacttgtttttatcagctgttctttttttaagctttgcactgtgctctgaagagtttctgttaatgaatacatgatcctgagacagggtgattttgctttgcgtttaacttttgccaggaaatgtccccactagtttttctatgctttttttggtggtaaaatacctaagtctatactctccccaacaccacattgccccatgaatgtggtaatgtagcaatggaaagctagtgaagataatttaaaata

SEQ ID NO: 13027 - DNA, 1049 bp, Homo sapiens
ctcccaaagtgctgggattacaggcttgagccacaccaagcctgagtcttgttttctgaggttgtaaccccatacgtgatttcaaagcactgcactctggcaggaacttctagttgtgatcagggcaatccagaagcatagtttctggcttcttttctctcagtgatttcaggttaagtcatgcaggtcattcatacatttctttatttaatattgtttgagcagttactacttcctaaccatgcagccttgtgtctacataatgccttgaacattgaatattgtggcactgctggtgaggatggtccttgatgatgacattgggaactgctaagggttggagcaagacagtcagtctgttgtgaggtgaaagggataggcaggtatattaacatgttcttgtataatccgataaatgtcctaaaagatgtagaggcaccatgaaaggcagaggaagaaaacagtatggtttactttatgggcaggaagcacttcagagagaggagtggcaagtgcaaaggcccagtcataaaagcgttctgggaaatatgaagtattttggttttggagcttagaaatcagaggtggaaatggtgggcagagttgagaattgaggagcaggttgggaccagataggaaagggaggtatatgtcgtgcctttagactctattttaaagacaatctagagctaataggaaccttaaattgggcagaatcaccaggatatttgtgggggttttttgtttgtgttttctttttgtttttgttttttatgagacggagttttggtcttgttgcacaggctggagtgcaatggcgtgatctcagctcaccacaacctctgcctcccaggttcaaacaattctcctgtctcagcctcccgagtagctgggattacaggcatgcgccaccacgcccagctaattttgtatttttagtagaaacggggtttcaccatgttggccaggctggtctcgaactcctgacctaaggtgatctgcccactttggcttcccaaagtgctgggattacagacgtgagccacggc

SEQ ID NO: 13028 - DNA, 1446 bp, Homo sapiens
caaggagaatatatacaataaatgaaataaatgtcttagatatgacattaaattttataaatatttatgtacacacaaacatgtatataaataacttgggtgtgtttctactatggatctctgattactacatcccagttcccttttatctattgcttatatcaagggattctttttttttaatccaaatgatttctgtgtttctagtagctgtatcagttagcttgggccctgcagtaccagtgtgggatttaaccagatagagagtagcaataaacagcattcagtgaagaggggacagcgtcaagtgagactagagatgagaaggaccttgacccttttgaggaaatgatagaaggccagattagccatagagcagaaagatgaggttccagaagtcatggagtccttatttgccatgttgagttttgtcattatattaatacctcaggcaatttgggtctattaaagggatttgatgagatttgtattttaagattaagagcattctgacagccatatggaaaatagcattcaggaaggcaagaattgtcatggagaactgttaggaagcttttgtagagctccacgtgtattactgaggcaaagctaggtagattaattgggggtccatggtaatcagggatccatggtagaaacaggctcaagttttttttatatacatgtttgtgtgtatgtaagtatttacaaaatataataaaatgtcatatcaaagaaataatatgctagtcaatttaaaagttggtgaattatttggagaaacataaaatgaaatccttatttttatttccatgtctcataaaatctaggacgtctatagaagataggtggcaattttagagatactaaatatgaaagaaaaaaatcttaataaaatacaaaacatggaaacataaattacagttggatgaaagaggtaaaaaagtaaaaccccatgtgcagaggtaaaaggtaaatgaggaaagtaaaatgcttgatttttttttttttttttttttgggatacagtgacttgctgtgtcatgcaggttggaatgcagtggtgtgatcttacctcactgcaacctccacctccctggctcaagtgattgtcctacgttaacctcctaagtagctgggaccacaagtacgcagcaccacgcctagctaatttttaaaaaattttttggccaggcgcagtggctcacgcctgtaatcccagcactttgggaggccggggcaggtgggtcatgaggtcaggagatcaagaccagcctggccaagatggtaaaaccccgtctctactaaaaatgcaaaagctagccgggcacagtggcaggcacctgtaatcccagctactcgggaagctgaggcaggagaattgcttgaacctgggcagcagaggttgcagtgagctgagatcacgccactgcactccagcctgggc

SEQ ID NO: 13029 - DNA, 1049 bp, Homo sapiens
aggaaaccaaagatacattttttaaaactcagttttaaatatattttttaggaaatttgtgaaggagcagaaacaagttcaagaagaaattagtagaatgtcttcaaaagcaatgcttaaggtacaagaagatattaaagctctgaagcagctcctgtcgttggctgccaatggaatacagagaaacactctcaacattgacaaattgaaaatagaaactgctcaggtataccaacttatggccattttaccgtagggtttttttgttttgttttttccaaaatggaaataaggtgttttgttttgtttgtttttaattatgaaatttgatacatgcataccggtagaaaaccagataactcatatactttaataatgagtttttattaagcgttttctgtatacaagacagtatcctaagcaatttatatctgttaaaagcattaagtatttctgaaaagacccaacaaggtaggaattattatccccattatataaataagaaaaaaagcacagagctttgttagtaagttgaagggcctggattcagaccctggtaatccaactccagagtttatgctgttaactaactaggtttcgtaagtgtggttgctggctaaattggcctattatataagaggaaacatagctagtcagaaaataatgttttttaactgtcggtttttaaataaaaattatatcatgctgtgtggatattaaatttgatgacttgcaagtcgtggttaaatcttagtttaaaaatagtaggccggccctagtggcccaatcctataatcccagcacttttggaagccagggcaggtaaatcacttgatgtcaggagttcgagaccagtctgaccaacatgctgaaatcccgtctctactaaaaatacaataattagccaggcgtggtggtgcatgcctataatcccagctattccggaggctgaggcaggagaatcgcttgaacctgggaggcggaggttgcagtgagccaagattgcaccattgtactccagcctgggcaacaagagcaaaactccgtct

SEQ ID NO: 13030 - DNA, 1059 bp, Homo sapiens
tgcattgggtaaaagcagctcactttatgaacttgggaatttttcttactctggagttacaaacactttttttctttgaggcgggtggttgggttcataactttaacatgaatcaagtctcattgtacaatggtcaaataatagcaataaagtagaagccctcatcataccctccaaccactgctgaggtgcaacaccttattttagcatgtgttacccaggccttctaaaaaatgtatttaaaagtatgtatatttagtgctgacttttttttctttcttttttttttaaactgttttaatcaaaaggctatgaaaaggttggacatttgaggggaaagtttcttgaaaaactggaatatttatttttaaattcttttcatccatccatctgcacattgatggagtatttaaatattactctgtctaaaagcttagctgatttattttaaacaaggcctcacaaagacagtattttaggaagcatattgtaaagatagggagtaaactattcaagggagcagtagaactcttgaactcatcatttcctacaccaaagtgcattattagcactctaatttgcagtttggattgaatgtataatattgggactgtctttggtaatttatggttatattcatccacatattaaccatagtcaatgtgaaacttcatttagccgttttgtttattattcttttaggttctgaaagaacagtaccttggctacaggaaaatgttcttgggagatgctgttgatgtgtttgaaacaaggcgagcagaagccaagaagtggcagaacacacccagagttactactggacccactcctttcagcaccatgccaaacgcagcagccgttgccatggctgcaacacttacacagcagcaacagcctgctacaggtctgaacgcattcaagttatagcttcttactgttccaatgcagaacatttatgtgcgtttttataagtcttccatttgtgtgagcactgaagaaatttctatgagtagctgttccaatacaatctaaaattgtgatggacacgattataaacat

SEQ ID NO: 13031 - DNA, 1066 bp, Homo sapiens
atgctataaatgccctttagaacatggtgtttcactagtgaattacatttaagaataacattagattctgaaatcatgactgtaccatttattgttttaaagtcagagatcatccatccattctttgaatttttcatatatgatactgataggtggtgcattctcattttcctcatacatagtgattacaaagtacccacattcaggatgaagtatgcttttattgactgaaggtatgttgaagatcaataggcttgtttgtatgtatgttgactgtaaacagaatacaagccctctaaaccaaattttgaagatgatacatgctagaattgtacctttccaaggtgaacagaacagcaagagcaggaaaaagatgttttgagatgtggattgcacattaaggagcaactgggaagttgaacagatgaaaataattggtgacatggaaagcagattgttttatttcttggtttagttacacttctaattagagaaacattttttgtggtcattctacagtgttttatttggtcctgtgtctttcggaggttaatagttatcttaatcctgccatcccttttgtcaggtttgaagcttgacatggaaaaatagtcttaatcgatattgatttttttattttaatcattcataaatttcttagtaatgcttactattcaatagcatgtgtctttctgagagttccatatagtccagtagtacattataatacacacaaaaaaattaatacatatttagattgcattcaagctacctatactagggaagcattctctggttttcactattggcagtttaaaaaattgttcttcacatttggagatgacagaattgacttgccataagtaaagggttgatgatagatttatgccaaatcctccatatcccgtggctggacccatgtgaatagtggctcgcacgagcactgtctggtagctctctagctggctggagtgtaggattgcattgttaagttatggagggaaaaagtcattatgggattgattcctttgaggattgatatttcttcttaaaaggattcaatccc

SEQ ID NO: 13032 - DNA, 1048 bp, Homo sapiens
aaggtctcccaggccttcccagtcaaaattttcgttatttttagtcatgtcaccatgatgtgagatttctgagctctgttagatacatttagaaatgtccctatttatcaaatggtgttttgtaccccataagttatcccttatgccctgtgacttctgtgaaatctttgtttttaagtgccagtaacaaattttagaccatctagatgagggtagagagagcttatgcattgtttttatacatcactgttgatctatacaagatttgagttatcagaagggttttgcttttatttgcatatgaaatttttattaacatgaatatgggcacagagcaaatagcttcttagactgctgccttctgaaggtggcttctgtatctttctcagaggaggaggaatagacttaaacgacttctttgtcctccttcaattttttttttaatgaaaaagtatactagggcttaggcatgtgtgatttacagttatttgttctgaaggctgcagagaattgaaaatccagcaggctatttgtgtatgaaatcatgagcatcgataacgtggataacgtagttccatgttggcagaacttgacacttgtctataagtgcttcccaagcctcctgaaaaactgaagacatttacattaggcttttcagtataattttaatttaggataggttttttagcaatgtatctgggattgagttttgctattgtgttttgacactttaagagttcttgatgtttacataataagactttcttatgtgacttagctgctgttttaaggagagccaagacgttttgttaggaattcctaatttttagcttagtgtaggtttggacatttaaggtgtagtgttaaataggaaacattaagtatttcatcttagtttcttgtggttttgtgattttgttgtatttaataaccaaaggaacattccccattaaatcagtaagagtaaaatttttcaaactggggaaaacgcattttaggttttttaaagaaaaattattttaaaatgtgacttagaaataaccatact

SEQ ID NO: 13033 - DNA, 1124 bp, Homo sapiens
tttaaattatttttttaatagtagtataagaattctggctgctattagttattgtttgttttctgggttagaagctattcgaaaagtccagtttctgtcccagtgtagcaaaatgtagttcctcggttgtttttctttaaatgctttataattttacactacctttttaatatacaaacctcattcttcattggataacttgaaggctttgatttctttaaaaatttaaattttagtgtgtatattactttgacagttccctcatctttgagatgcactgatcactgtgcttgaaaaagacaatactgaagattgtactatgaagtttattgaataattttcataaattatttatccaaatgagagatttttagatttttgtattctgcttagttttaaaaaaaaaaaatagtagtttaaaagagaggctagtaagtttgatgctattcttgccaaacaaactcagccaaaatctttaaagtaacaagagggaaaaggatgactaatcgttctgcttctgagtacattttccaaaacgttggaaagaaacttctgaattgaaatcttgaatgtattgaatctgtcaaggtacacagcggtgcctttgtaaatgttcattactttatttaatcaggtgataagtggtgtaatgtagcagagcttaagaatagaactcaattatcactttttgtgaacaagttggaattgtcatgttactgtgtaattgatttgctttacaatgaacaataaatttaataaaataaaacattgtcttgttttttatctacttattgtatatatcatttatatttcatatgagaaatcatgcctagttttttgggtacttactcttatgaaataacatgatagttttgccatgttagtgtcagtctctcttgatcaattgagacttgactctaacactaaggagctcgattaaaaaaagtaaaaaccatttactgattataccaactagttttatcagaaaacaagtgaggagatctaaaataattctagaagtaaatctaaaggaatgataatttatgatacattaaagatttcaaattatttagtagattaaactaacgtctttcattgcggtaagcctcttttaattgtctagt

SEQ ID NO: 13034 - DNA, 1024 bp, Homo sapiens
cttatagggctattgatattgacaccaaatggagtggcttctcagcctcttaatgtcttaagtaagtgcttaatttggaatagagaaaccagtatattttaaaaaagaaaaatattctttgtagcaactgtaaattctcccattataacagtgaacagagctccaggtaataacgcataggcatgtcaggttgcatctgtatatttgactacattagtattagtgacatcaggtggatataaaagaaaacccttggaaagagaactgccttagccatgatttcgttagtagacctatttatgattcaattgcaattttcagataggatgtgaacatggaatttcattgaaaatagtttaattttttatataaaaggttttgtatataatgtgtgtcagtgactattttcaaaatcattttcatcaagacaccttttttctaaaataggcattgcatacacatatgcacacgtatgtgcatgtgccacacattttttgtataatgttgggtttgattataaaagtgttgtcaaatgttttatttatctgcatatagcagtggttggcttttttgaattgaaatttttgcgcattgatgcattgaaataaggaaaattatttatctctgagcactaaacttatttttgcatatttctgtaatattgcagtccccagatccagaacatgggaagttagggaaaatgtgtgattttgtgttttgaattactgtcagaattacatacacaattacaacaaactttttttaaaagacatttcattgtactgcaaaaatctgaatatttatatttcttgtttttttctttatatgttttgcattttaatatgttgagccactggaaatttgtaacagattaatttgttataggagtttaaatgtgttgtcattgtctccattgtctttgtccagagcctattattatggaaacaataaaatttattgtgtcagttgctttgattctttataggtgtcagtagctgttcttaatatgtaattttattattgc

SEQ ID NO: 13035 - DNA, 1089 bp, Homo sapiens
ctttcctttaaggttgaataatgtttcattgtatgtatagaccacattttgcttatccatttatccacggataagcaaaccaacttgggttgcttccacgttgtagctgctgtgaatagtgctgctataaacatgggtgtacaaatatatctttgaaccctgctttccattcttttgggtacatatatactcagaagtgaaattgctggatcagaagataactctacttttaattttttaaggaactgccatactgttttccatagcagctgcaccattttatattcccaccaacagtgctcaaaggttccactctcaccacatactccacaacacttgttattttctgtttgtttttctttttgacagagtcttgctctgtcacccacgttgaagtgcagtggtgcaattatggctcgctgtagcctcaaactcctgggctcatgtgatctccctgcctcagcctcctgagtagctgggactatgggtgcacaccaccgtacctgcctaattaaaataatttttttgtagagataggaggagtcttgctatgtcgtccaggctgttcttgaacttctaggctcaagtgatcctccagcctcggcgtcccaaagtgctgcgggtgtgaggtggtatctcattgtacttttgatttgcatttccctgagtattagttcatgttgagcatcttttcatgtgctttttggccatttacttgcatatcttctttggaaaaatgtctatgccagtcccttgcccattttaaaatctactgtgaaatatttgaccattcaagtactgtgacagagcaagactctgtcaatttgttgttgttgttgatactttttaggagttctctgtatagtctagatactaatcctttatcagatgtgggatttgcaaatattttctctcattccgtggttgcctttttcctctgtttatagtattaatagttgcacaattttttgaactttgatgaagtccaatttgtctatttttcttttgttgactgtgccttttgtatcatatctaagaaatcattgccaaattcaatagactgttttttacggtttaatttcatcctta

SEQ ID NO: 13036 - DNA, 1056 bp, Homo sapiens
tgggtgacagaatgagactctgtctcaaaaaaaaaaaaaaaaaaattttaaaaagagtatctggctgctggagtgagcagagactaaagctgaagggaggcaaaggcatggaggcaggagcccacctagtagctggggatgctgatccaggcagaagatgatgggggtgttggagtggaggttgtggtattggtgatgggaggtggtgagattctgggcatatagtattttgatagtaaagctgacagggtttgctgatgtattggatgtgggatagaagaaggttaagacccgaggggtttggatctgagcaattggaaggatcaggttgccatttctgagaagaggaagaccataggaggagcaggtaaggtgggggaataaggaatcttttttgggcattttaaggttgagataactcttagatatccttagggcagttgaatatgtgtgtttgggaaatcaggggaaaggtctattatggagaaaaatactgagtaatagtctgtgtagtgttttcaattctgtgaggctgaatcaggtcaccaggattgataagagatagcaaatctcaagaattcagctcttgtgggtggtggggtggggggtacttcattgtttaaaagtttgagagaggagaggcagcaaaggagatcaagaaaatatggccattgaggtaagtagagaagcaagagagtttgagaaaatatggacattgaggtaagtagagaagcaagagggtttggcattttggaaaccaactggaacaaagtctttcaagaagaagggaaggaactgctgtattaaatgctgctaatgggttcagtgaaatgaggtctgagaaataattattggatttagcagcgtggaggtcatgggtgacttgtcaggagctgtctggggcattatggagatgaatgcttgattggagtgagtgcaaggaattgggtggagaacaactggagaaaacaaaagaagtttacagtgagttttgctgaaacttcttgtaggtcttaggttagcatggtaatggatttccctatcatggtgagcaaa

SEQ ID NO: 13037 - DNA, 1018 bp, Homo sapiens
ttataagttgaaaataacgtttagtactctgataaaccgattgttaagtcaaaaaatcgtaagttaaaccatcaaagtcagtgaccatctgtagttgcaacacaaaccgcatggcccacaaattgtaacatatttactatctggttctttaccaaaagtttagtgaccccctgccctgtgtaatcagatggaaactgactcaattccagttccattgccagctgtagctatatttctgaaacagtgtttttaaaaatgttaacaagcatttttgggagaattggatctatggctaatttgagaagatgcagagttgtaaataatgaagtagattcatctactacactttttacacaatctttaatccccttatttcactataaatcatgcagaggtttattatatagaatattttgttaaccaaatttatttgaccagtgattttcttttttggtaactcttgttataagggacacagacttagaaatgctgctttttaaaaatagtgagttttcctcttaatagatgatagtaaaataagaagcatgtgaaagagaatcctcagagtaggacaaaggagaaacggattgaattagtctattttgtgttgctataaagggaatacctgtgcttgggtaatttataagccaaagaggcttatttggcttatggttctgggactatacaagaagcatggcaccagcatcaacttggcttttggtgaaggcttttgtgctgtgtaaaaacctgtagataaggtcaaagagggaacaggtatgccaagagggcctgaaccccacaatggggagcaaatctccacatgagatttggggtgacaaagcatatccaaaccatagcgtgcatatttaatttctgggtttcattaaagcaacagatatttgagtacttttaataggtctggcagtttgcccaggttgtagacataggattacatgacagtatgttctctactctcaagtttctgtttgtgctgttataaatttgagcagtcatcatt

SEQ ID NO: 13038 - DNA, 1099 bp, Homo sapiens
ttatggaatggaaaaaggggaatttgttctttctacaaatggtttcaacatgtcctaaatgacaatttggtggagttgttgtggaagaaattcaagtagtggattgatgtttgaattgggtgacttgtatggtcctgccagttctgagattttatgataaagtgtcaggaatcactatttcttagagaacatcagcctgaatgggcaataaatccagaaaaagtacaagaaattttgctaaaatgtggagatggctgttttgcctttaaaagttgatgaaccatagcctcattttacatttttaaaataatgctctttaaaaatgaaatggtcatgaaagaaatatagacagtgtagaagggcatgagctagaaagtaatagtgctctaatcctccgaccaccgtttccctttccatctagtagtgagggaaagggtggtgttgagaattagtctttgttttttggcttgaataattgactccacagtggcagtgccattaactgagagatgggataaaacttgcaagaacaggaagctatgcggagcaagcttcctgaactgtcttacattgtttgtctgattgaattatttaggccttgaattctgtttgtgctctagtgacattttgtcttcaaagatgttaaattattccaaaagtaatagacactgacttggagaggtttttattggccagatttgggataatttgaacattagacagaatatacagttgaccctgtgtatctgtgggttccatatatgcaggttaagccaaccacagattgaaagtgttctgtagttgtgtccgtactgaacagttacagacttttttcttttcattttcccctaaacaacataacaattatttacatagtatttacattgtattaggtatcataagtaatcaaaagacgatttaaagtatatgagatggtgtgtgtaggtttcatgcagataccacgtcattttatgtaagggacttgagcatctgtgcattttggtatctgctgggaggtcctggagccagtgtgtcccatagatattgaagagggctgtgtattataatttgtcctataacgaacccgtgaatccatctc

SEQ ID NO: 13039 - DNA, 1005 bp, Homo sapiens
agccaaatacttacagccaactgatctttgacaaagcaaacaaaaacattaaatggggaaaggacatcccattcaataaatggtgctgggataattggcaagccacatgtagaagaatgaaactggatcctcatctctcaccttatacaaaaatcaactcaagatggagtaaagacttaaatctaagatctgaaattataaaaattctagaagataacatcggaaaaacccttctgggcattggctcagataaggacttcatgaccaagaatccaaaaacaaatgcagcaaaaacgaagataagtagattattaaacgaaaaagcttctgcacagtaaaagaaataatcagcagagtaaacagacaacccacagagtgggaaaaacaatattctcaactgtgcatctgacaaaggactaatacccagaatctacaaggaactcaaatcagcaagataaaaaacaatcccatcaaaaagtgggcaagggacatgaatagacagttctcaaaagaaaatatacaaatggccaacagacatatgaaaaaatgctcaatatcactaattatcagggaaatgcaaatcaaaaccataaggagataccaccttactcctggaagaatggccgtaatttaaaaaatcaagaaacaacagatgttggtgtagatgtggtaaaaagggaacacttttacactgctggtgggaaagtaaaccactatggaaaacagtatggagattccttaaagaactaaaatagaactaccatttgatccagcaatcccagtactgggtatctactcagaggaaaagaagtcattatttgaaaaagacacttgcacacacatttatagcagcacacttcacagttgcaaaaaaatggagcccacttaaatgcccatcaacaaacaagtggataaagaaaatgtagtgtctatatgtatatatacagctctgtcgcccaggctggagtgcagtggtgcgatctcggctcactgcaacctccaaca

SEQ ID NO: 13040 - DNA, 1026 bp, Homo sapiens
gtgcaacttaatttatcactttatgagcagtgagctttttgtactatttaggaaattgttacctactgtaaggttacagttttttacatttagagttttttacatttagagttactgtacatttggtattgatttttgcatgttggttttaggggtcaagatttattttacattttgtcttaattactatagccttgtaataattctaattcataataaatataataggtaatataaatcttccaatttgttatttaaaatcaccctagtcatttatttcttatttttttttttagaatttgcttataaatttctaccccaccccaccccccacaaacacacacataaacacactactaggattttgcttggggttgctttgaatctgttgataatttggggagaattaacatctttccaatactgaaacctaccaacccatgaacatggtataacccccatttatttaggactttcatttctccaagcttctgtaagttttttgggttgattttagacagaatctcactctgtcacccaggctggagtgcagtggcgtgatctcggctcactgcaacctctgcctcctgggttcatctgattctcctgcctcagcctcctgggactataggcacgtgccactgcacctggctaattttgtacttaaggtagagatggggtttcactatggtctcgaattcctgacctcagatgatcctcccacctcagcttcccaaagtgctgggtttacaggcgtgagctgctgcatccagactaagcttctgtagttttttttttttttttttttttttgagacagtcttgctctgtggccaggccggaatgcagtggtgtgatctcggcttactgcaacctctgccttccgggttcaagcagttcttctgcctcagccttccaagtagctgggactacaggcgcatgccaccatgcccagctaatttttgtatttttagtagagatggagtttcaccatgttggccaggatggtctcaatctcctgacctcg

SEQ ID NO: 13041 - DNA, 1049 bp, Homo sapiens
tttcaaaccttgtatttaatttttatttctgctttcatatgtatatataatttgtcatctgaatgttctttttcataaccttacttatatttcatggatgcagtagcttacctctttgtgataatagttttaattgacaaataaaaattgtgtatattggctgggcatggtggctcacgcctgtaatcggagcactttgggcggccaaggcgggtggattgcctgagctcaggagttcatgaccagcctgggcaacacagtgaaaccccatctctactaaaatacaaaaaaaattagctggccatggcggtgtgcacctgtagtctcagctactcgggaggctgaggcaggagaattgcttgaacctgggaggcagaggttgcagtgagccgagattgcatcactgactccagcctgggcaacatagtgagactgtctcaaaaaaaaaaaaaaaaaaaaaaatttgtatatatttatggtgtcaacatggttttgaaatatgtggaacaaatttttgtgatatacagttttaattgataaatattgtatatatttatggtatcaacatgttttgaaatatgtatacattatggactagctatgttgagctaattaaccataagcattaactcacacatatctactctgcaattttcaagtatacgtttactgtagtccatttgttctataatatatattttgaccttatttttcctgcttaattgaaatttggtatacttttgcaaacctctccccaatcactcccctcctcctccagcccctggtaaccaccattctactctctacttttataagttccacatttttaaattctacatataagtgagatcatgtggtatttatctttctggcttatttcacataacaacataatgccctctggtttcatccatgttgttgcaaatgaccagatttccttgtttttaaaggctaaataatattctgcaccttttttttttttcttcagaggtgggatcttgcttggttgcccaggctggaatacagtggcaggatcatagctcactgca

SEQ ID NO: 13042 - DNA, 1024 bp, Homo sapiens
tgtgttgtgaccattttgagagcatctagacaacttcactaactgcagctatgtggcctcatttttttcttcttttcttttttttgagatggagtcatcactctgttgcccaggcttgagtgcaatggcatgatcacagctcacttgaacctctgcctcccaggttcaagtgattctcctgccttagcctcccaagtagctgggattacaggcgtgtaccaccacatccggccaatttttgtatttttagtagagacagagttttgccatgttggccaggctggtctcgaactcctgacctcaagagatctgcccacctcgacctcccaaagtgctgggattacagacataagccattgcacctggcctggcctctttcagtagaactgatttcagtagaacttcaaactattttttataaaacttaaaaaaggaatgcttttctcattcagtttgtgaaataaatttcaaagtcagttaatatttcttttactgggaagaattctgtgataaattaaaaatttgaggcaaagcatgatggcttatgcctgtaatcccagcactttaggaggccaaagtaggaggattgtttgaggccagaagttagagaccagcctgggcaatatagtgagactctgtctctacaaaaagaaaattgaaacacattgtcaaatatgctggtatttgtgaatctaagtgaagactgatatgtagtccagctccaatcttcttttctttccctatcttactccttaagctaattttccagccaactcagaggttgccctgcctgcttgaatcccctcatcccttcatcttcatagctcgaaattaaactctctctagtcaccctagctgaaaatgagaatgtttatatctaaaatcctattacagctactttgaaccacccatgggccacttactagttttggtaatatggtaatctatttgattataaactcctgagggcaaagactgtgtcttactctgtgtttgtatgcctcccactgcctaccaaaataca

SEQ ID NO: 13043 - DNA, 1041 bp, Homo sapiens
tttctttttgtctttcttttcttttccctttttttttttttttttttttttttttttgagacagggtgtcactgtgttgcccaggctagtcttgaactcctgggctcaagagatcgtcctgcctcagccttccaaagtgccgggattacaggcctgagccaccacacacagccattttgtaaattaattttctaatgcacttattattggctgtgttttatgctttttgttgaaagtattcataaagctgtatcagaccataggaatgatttatactaaatcaacatctaagtattaaagacttggttttgatgtattttctaagaaaattaattgaaagtagagtagtagttatatgactggcctagtagccattaatttttgtaaagtacatgtattagagttctccagagaaacagagtcaataggatagataggtagatgtatgtgtggatgatagatgatagatggatggatggatggatggatggatggatggatggatggatggatagatagatgaatgacagagcatttgctagaggaatcggcttatgcaattatggaggctgagaagtcccatgatatgccaactgccagctgaagaaacagggaagctggttgcatggttcagtctaaatccagatgacctgagaatgagggagctgatggcataactctcagtcagaggccaaaggtttgagaagctggggagctactgtacaagtcccagagtccaaaggccagagaatggagagttctgatttccaagagcaggagaagaaaggtatcccagctccagaggaaagagaagttgcctttcctctgcctttttgttccatctgggccctcacctaataagatggtgtccatctatgtacgttacttggaggtggatctttccactttagtctactgtttcaaatgccagtctcttctggaaacaccttcaccgaaatacccagaaataatgctttgccagctatctgggtattctttagtcaagttgacaccttaaatcaaccgtcacagtctatatca

SEQ ID NO: 13044 - DNA, 1061 bp, Homo sapiens
cctctctgttcccaaatagatgtgtgaatttctaaaatcaatttctattctaatttccagtcttttcagatcacagacaggcttgtaattcaggtcagtgtagtttaagatgcctatttaataaaaacatagaagttgggaagatagattgctaatttttaaaaattcatttaacatctgtttatgtaaacatcttgaaccatttgaaataagatcattttttgttttccctaatttcacagactaataggccttaaagttggaaggcatcttagcagcaacagactattccagtctcttagctgccatagtaattcttggtaatatgcggggcagacaaccctgctgacactggtcgaacatttccatcatggctaactttctgtcttattagagtaaacttgttgttacacagctataatccttgaaggtagagtcagaaatttggaattcctaatactcatcctttgggccctctcttccttgattggtcttctcttttttccccccttctggttaacactagatggtaaaatcaaatgtctgaaaaacaaacaaacaaaaaacaaaaacaaatgtctgaaccttgatgctgaagaggggctaagggagatccaaaaataaaaggcagagcaaaataaagaacaacaaaaggagaaattaagaagaaaaataagaaagggttgcacatggtaggaagcgatagaaaatcttgggttatctatccttgaataattttttttttttaatcagcatgggccaaagaggaaaaattaagcccctgttatagtggacctgagatttgtttgaatctttgttctaccacttaattgtgttaccatgggaagcattaacctgtctgtcacttttctcagctataaaatggggccagacctatttgttttttcctttgggtagagattgatgtgaagactggcacataataaatgttcattaagtacatttcacttttcaagttgccctgtgaatattaagtacatgaggattaagagctttatccgttttgtttactgctatatcatcactatccagaatgttac

SEQ ID NO: 13045 - DNA, 1027 bp, Homo sapiens
tcttatgatcagcgtttttgccggttgtcaaatcccttacccaaaacgagaatttttaacggaagaagaacctgatgacaaaggagacaaagtaagtattaaagtactgttagcagcttcttgtttcgtgaatgcctccataacattttccattgtgggtatattttgttctccctctgagctgaactttttctgtttaaccaattgagaagaaccagcagcagcagcagggcaataaccacactaatggaactggccacccagggaatcaagacagcagtcacacacagggacccccgttgaagaaagtgagagttgttcctcctaccactacctcaggtggacttatcatgacctcagactatcaggtattccaagtttattttgtattgactgcatgtcagtgtttacatatgggtttatgatcgtgggaaaatgtgatttaattgagaaatactgacgtctgtatacccagggaaatacattaacatgaaatgttactggcatggaaaagtactgacagtggtatggtagcaagggtttagacttttgaaccagacttggaatgatcaaatacaaattatgccatttattaactgtgtgaccttggacaagtaggataatatctcctggcgttttttcatctgtaaaatgaaactagtaaaacctaacttgcagctgttgtcagattagacatgaagtggcttgacacctagcttatggtaggagcttgatagctattgttttggaacaatgtttcacagtgattaagaacataggctttcagatcccagtctggccacttacttctctgtatccttgagtaagtgattcagatgttctcagtttccatttgtagactggataatgatcaatgtgaagctgtagtaaggattaaatgagataactctgggaggttaagtgttgcagccatttcaggaaactgaggcttgtagaggttaaataactttcacatggatccccagcaagctgtagatgcaggactcatatttgatctgaccacaaa

SEQ ID NO: 13046 - DNA, 1845 bp, Homo sapiens
ccagctcccttctcccagggttctaatgacttcagtgtagtactcatttttcttcatcttgaaagattttcttagttggtattcacaaaagctgtgtcttttcacatgtttaaatattggaaagtttggtcaactattatatttaccttccaacctgtgcttattctagaactatgtacatatagaaattgttcttgcatttccagttggctgacatgaagttgcttaatagcatttgtttttaaaaaatctgtttgctttaaaatttacaacctaatagtcaatgatgtgcttcactatcttcaacaattacgaaaacaaaggtggaacacactttgctaagtggtcatgccaacattgtaacctcctatctcttgtcagtgtgtctttgtagtcacacgttacggttcccatagaaacctatgtatggcaggtaaccttttggttattgggatgttttgattaaaacaattgcgttataatgcaagtattaaatgaattgtccctactcacgggctagtactagtgatcgtctttggaattccaaggactttctttgaagagtactcccagattgtttttcactttgggtggctctccattgctgtagaccttgaatctctttttcttttcttttctttctttctttctttcttttttttttttttttttttttttttgagacggagtcttgctcttgtctcccagactggagtgcagtggtgtgatctcggctcactgcaacctccgcctcctgggttcaagcgattctcctgcctcagactcccgagtagctgggagtacaggcgcccgccaccatgcccggctaatttttgtacttttagtagagatgcagtttcaccatgttggacagattggtctcgaactcctgacctcaggttgatccgcccacctcggcctcccaaaatgctgggattacaggcgtgagccaccgctcccggccgaatctctcaacttctcttctcagtccgttttaagggccctgtttctttcaagtcaggctttttttggctttgctcttgggcatgtggaactaaatgcttctgacagccccacacattcttcttcagggctggttctttacctgtggcttgactttatgctggtaatacagaaatattttatgccagtaatacataaatgatgtacattataaaataaacaatatcaacacagagatttatagaggtaaaaagtcttaagttttctttttcccgtcttattgttgtcctattcctatttctttcttcagaggtaaccataatatagggtgtatccttctggattttttccatttaatactgtagatgaaatatataaccctgtatgttaaaaaaaccatttcatgaatgcctactaggtaccaggtactattttaatcactagggttgcaaaaataagagacagacgctttcaagatgttcatagtctaccaggacaagcaattacagtgcagtgtgataagtaccatgatagagtcagtaatcagtgagggatgtaggagcctcatgcatgacctaatccattcattcatttgctttattcattcagtacacttcagagttttaatatgtgccggggatacagagataaacaagacagatacctctgtcagcccccgatgagcttgctgtgcagttcagtctcaaagagttttaaccgttggttacaatgtattgtttgatatgggatctgaaaggggccagcaacaagagctcagaggaggaccataaacccaagcttagggacgttcagagagacaggaaagcctcccagaggaagcaccatgagaaggaattggtcgaagtctgggttgaggagagg

SEQ ID NO: 13047 - DNA, 1033 bp, Homo sapiens
actgggggatgtttcacattgttgaggaaaacacatagttccgtctcttcaagcctgtggaaactactagctcaagatagttaaaaatgtctagattagattgcactccattccattcgatgacctcatgtttgtaaagaaggatttttggtggttgctgtagcacgtgaaaatcagtgtagaaaaggaaatgagggaggccattgtccagtctgactccaaggtttgagagaaattgtgcagtgctcaacaagtgtacacatactgtattagtaaatacttgtggttatctaagaatgaaataaaaatgccattttttctctctattaaagtgtacttttttcaagttggtaccaagttgttaggacattaagtacttacgtttttaacattttctttgctcaataagcatttgttttggcctgagactccaagggtgcggtgaacagagaaagttttggaactcctgcctttgcctgtgcagtatttgttaatggaagctgttggagtagatgaggtcatttgaggagtgtgtatagagtaagaaaaggagtggtgtggagtgagatctgaggcactcttgtgtttgaaagggaagcagataataggctcccacactgggactaagaaggatgggggtcatggtgtccgaggaaacctcagcaggcagggcgtgctcagctgctgcgagctgttagtaatacaggggacactagaggcaacagtgacatgacagggatgggagggggaggccagtttgtatcaggatttaatagtgagtgagagtgagggagtggagcccagcatgtgtagacagcaatgctcaagaaatttgatgctggtggttaggggtggttatagggagggcagataaagggggaaccctttggtttttgttttttaaatggggggatttgagcatgtttaaatgctggtaaagaaccaggagagggtaatttcagagtttccattggagttagcccactagatagcggtttcagagtttccattggagttagcctgaggacatgat

SEQ ID NO: 13048 - DNA, 1050 bp, Homo sapiens
atttgtttgtatatcccttttcacccaagagttgtataaatttttaggtggaaaggcttttttgttcttaatttctagttttattttccttgatttaattactagtattattatttttgtatattttactgatatgaatacagaaaagtctacatcagaagtatagttgaattttcacaaaatgaattcatccatgaaaccagtactcagaccattcccagaacttcagaaggccctcacattcccttcatctcatgcccacccctctccaaaggtaaccactaagttgacttctaatattgagttttgtctgcttttgaactttacagaaataaatcattattatgtagttttgtttttaaatctttcattcaacaagttttgttaaattcatctgttatttttgctgtataattttccattgtataactgtaccactgttcatttgtccacctctccttacagtatttgtatcattttcagtgttttgtatttctagttttgtttttgcactgtgatcagaggatattttttgtgatatttccattttatgaacatagtaatgatttctttgtgccttaacatataattttctgtgagtgttcaagaagctatattctctgttaccagagtggagtgctgtctctctctctatatatacagaacaactactttgttggttatattgttgaaatcatttatatcttttttttcctatgctctgctttgtatcaagtagtgtgttttatttatggtgtgtttctatttatttactcttggatcaggcataatttgttatttagttcatagagattaataatgtattctgcattgtgaaattaacttttagtatttaaaagtagttaggactattcagataacttttgtcttgattttttttttgtctgattatttttattcacctggtaaatttttgttcctttatttttagcctttttgaatcactgcattttaagtatgtcttttatatacagcatagtctttgctttctaagcaaatttgaaaatatctttcttttaataagcaagt

SEQ ID NO: 13049 - DNA, 1107 bp, Homo sapiens
ggcaaaaacttcctaacttccttggcatggatcttacctgtgacaaaatgtgttccatggtcaaaaaatggcagacagtgattaaagctcatgttgatgtcaggactaccgatggttacttgctttgtctgttctgtgttggttttcctaaaaacaatgtaacaatccgatatggaaaaccttttatgctcagcaccaacaggtccgccaaatccggaagaatatgatggaaatcaagacccgggaggtgcagaaaaatgacttgaaagaagtggtcaataaattgattccagacagcattggaaaagacatagaaaagacttgccaatccatttatcctctccatgatgtcttcgttagaaaagtaaaaatgctgaagaagcccaagtttgaattgggaaaactcatggagcttcatggtgaaggcagtagttctggaaaagccactgggagcaagacaggtgctaaagttgaatgagctgatggatatgaaccaccagtccaagaatctgtttaaagttcagacttataataatggcaagtaaaaagtcctatttgtggaaaaaaaaaaatcaaaaccaggaaattgacattggtacaatctgcagaccttattcagatttcactagtttatacatgcactcagttgtgtgttctgtgcaatttaatcatgtgtataggttcatgtaatcactaccacatcaagttacagaactgttccatcagcacagaggaactcccttaggtttcctctttgtagtcactacagttgatttctttatattaatttgtatcatgtgactttgttgaatttgtcttttaattctagtagttttattgtggattccttagacttttttttatgtataggatcataaaatgtggtaatcatgaaattgactagcaagacaattttacctcttttccaatctagatactttctcctcctttccccccttcttttctttcctcctgccttattgcactggatagaacttcctttagaatattgcgtagaaattataagattagatattcctcccttgttcctgatttcagggggaaagcattcagtccttcaacattaagtgtgattttagttgtttt

SEQ ID NO: 13050 - DNA, 1054 bp, Homo sapiens
gatttataatcctttgggtatatacccagtaatgggattgctgggtcaaatggtatttctagttcaagatccctgaggaatcgccacactgacttccacaatagttgaactagtttacagtcccaccaacagtgtaaaagtgtttctgtttctccacatcctctccagcacctgttgtttcctgtctttctaatgatcgccattctaaccggtatgagatggtatctcattgtggttttgatttgcatttctctgatggccagtgatgatgagcgttttttcatgtgtcttttggctgcataaatgtcttcttttgagaagtgtctgttcatatcctttgcccactttttgatggggttgtttttttcttgtaaatttgtttgagttcattgtagattctggatattagccctttgtcagatgagtagattgcaaaaattttctcccattctgtagtgcctcttcactctgatggtagttccttttgctgtgcagaagctcttcggcccgatgattttttattgtttgctggacattaagaacaagaaagactgaggaatatctatcccggcaaaaggcttgctcttccttttgtcacactgttaatgagggggactgagctggatctgggctttgaagtagcattaattagagtcagtttaccattggattcacatagtttgagagtgggatcacgagtttgttttcggcagttttcactccgaaccccagtaagatcttggagatctctttatgcttcagagccaagctgccagcttcctgagtggtgggagatttctctttgttttatagcttggctgctagcctttctggacagtggtgagttatttatactctttcgatggctttcagctcctcagaaggtatctctttgccctgctctttttaattttatttattattatttattttttgagacggagtctcgctctgttgcccagactggagtgcactggcacgatcttggctcgctgcatcctctgtctccagggttcaaacgattctcctgccttagcctcatgagtagctggga

SEQ ID NO: 13051 - DNA, 1050 bp, Homo sapiens
caaatcaaggaaataaaaacacaaataactagttgtttggttgagcaggtgctcaggaggcaataggaagtcagagaccagggatgggatataggcatgggagaaaggcagagactcaaaccagtaaaggatataaagcaactttaagcacagttaagaaaacctcttttgggctgtgtgtggtggttcacacctataatcttggcatttgggaggctgaggcaggaggatcacttgaggccagagtttgagaccagcctgggcagcacagtgagactctgtgtctctctactaaaaatatttgtaaaaaactttaaaaaagggaaacctcttttatacttatttatgatggcctgtgaacaacttcaaggattttctggttggagacaggatggtggggccaaagctaagggtaatgccctggtttggttgctgaaattaaggaaagaaagacatttgtctaccaggtgattcataggtggcatgataaacagtagtttaatgtatagagttgagaagacaaaacacaggcctctgaaggtaaatcccagtggaaagtagcatgtgttgggtttcacactggtgatactcctagtgagttctgttggagttaggagggtggggtgatctagctaggttggtgtggtcctgcagccatagtgaagaagatagagtcagtcatagaaggagtggagtttggaataaaccttgggacttaggtgagatagatgtaggtgagtgtgtcttccacctgtatttactgtgtgattttttttggatgagtcttccattagactgtttcctaatttgcaagatagttaaactaattcctaccttgcaggtgtcaaggttgtaggggattaaatgagatgatttatgtgaaagccctttgtaaatggcactgtggattcagatgtaagttgttattaataaattgccagttgcaatggggagcctgttggataagagctttaattcattcatcatatgtaaatgaggtggtactctttgcaatcaaagctgtttaatgaaggtcatgattagggggaa

SEQ ID NO: 13052 - DNA, 1047 bp, Homo sapiens
ttcctcactcacattagcacatttcaagctggatccatgtggctggaggctgccctctgggacactgtcactgtgtagaacatttccatcactgcgggacattcatttggacagcactacctcagagcactccttgactccaggggagtcagcatccccatccccatccacttaatcttccgagacctacgtctgtcagatttgttccctttaaagaatcctcccttgtcttagtttaggtcttcatcacctgtcttctgaattatggcttaaattcagtgaccagccttgtgaagctgtccctgccgttgcccctccagctgtagccaccttctcccttgtgctctgtgcatccgccatatacacctgtcagagcactggccccacggaatgctacatggttgtttacagacttttcttcttgtggactgagaggttcttgggagtccagggttgggctttggttttaccagggggaggggcaggcacagtgactgacacataactacatatatatgtgtttattgagcaggtagaggcatggatggatggaggccatagcaggttgcagtttgaaggcaagagacctttggatacctggaaactagacgacaggagggcatttgtgacacagggagtgtaacagatgcaaggccagaggtaggaagttacagggcaattctgcttctggacagtagccacaggagagcactgtcagcaccattcagagtgtagccatgtatggaaatagaattggagtgatggtgttgcatagaagcatgcttccctgttctggccagtattgcagctcgtagtagaggtgctgtgtttccacttagcagccttaacctgtgacttcaaaggagttactgatatgctctccattgtcaaatgaggctacgtattcacaaagtctagttaattcttcaagacttttatggttcttgacttatgttagaaatgttagcagctcagcagcaaagaaaaaggcatgtgtccgtgcccaaaaggagacaatccaatgtagatattacttacttactcctt

SEQ ID NO: 13053 - DNA, 1045 bp, Homo sapiens
tttctttcttttttcttttggaaggatagggagagaataacacgtcttttggttttaagatgatattgaaagagaacataaggtagaagaaaggctattataccagaattagaagctggaagattgatctctaatcctagcttgccttgaccttgggcatatcattacatattaatttaccataggaaaattgaacttgatttccatactttcactttacaggtaatttttcaggaatgtatctgtgttctctgaccaagtttaattaagctagaaatcagtatcacatacccaagaaattccaaaatattttgaaattaatgatcacagcctgaaaatccatggttaaagaggagcttacaaggcaaaatactttgaattgaatgaaaaggaaagcgtaacgtatcaaaatatatgcgatgcacctaaagcactactttaaggggaaatttatagtgttaaatgcttatattagaaaataaaagttaaatagcttttgggcttttcctgtatgtcatgatgggttacaggctgattgtagttctgataaatggtttctttcacttcctatccaatttatatgaaaaggggagatagttaaatttttttgtcaggcaagcatttattttttaacacggatactgtctagtatttgtgttccactttatagtttttggggggctttcaggtgtgtcatctcaccacagccttttgagataaccaggcagatattactgctttcatatttagaataaggacttgaggcttatggaggtctcagctcttgaagaactcggggcttctgcttgccacgccatctgcttgttttgctgctgtgctgcatttccaggctttttgtagaagcgctgtctgtgttcagactgttgttgtaggtggcacactctgattagcttggtgaggcagattctgttggatgagggaattctctaggaggagtgctttttcttaggcatttccgttggtgtttgtattatgcccatcagaggtggcctttttttaagtaccgttttggagctatgtctat

SEQ ID NO: 13054 - DNA, 1058 bp, Homo sapiens
ctgtatcagatctttatcagatatatgatttgtagttttattcattttaatagcattttttttcctttttaccccagaatgaaatttttgggagccaatatgggattattttttggttttattttttgcactttccccaactcccataaaagtagttactctttgtcatcttccttttcttccattttctggcagggcacttagtttgtattctctttttggggggctgtacatgagtcaatagctgtgcaggacagaagacccctaattagtgaatatgtttgcatggctgggatggtcagctctttatttctggaggttggagatctgccattccaattgtcatcagtattgactcgttgtccctggggtgtagtcaaaggcctcacctgaagtactacaaggtcagaagccagaacagggccagattcagattcaatgatgaaaatgctggcgacaattcaccaacatcccttgatttttacatgttcatttctgattgaattgtattgtgcttactgtgtgattgtaattttctgtgtgattgcagttaacttttttgtgtgacctaattcatagctttttttcttacaacttttccgtgttttcttttttaaatatgcattctcacatctatgtataacatttttaaaaactatcaattaacacttgttaattgtattattcaaatcttggtctttgttggtttctgagaaaagtatgttgggtcttctacaaaaggataataaaagttcataattgtcatttttagtgttttttttttaccaattgaatatgataagtgtcttcccctccatctgtttttgttgcgttcaccttgagtttctcttgtgtcttagagcctgactcccttttgttgttagcatttgcctggtgtatatttttaatctctttatttttatcactcctagttatttcattttagatgtattcttgaatatttatcttacaaaacccaaacaactcagtgtgttgctgctttgttcagtggaggctgtttggtgagtggtaaggacatggactgagtccaggctgcc

SEQ ID NO: 13055 - DNA, 1132 bp, Homo sapiens
cccacgctcgacgtccttcactgtaaagtgggtcccctcgtcagatgcgatgatgtgtggggtccatcaggctgataattctgggtggacttatcgatgatgcaggctggcggattttgcctgctttgtgttcagtgtctctttggtgggaaactttccagtggaggttaacaagtgatacagaaatcttcaccctgtgcccactcccgaatttctacccacatggcctttatccagatctccttgttcctcatcttccagttctttttatttcagtaccttgaccatacaaccaggctgttggccactgcccacacatctgcacgcatttcagatcaagctacgcggtgtcatgaactggtgtcctgcccacagctccacctgctgggaagattttcctttccactgtctctgagggccatcctgagtactgctgcagcacacacagtccatttttgactaacaccatgtgctgagctgatccgtctgaaaaaccaagctcaggctttccttcctccttcccctggatgtatgagtctgctgcctgtgtaacctaggcacacaggggaggggcactacagctcttgggggtgacttggaggtctgggcttcctgctcatgggactcacttgtatcctgtggttctactgtggttcaatcttgaatgtcccatttctattttatggtcaactgctgctagtttgaattaataacttgactgacagaacttagctcattctggggagctttgcatgcctggacccctggttctctgtgatctctaccaggtcttggtaatatagtacatttaatactctgatgtgatggcaggtcctagggccttgcctttgattctcctgctggagcttgccacaaactccatattgtcctgttttccttattttttaaatttttcttttatttttatttatttattttttgagtctcagggcatttattttgtaaggaacatgtttgaaaaggggcattttaattatcctgtaaatgtttttacctcagcaataatgtttacatagctagtaatcatggctctcaggcatgatgagttttactgttgttaagttttgttttgtttttatacttaaagttctagggtacatgtgcacaacat

SEQ ID NO: 13056 - DNA, 1100 bp, Homo sapiens
gcttcatccatattcctgcaaaggacatgaactcatccttttttgtggctgcacagtattccatggtttatatatgtcacattttcttaatccagtctatcattgatggacatttgggttggttccaagtctttgctattgtgaatagtgccgcagtaaacatacgtgtacatgtgtctttatagtagcatgatttacaatcctttgggtatatacccagtaatgggatcgctgggtcaaatgctatttctagttctagatccttgaggaatcaccacactgtcttccataatggttgaactaatttacactcccaccaacagtgtaaaagcattgctatttctccacatcctctccagcatatgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcctactttttgatgggttgtttttttcttgtaaatttgtttggttcattgtagattctggatattagccctttgtcagatgagtagattgcaaaaattttctcccattctgtaggttgcctcttcactctgatggtagtttcttttgccatgcagaagctctttagtttaattagatcccatttgtttattctggcttttgtttccattgcttttgatattactgcacagggactcatggagtcctgaagtccttgcccatgcctatgtcctgaatggtattgcctaggttttcttctagagtttttatggttttaggtctaacatttaaatctttaatctgtcttgagttaatttttgtataaggtataaggaagggatccagttttagctttctacatatggctagccagttttcccagcaccatttattaaatagggaatcctttctccatttcttgtttttgtcaggtttgtcaaagatcagatggttgtagatgtgtggtgttatttctgaggcctctgttcggttccattggtctatatctctgttttggtaccagtaccatg

SEQ ID NO: 13057 - DNA, 1026 bp, Homo sapiens
aatgtttgtttttgtaattgcaaagtattttcaagggtaatcactgacccagcattttttcctttgactcttcctcgctcttcaatttattcaaaactgagttagtgttagagacgataaaagctgtctgggagaagaatacatttgttagagtacgctatggtttggatgcagtttgtctccatcaaaactgatactgaaatttgatcccccagatgttgggaggtatggcctagtgggatctcttatgaatagattagtgctttccctatgtggtaagttctcactcttgtgggaatggattacttcctgtgagggtgggtggttaaaaagagtctggcttccttggtttctgttgtttcttctctcaccatgtgatctctttgcatacacccactgtcctcctattttccaccatgagtggaagcagcctgaggcccttaccaggtgcaggtgcccagaatcataagccaaataaacctcttctctttataaactacccagtctcaggtactctgtatagcaccactaaactaagacaagtaattgacactgaatttgaaaaccataaaaatcattactacattattagaactttaaagaagagctgcaaagccgtcttttctgaagttgtagacaggtagcatggcctctctctcttgtcttttgtatttatacaggcataggagttccaaatagaggtttaatgaacatgagaaatgaaggctggggattaattagtcaaagctgaaatactgcaacaacaatatatgaagtaccccaagggaaggccaaagagaaatatatatgtaaatgtctatggctgtacaatcagcaaacattttttgaataatcaggttgtgtcgagggctgttcagggcattgtggggaacacagaattcatggactcagtcccaaattcaggcagctcatagttcatctgggaagaagacaactgtgagtcctgcctctgccaggcacagagacccctacagtttgcttgggatggttaatggggaaatgaat

SEQ ID NO: 13058 - DNA, 1008 bp, Homo sapiens
aaattgtttttgcgtgtatttatttttgtaggaatgcttttagtctcttgtttttatggctgaaatgcctgttggcacaaagtgtaagtgatgaaagccgacataaactgtcagagttttaataatcaatctgtatctcatgctgtaataatcggcggagtgttgtgttagttgtgtttatggtgtttgcttggccacagtctcctgtaagtgaatctgcccacacagtatgccttgttctacatggcccttgtggtaaatagaatagtaatagcccctccggatatgtccatgtccttatccttggaacctgtggatgtgttatgttacgtgtaagagggaattaggattgctagtcagcttactttaagagaaggagattaccctggtttatctggtttggttcagtgtaatccacaagggttctttaaatgggaaaggagggaggtagaagaatcagtgccagggtgacgtgatgtgggaaggacccaactgccattgctggctttgaagatggaagaagaggggccatgagccaaggaatgcaggcagactggagaagctggagaaggcaaggaaattggttctctcctgaagtccccagaaagaacacagatctgcccgtacattagttttagcccagtgaaattcgtttctgacttctgacatccagaactgtaggatagtaattggtgttattttaagctgttatgtttgtggtaatttgatacaacagcaataggaaaccactctagctttggttgtgttttgtaccacccaatccactgtagcctcatgattgggccggggctgggaacctgcctagtggatagtcagttctgagttacgctactgcagtgcatctcaacctggcttctctatcagagtcacttggtgagctttaaaacaggatgctaggaatcacccgagagattgtgcttccggtaagcaccagagatgacccacaaaattagacacccatgtgtctggatggaaaagatgagctgg

SEQ ID NO: 13059 - DNA, 1053 bp, Homo sapiens
atgaatatgcttaataatcaatgtctgttatctaagttcttaaaatgcttagaatattgtaaagaagtattttaaaagttcattatagttaattatggttgacttttctttctgtttttcttaatttttcaaattttctatcatgagcatgtgttagttttataatcaggacggtagcagtagagtctttaattggactttgggccatttttcctaccgtttactttcctgtattttctgtatttcttacaataagcatgtgttgcttttataggagaaaaaataggtttaaaaaagaggaaaaaactttaagcccaatattatgacttgttattttatggaattcaataggaactgacattacagatactataataaagtttcttttttaacttttcattttgaaatgattttagactttaaaaagaccaaaaacagtacaaagaatttccataaactttcacccagatttcccagattttgttttacatttcttctttttctcagacttctcttccactttcccaccatacaaatgcatgtatgcatatatattaaaaatgatctcttttttgtctcctttaatctgaaatagttcctcagtctttctgtgacttttatgaccttgacacttttatgaccttgacacttttatgaccttgacactttagaagggaaacagcatttatgttatggaatgtccgttggtctggattttctaatgtttcctcgtgactggatttaagatattgaaagaaatatcacacggtgatgatgtgttctcccctgtgcgtttcattaggaagctcatgtgtctgcttgtgtcataactggtggtattgactttcatcagtggattgattaccccaagtttctgtaatgcaaagatttttttccctatgtgattaaaaagtgtcatatggggagacactttgagactatataaatgttctgtttcccatccttctatgaacccactagtctcagcatccattgatgatccttgacagaaacagttgctgtggtggttgcagaatggtgatttttttgtca

SEQ ID NO: 13060 - DNA, 1028 bp, Homo sapiens
gaagtttatttagctgatgattgtgcaggctgtacaagaagcatagcacgagcatctgcttctggtgaggcctcagaaagtttccgctcatgaaggaaggtgaaggggagctgtgtgtgcagaggtcacatggagagagagaggaaacaaggagtgggaggtgccgccaggctctttttaacagccagctctcacaggaactactagagcaaaaactcgctcacccagggagggcattagtctattcacgagggatccacccttgtgatccaaacaaattctatcatgtcccacctccaacattggggatcacatttcaacatgagatttggaggcaaccagcatccacgctgtagcaagtaatgttaaccactgtgtacacatggctgtgcagcagatctccagaatgttgtcatcctgcagaagcaaaactctgcgctcgttacagaactccccatttccctcttcctctgacccctggcaaccaccattctcctgtctctatgaaatggactactttacatgcctcatataagtggaatcgtacagtatttgtcttttgtgactgattaattttgcttagcctaatgtcatcctcaaggttcatccatgttgtagcatgtgtcagaatttccttcctttaaaggctgaataatactccattgtatgtgtgtaccacattttgtttatccgttcatgtattgctggacactcaggttcttccacctctgctactgtgaatagtgcttctgtgaacataggtatgcaaatgtctcttcacatccttgcttgcacttctttacgggtatatactcaagtagagttgctgggtcatatgtttaattttggggggaaccaccacacagttttccacagcagttgtaccattgtacattctcaccaacagcgcacagggttccaatttctccacattcttaccaacacttttctgcgtttttgtttttgttttttaaatagtagcatcctaatgggtatgagaggtggtggtgagagggatttcagtcatt

SEQ ID NO: 13061 - DNA, 1052 bp, Homo sapiens
ttttattttgtcaagataaaaaagtcctagaggtatattagctcatgaatatcaagttcggggtcattgtaggacggtgttggatttgccttttttttttttaacaccttataagccctgtctaccaagagtagatacataatctgtatctaatctcgaggaaacatctgatacacccaaatcgacagacattctgcaaaatagcttcctatattcttcaaaaacgagaaggttgtaaaacacaaagactgtgaagaactatccagattaaaggacattaacaaaattgacaaccaatgtcacggataatttccactggattctgaaccaggggataatcttttccatttgcaattagattgggtctttttgcaaaatttgaataatatttgtaggatagatagtagtagtgtatccaaactaattttgtgattttgatattttgggtgggcgaggcgggggcggtaacacatgaactattttaggggtaaagggacattatatgccattcactctcaaatggtccagagaaaagtgtctgtgtctgtctgtgtaaagatgataggggaagattgggaaataaatgtggtcagatgttagcagttggggaatccaagtatatgggaatgtttttctgctggtctcatagctgttctgtaaatctgaaattatttcaaaacagttaaaaaatgaatggataccatcttgggcaacattgcaagactctatctctacaaaaaagaaaatacaaaatttaaccgtgcatggtggcgtgcgccggtggttccagctactcaggaggctgaggtgggaggattgcttgagcccaggaggtcgaggctgcagtgagccatgatcgtaacactgcactccagcctgggtcacagagtgagacccaatctcaaaaaaaaaaaaaaaaatggataaacattaaatcatcaaatatcttactttgttactaagctagaaagtagatgattgtattttatgtttgtttccacagtaattgttgaaataaaggtttctcagttacttcttgggttagctgagag

SEQ ID NO: 13062 - DNA, 1905 bp, Homo sapiens
tatatgttctctaggccttttagaaaacatggtaagtaggtttaccttccttgagagaagcatggcacacatttgtgttctgttgtgttcaacatgtgttgtagttcatagaatgtgtatcaatagaattaaataactagcgtctacccagcttatttcgtgataaggtaaataaattaccaaaattatatggtgattttgtgactaagtattgatgcaagattaaactttggagagaggttgtgatttagtaggctgattgtgctgtcaggagaaattgtccattgggaagataataagcatgtaaccatcaaaaatgatatatgtgttaaaagctagtaaaattgcatttcttttactctagatttttagccttaatactcactataccaaatttatttttgtaggagttgttcctttggccacatatatgcgaatctataagaaaggtgatattgtagacatcaaggtaaacataaaattgggaaaataacactacagaagatagaaaagttggatttaatctagtgtaggaattcaaatactagtgtatgttgcatctgtaagagtatagaatggatttttttttttttttttttggagacggagtttcactcttgttgctcaggctggagtgcaatggcatgatctcacctcaacctccgcctccctcccggattcaagcagttctcctgcctcagcctcccaaatagctgggattacaggcgtgcaccatgatacctggctaattttgtatttttagtagagaagtggtttctccatgttggtcaggctggtcttgaacacctcgggtgatctgctggactcagcctcccaatgtgctgggattacaggcatgcaccatgattcctggctaattttgtatttttagtagagaaggggtttctccatgttggtcaggctggtcttgaacacctcgggtgatccgccggactcagcctcccaatgtgctgggattattacaggtgtgaaccaccgtgcccggcctagaatggattttttaaagtgctattcttagcagaatttaaattttcctcattacccgcttggagttaacagctagtggaaattgggtggtagggtgggaaattatgagtttatcaagttggaaaggaacgccttagtgcaaagtttaattattgatgaagattactattactatgattaaaaaccctcctagtgaaagctgtgttcttctgtgacctggatttaaatgtatcttggcactcgagcttaatgatgactgttttttttgattgcttgaagcaatgtgaaaaacacatttcaccggctctgaaagctcttgagttgccatttgaaagaaatcttagaatactttgcagttacttaaagtcagaattttaaaggaaggggaaatgctggtatataacattggtttctttaatagggaatgggtactgttcaaaaaggaatgccccacaagtgttaccatggcaaaactggaagagtctacaatgttacccagcatgctgttggcattgttgtaaacaaacaagttaagtaagtagtgttgtagttctttgtggctaaccagtattccctcatatacccccttttcactttgccagttggacttatgtctttattggtcattcaagtggggcaaaggaaatatccttttaaaactcaggcaaactgggtgtttgtctgtatcctgtcagaggaaacaaattgaaatagatttactggaaagtcttacacagttagttactaagcggtttgtttgttttgtttcgagacggagtcttgctctgtcgccctggctggagtgcagtggtgggatctctgctctctgcaagctccacctcctgggttcacgccattctcctgcctcagcctctggggtagctaggactacaggcg

SEQ ID NO: 13063 - DNA, 1016 bp, Homo sapiens
agaaggagaaaattgggatgactagaaaacattttcagtccttaagtaggtatagcctagggtaatgtagaagaagccctatttgagagaaggtaaagccaaggagaaggaaaattccatataggggaaatgactgttttggaaaacacatatcccacccgccagtgctctgtgctttgggcccttgtttatctatcccctcttcctgggccagtcttactcctgccgtactcttaagtcaaagcttatgtgtcaggcctctcagcctagtttgggtacttctttgtgctttcattacaccctgtgtttcctggccttggcatttactatgctattggtagtgcttatcttgtttacccactaaaccaacttggaggtcaacatgattctggtacctggaacacctgacaggtagtggacacttagtaaatactctatgaattcatgtaagtagttatggcatgcagcttttcagtcactcaaacctgacctcttacactagcgtgccatagagcctacatttcctacactcagccaaattctttaaagagatatccatatttttgagcactagtatgttccaggccttggggatagatatatagctatagtggatgagacagagtaagtcctgttctcataaagcatgtgttataagagccccttaaaaaaaaattgtgaggctcggcatggtggctcacacctgggaagccaaggtgggaggatcacttgagcccaggagtttgagacaagcctgggcaacatggggagtccctgtctctacaaaaaaataaaaaaggtagccaggcatggtgacacatgcctgtagtcccagctgcttgggaagctgaggcgagaggatatcttgaacctaggaggttgaggctgcaatgagccatgatcacaccattgcactccagcctgggtgacagagggagaccttgtctcaaaaaaatatataaaattaaaaacttgtaattctgtaaaagcagcaaatgtagggtcaagatagaaaa

SEQ ID NO: 13064 - DNA, 1079 bp, Homo sapiens
tactatacggaggcacagtttaggggccaggatacggcagtgaacaagttggcccacatgcagtttattttctgatggcagagttagacaataaagaaacatgcaaacatttaatttcaggtagtaaactaatgatgacaaggagaaaacactgaatagttaaggaaggcctttctgaggaggtaacatttgagcagagaaatacaagaagagagagaccaaggataaaagagaatgagcccagaatttttttaaaaacctgagcttagattattcagcaatgaaagaaaaattatgaacctttctagaggaataaattgtatatttcagccttgtgtttgtgacttttattagtgcctaaatttatatcatctgtttttaatctgtatatgtatttacctaacaattatagtaaagaatattggactactctgtgggaaggaggatatgtaggatattggagttgttttcgattggctgatacatgtatgtatattggaggggcttattttaattgaacttttttattcttcttttgagacagtcgcactgttaccaaggctggaatgcagtggtgcaatctcaactcgctgcagccttgacctcccaggctcaagcagtcctcctacctcagcctcctgagcagctgagactacaggcatgtgccaccatgcctggctaattgtttgtttttgtttttttgtgtgtggagacagtctcactatgttgcccaggctggtcttgaactcctggactcaagtgatcctcccatctcagcctcccaaagtgctaggattataggcgtgagccactgtgcccagccaaaatagaccttccttaggaacagaaattgatatgtgtggaatcttgggtatcttttcagtaagcataggcatagcaaacttaggcagtataacattggaatttagagctgttggactcacaatgcctgggttttgatcctggctctagacgttagccatgtgaccttggacatactgtttgatctctttgtgcctgagtttcttcttctgcaaattgggataacaataataccatatagggatgttacaagtgtt

SEQ ID NO: 13065 - DNA, 1102 bp, Homo sapiens
gctcagtgcaattcataacccaggaaacaccctactcatgttttgacctgcacccttgaatgaaaggaaactgtttaaatatgtgaagattgtaccaatgttgactttccagtggacactaatttagagtatggaaaggttttgaactgcagaaaagttaaaaaagacattaacttgtcaaatccttcatcttggcatgaatgcaatagatccttcactaagaaaatattgtttcccactagtgctaagcttccattttcttgcttgtcatattatttcagttcatgactctgaagatactcatgatttaataccgtacttgaaacagctgcacctggaaactgagtaacattttgcaatcttaaatcatattactcttatatttgtatatgtgtaggtctatgtggaacatacaagaaatttgacactgattcatagatcattttattattttacattttgttttttaatacttttagactattatggtttatagaacatataaccttccctcagtatccctgggggattgcttccaggacccccatggataccaaaacctgatataaaatggcatagtatttgcatataacctacatgcctcttcctgtatactttaaatcatgtctagattgcctgtaacctaagtaatctattattactaatattacattgtactaggtataatctagtcttacctagtacaatgtaaattctaagtaaatagctcttattccgtattggtttttatttgtgttattttcattgtattgttatttttttgcttctttaaaaaaaattttcaatccatgtttggttgaatccacagatacagagggccgattgtacactcttgtgcttacaaaaaaaggggcactgcattttcaatacaaatgcctggaaccatactttcacatctcatgtgaaatatcaaatgcctaaattcacaattctctcttagcgtttgcttgacagcaattgggccatatgctaaacttccatattaattcctacacatctggtgtttctagataagccccaagtcaaagtatttacaaggctctttttcctataatttgcaaggaatgaaatcacttttaat

SEQ ID NO: 13066 - DNA, 1037 bp, Homo sapiens
tctctctggcatggccagctcccactctaagactcttaggtgtgaccagctccaccctaaacaaagacatttctatgacattactttctggaagctaaggcaaaggccagccctctctttgggccaaaccaaactcttgactacatgggcaggaaatgtataagagaagctggaaaatcttgtcacaccagaaagcaaagaaactgtcaaagaccaatgtactcatttcagaaagactcaggacccacttgaaaggtctcccactagtcaaagatgatataatttgatttaaaaaacaaataaatgattaaaacacctaaaatatgttaaaatctgtaaggtcataatgataatcataataacaaacctggtagtcccttttataggatgctagagcaccaaatcactattcacaaaactgataaataggaagaagtaagcatttaccctgttccctgtacaaattatacttcaaagtcaccaattaattgatgaaagaaaactttacagaagaattgtaactaatatattagaaggattatagaataatattatcatcatttgagtttcaacacattcattaacccttataccacagaaagatgcaagaagagcaaaccaccacctctggggcatccttgtcaaaaaattgaacctgaatctgatcaagtctctagttagaactactagtttgcaagaaatacagagggcagagaaacatgttaaatgacaccataaggctgcaatcacaaaaatccaaaatgtgagaaatgctacaggacaaagaacccagtttctttaacaaatgaattgcaaggagaaaagaaagaagagtatgctgtgaattaatagatttgaggaacatcaaataaaatgggtaccttgtttgtgtctttatccaaactaactgtaaaaagttattcaacaattgagggtatttgatgatattaaggaactgatgttgattttttaggtgtgatagtattgctgttattttaatttttaaaagccattatcttttagaaatgtattctgat

SEQ ID NO: 13067 - DNA, 1089 bp, Homo sapiens
actagaaaatataatgagaaaaaaggacattgtttgattatctatgattgtgtggtatagtatatttacatgtaatacacaaacatataattcttggctgaaccatgtgaaaattaattgtaggcatcttgatacttcagccctaaattcttcagcatgcagatctcaaagacattctcatgcataaccacattgtaattaccatatcaatgaaattaatgtataatttcatatcatcatctaacatcccaaaaatgtcttttatagtggttgccttttgtttgggatgcagattcaggatccaggcaaaaatgttccacatactggatttgccttattatgttttcttgattagattcaggtcaaacttgtttgacaggaaggaatattacacaggtgatgtttttatacgtcttaattacaacagatcaggaggacttaatgtcaggttgcccttgataaagctggtgactaccagatctctccattataaaggtgcaatttttcagctaagatatttttgggaggaatgagatgagaatattgcatgctcaatataataatagtatgtaaatttatagtaattagtatgagattcgtgtaagactaaagacattagtgagagaatagagaatcaagaatagagactgggggaagaaagaggcaggaggaaggaagggagtggagaaggaaagaaaacaaaaaaaagaatggagaccgacatatgtgtatgaactaactgtgtggaaaaaggtcattgttcatactagtggagaaagggtggattatttagtaagtgatgctgatacagttgactattcatctgtaatactgaaaattaaaaactaaacatacaaaatatgaatcttataggagaaaatacaggataatatttttataatattggcaaggataaggtagaaacctccctcagccaggcacaaaacctagaagctatgaatgagacaatggcagattcaaccatgtcataataatagtaaacttctacatagaaaaagataccatacaaaaagttaacttgtgaaaagacaagtggtagactggttgaaattatttgccatatataac

SEQ ID NO: 13068 - DNA, 1034 bp, Homo sapiens
gcggagcttgcagtgagcaaagatcgcgctactgcactccagcctgggcgacagagtgagactccgtctcaaaaataaataaataaataaaaagcaaactttgtaaatattaccaatgattaactttgagtagagggattacagatgattttttttattatttgaatatttatattgagaaaaataaccattatttaaaagaacatcgactacattgttgacactttttctgcagaaagtgcaacaagtgtatcaagtgacacgtaggtctggctcttagaagtctgtgaacccttcttcacctcattaatcattggctgacctatagagactcagcaaccagaaataaaggcatgaggtcaaactgcacagggcttgggaaggctgtctgacttcagatccttcaggccctcagacctcaccgttcaaggtcagactgactgggaaaggagtgggagttttcctggggcgtggagtgtggacaccatcagaaccaggctgaggaataccaggtactgcagagcaagtgaccgttgttaagggattctttatatggtgtgactgcttattgtggttttctgtttgctttcactccattaacttgtgtgagctgcttattatttaccaagcactgtgctcatgcttggtgggggatagaaagaggcaaaatataggatcccagcccccaagaagtctctcatcaaaagtaaaaattagacaggtagaaaagataaattataacacagcaagacaagtgatataacacaggtttattcctctcaaggaacgcagaggaaagaaaaatcaagcctgaaggattcagtgagtcttagcagagtttctcgtacagtaggcagcctggaggaaggtggctgggagagggagttccaggcccagagaacacctggggcagagatgcagaagcaagaaagagcacagagaaggcacccacacctaatccctgtgttccttttgaattgctgctgtcaaattaccacaaatgccgtggcttaaaatgacacagggagatttga

SEQ ID NO: 13069 - DNA, 1031 bp, Homo sapiens
cagccattggaaaactgaagcacaaaggctttttcttaatacacttagttgcaatgatgtttcaaccttataaggaaactgcaatttgattttttgtttttgtttttgtttttgttttttttgaggagggggttgggagttcttgctgtgttgtctaggttggactccaactcctgggctcaagtgatcctagcacctcagcctcctgagtagctgggactacaggtatgccgtaccatgtagcttacgtaacatttcgtatttctgttagtcttgggatttttctaaggcttaagagtgatttgatttgtattcaactgcattatcgattcttgacatttaatgatgtaattctaatattttcaactggctagattttcaaaatggctttaatcttcaaagtgtacaatttttaacaggtaaaatatgccaatatttgtattttatgtacattatttgaaacccagtagttttaatttaccaaaatacacttttcaattctcctaatgtagttactagtgaataagacatgtttcagatagaatcctggctctttgactagctttgtgactgaacgaatttttaacctttaagcctcagtttttctcatctggaaaatggagatgttatgaaaattgcatggcattgcctgcacatattgaggtttcagtcttagttattgctattattaaatattaataatctatagttaacctctgtatttccttcttcaaatttttgagggcatacattgaagactagtaaaatagctacagattattgaattgtgattgtccaaatggaggagagcagtgccatggataacttgaagttcaaatgttagctttggaatatgtaatgtgtagcgtgtggcaaagctgtttttgtttaagccaagactagccttttcatcccacaaacctatactaagtgacagagaagtgagtactggcgatttgctgttaggatagctggcataagtttaaacatttttattggaataatatacttagtatatcatgaaggcttta

SEQ ID NO: 13070 - DNA, 1029 bp, Homo sapiens
cgctgcagcgttgaactcctgggctctagcaaatctctctcctcagtccactgagtagctgggactacaggcatgtaccaccatgcctggttatatatttttaatatttaaaaaaatgccagtgtcagaaaaataagaacaatatcttgtttttggaattagaaatgtaatacatgcacaggttaaaaatttaaatagtgcaaaagagtacatagtgaaaaatagcctccttccctccctagttacctgatccctgtctcccagagacactctttctagcttatttggggtagccactgacaaatattctttgcctatactattattcatatgtttatatttctctatgtctaacacattaacacacatatatacacatatgcatgagtgcacacatggaagcctaatgtactctgaattttcttacctaatggcttatcttgtagtttgttccacattcgcacatagaaatctactttattctttctcgtggctgtgtaaatattccattatatgtttatattattagattctttataatggatattttagtggtttatagtcttgctattacaaatgttggcacaaagttatgttttaatgtactatgtatatttatttacatatatatttacacaattatgtgatatatacttaaggagcatatagagtcttcagtaatctggttcacagttgatacattaaaaaaaaacactgtgtggggtgtggcgactcatacctgtaatcctagtactttggaaggccgagacaggaagattacttgagctcagaagtttgagtccagcctgggcaatgtagtgagactctgtttctactaaaaataaaaaaaattagctaggcttggtggtgcacctgtagtcccagctactcaggaggctgatgtgagaggattgcttgaacccaggagacctaggaggtagaggatgcagtgagccgtgatcatgccactgccctccagcaagaccctgtctccacaaaaaagaaaaaagaaactcactgtatttatat

SEQ ID NO: 13071 - DNA, 1039 bp, Homo sapiens
gccaacactttgggaggccaaggcgggagaattgcatgagcccaggagtttgagaccagtatgtataacataccaagaccccatctcttataaaaataaaaaaaattagtcaggtgtggtggtacacacctgcagtcgcagctgaggtgggagagtcgtttgagcctgggcggttgaggctgcagtgagccaagatcatgccactgcactccagtctggacaacagagtgagaccctgtctcagacaaaaaaaaaaaaaaatcagttaataactagcatttcagacatacgagtagaaagtaaaactagaatgacaaattaatgtttaaaagtatttctaatataagaggttagtgggatgtgtcttaaagtggaaatatatgatttagagctcctgacatttacttttgagaaaataataaaaattattagaaattgagaatatatagtacctattctttttataatttattttaatacaataaaatgttactagaaatgttactagaaatttgaaaataatgttagtagaaatgtgacctaaatatttggagagatattagaatatatccaatggaagcagactaatatagaaaaatgagcactctactgtgatatttgaggccctggatctcccattttgtgacctatggccaactttctaggctgtaatcatcccatctgtgaaatgaagagcatgacctcatcattaccatagttgctgtggtgtccttcatctctaaaacttaatgtctgtctaaattgaaagcatccatatgtcagtttctacctagaaatttgtggttcatatattcatatagcttgaaggactatattttcttgccatttatatttaaaatgatgtgtaatctacagacacagagtttttccagtagtgagcaatatagttagaatctttgtgggtacaggttgcatatattttaaaattgttaatggttgagttgagaaggtttcaaatctcaaaatctctttacattagaaatactcttggcataggagtatgacatattacacatag

SEQ ID NO: 13072 - DNA, 1030 bp, Homo sapiens
tgactcacacctttaattccagcactttgggaggctgaggtgggtggataactcgagtccaggagtttgagaccagcctgggcaacatggcgaaacactgtctctacaaaaaatacaaaaatgagcttgacttggtggtgcacgcctgtagtcccagctacttgggagactgaggtgggaggatcacctaagcccaggaggttgaggttgcagcgagccgtgtttgcaccacttcactccagcctgggaaacagagcaagaacctgtctcaaaaaaatacaacaatttttttcactcaaaatattttattaactttggcatgctattttatttctttatatctggtacgtattgtggttccagtctaaagcacaaggatataagaagttgcagttggtgttccagttctttagaaattgaatgtgcccttgcatagcaaggtcttccaactgattttatttttggtagcataaaatccctttgtaacactgagattttaagaacataagtaaagactgctttgtagacttccttaaattactatgtagataatgtttgtccccctcaatgacctgactcatagcagaagctacaaatacgtgtatatgtgtttatacatgtaaattatgttctgctgtgtttgatataatttatttttctcattttttacgtatttttgttttttgaggggcagtgtcttgccctgtttcccaggctggttcaaactccgacttcaagtgatcctcctgtctcatctacccaacttagctgggactacaggcacatgccaccatgcccagctaattttttaaattcttgtggagactgggtctcactctgttgcccaggctggtcttgaactcctggtctcaagtgatcctcctgtgtcagcctcccaaagtgctgagattacaggcatgagccacctcacctggcccaatgaatgatttaaatgacactttaaaatgatctatgttttattaatcagaacatctttacaaacttgaaaaatagtagtatacaaatgtga

SEQ ID NO: 13073 - DNA, 1047 bp, Homo sapiens
atactgaaatgttgagtaaatcaaggaatgaaaaaatatacatgtgtgtcctaaaattaccttctgttctttcctttgacatagtgagtctagaggcttacctcccttgtaatgagagtggacttcccttagccctaaaccactggaactggcttttatgaagtggggcaaaggtttttggaaaagctagggctttgagggctacaaatagtgatcttaaaagctctcagtgttagccaggcgtggtggctcacgcctgtaatcccagcactttgggaggccacgccgggtggatcatgaagtcaggagttcaagaccagcctggccaacatggtgaaacctcatctctactcaaaatacaaaaattagccagatgtggtggtgggtgcctgtaatcccagctacttgggtggctgagccaggagaatggcttgaacccaggaagcagaggttgcagtgagccgagatcatgccactgcactccagcctggggcaacagagtgagaccccgtctcaaaacaaaaaaacaaaacaaaacaaaaaaactctcagtgttaagatcaagctccaagggggcaaggagctacaaggacttgcgatgctgaatttttaaacccctaccccttttcattttgaggagtgactccaatttctgtttgtatcactagttatttcttctccagatctctctgacgttattgagaactttagtactcaaagtgcgatcaccagaccaggagcatctgcagtcttgggagcgtctttagaaacacagattcttagacctcgctctaaggcctaccgaatcataatcttttattttagcaagatccctggaagatttctgtgttcactattgtttgagaagtgctactctagaatatattttcaaaccttttcttcttgaaaacttttattcaagccttgagcttttttgtttgttttgatattttacttttgagacagagtcttgctcttatcacccaggctggagtccaatgacacaatcttgactcactgcaaactctgccccccgggttcaagtga

SEQ ID NO: 13074 - DNA, 1146 bp, Homo sapiens
attaaaaaaattttttggcgggggtgggggtagagattggggggttctcactatgttgcccaggttggtccttgaactcctggccttaagcagtcctcctgccttggccttccagagtgctaggattacaggtgtgagctgctgtgcctggcctctgctggatgttttaccacgggaaaaggggtgtattagtccattttgacactgctataaagaaatacccgagactgggtaatttataaaggtaagaggtttaattgactcacagttacacatggctgagaggcctcaggaaacttagaatcatggtaagtgataaaaccatcagatctcgtgagaattcactcactatcacgagaatagcacgggggaaaccactcccatgattcagtcactcccttaacacatgggcattattaatataatttgagatgagatttgggtggggacacacagccaaactatatcaaggggattgggaattttgttatacaatgttaacttacacgtgtggagcacaaaagctggttatcaataggatgtggcattttcaaatgcttttatttcataataaccagcaagatgggactggtcaggctatcaagaatagaggatcaataagggaatttaccttttttgggggaccactgtgttcataaggttggtctaggtaaggatttctagaagctcggaagggaagaggagttggtgcttttgtttgctctgaaggaggggcttggatcttaaagaactgaaaaaactttagtaaataaatatttcccttaaaattgtgtttgccctgtttattttctgatcttctctttaacctcttcctttcccttagcacctgcttccagttaatcaccaatagtggtttttaacctaccagatgttgccacaagtaagctttcactagttctctatttctgttattattgcctcaagttcatatccttctttctcgactagtgattcgtagccagggcagttgtgtctttttacccccagagaacatttggtaatatctggagacatttttggttgttacaactgggtacttggtgcttagtggtatttagtgggaggatagagatgctgctaaacatcctacaatgcacaagacagccccccacaagaaagaattat

SEQ ID NO: 13075 - DNA, 1052 bp, Homo sapiens
attttttgtaaagatggggtcccactgtgttgcccaggctgatcttgaagtcggctcaaacagtgctctcatctctgcctcccaaagtgctgggattacaggcatgagccactgtgcttggcactaaaacaatactttttttttttttttttttgagactgagtctctgtcacccaggctggagtgcagtggcaccatctcagctcactgcagcggcaccatctcagctcactgcagcctccgcctcctgggttcaagagattctcctgcctcagcctcctgagtcgctgggattacaggcgcctgccaccacacccagctaatttttgtatttttagtagagacagggtttcaccatgttggccaggctggtctcgaatttctgacctcatgatccgttcgcctcagcctcccaaagtgctgggattataggcgtgagccaccgtgcctggccaatactttttaaaaattgcattcaagcttcatcttttgttctcaaacttcaccttctgctaatggtgaactgcatacttgtggtttcctctaaacaccatcatgtctgtatacatagttttcccctaacctatactacatacttccatctcatattttcctatctaggcacatttattcttccttcagaactttactcaggcattcacttttctctgtgaagctacctttgtttctgctctattcatacatgattacttatgcattgttatatcacagtgggttgtggtttgtttacatttctgttacctcctagcctttaatctgtcttcgagcgtaaggtgtgtgttgtgttccaaatacttagaacagttcctgatacaaagtagattctcagatgtttagttgaaagtacatttttttcttcagggattaattagtaatttggaaattagcttatagatgagatattgttataatttacattctatgcaataaaacttttctatgtaatctttcgcctcaccatcatgttttacattgctaccatctcttttcagatgttattttgtattttgtcgcttataatggtaccttaa

SEQ ID NO: 13076 - DNA, 1032 bp, Homo sapiens
tgaaatattttatcacctgtcctacagagttgttgtgaggattcaaatttccaagcacataatagatattaaataaatgtccattgtccagttttaccttatcaccttatctcctaaagttgatgtttgtttatatttatttagagtacagcctgcagttatattcatatgtgcttaaatcatgatatgtgtataatggggcagtgacacttggtctcttttaagggctcacatttaaatgctaactcacttgaatattttgaaaaataaatgctttttttgaaaggacaacttaatgtgttttttcctgtgattttacatttcattttgaatgaaaggttctgggaaatgtatgattttgtaaatttctcataatattgcaggttaagatttacctaaaagtagtgatacattaaataaaatcacgctaattttgtctcagacttttgaaaattgtgtggttgtgaatcataagttataatattactattgttttagtgaagtgatacaattaaataagaactgttggactgtgcatgtgttaggggatccatttgatttcattgtctccttgtcagcatctcttttgatgctacttttttccccttgtctgattaaatggcattttttgtaagaggtatttaattataagaatgcttacattaaaatctcttggcctataaattctcatgtgagttctagttgcttgttactgcttcctttaagatctcgggggcggtgggtggttggaaactcactagatttacttccgtctttactcactgggttttggtattacttcaggtgatttgtaatctctaggccacaggaaatgggataatgtaggcttttgatgcaatggattggactttgtaaaggtgaagcttcaagctatctacttagggtgcctggggactttgaagagttatagaactatgatgcagctgcagtggcctttctgtaaatgtactactttctgttcacacatctcaccctggacctcctcttctctctagctgatactcgaaatct

SEQ ID NO: 13077 - DNA, 1078 bp, Homo sapiens
aggttcaagcaattctcctatctcagcctcccaagtagctgggactacaggctgcaccaccacacccggctaattttgtatatttagtagatatagggttttgccatgttgtccaggctggtctcgaactcctgacctcaggtgatccagctgcctcagccacccaaagtactgggattacaggcgtgagccaccacacgcggcccctaactgacaaaatcaacggcattcctcttacttgccctctgctacaattgacagttgaccattcttctttttttgaaacttttattttcttagctcttagattgttattagtgggttttttttttttgtaagacttcttggcctttgtactgccctcaagaactctgccaagctctgtcattgactgttttttctttcactctttcttcatagtgctcttctgtaatctcacatgtcttcaatacttcagctccttcctagtcacatttgactcctggatacttttttcccctcctagtcctctgcactcattctattatatttctggtttcttctgaacatcttcatctccatgacataggacttaaaactcaacctgtctaaaatgaacaccaagttagggatcctccccctctcacagaggcagggcgggttcctgtaaaaaataaaaataaatgaataaaaaataaaatgaacgctgtatatttttcttcaaacctgtttttcatttacacacatctgtagacacttattcacaactatatgccaccatatatcttggttattgatatcatttggtgtctaacttgtgagctctttttgacccctcacttccttacctgccatatccttcagcaactaagatctgttgctggtttgaaattatttttactctgttagttataatgtagatccacctttaattcttgcttggattattatattgtggtgtcttagctggtttcctgcttctagtcttctttttcaaacaactacctgattgtctgatcttgcctctcatctttgtcattgggggaaaaaaggtcaaaatcccttatgaaggcatccaagctgctccttgctcttgttc

SEQ ID NO: 13078 - DNA, 1203 bp, Homo sapiens
gaatattagtttctcattcatcccatcattgtatgataacaatttttttcttataggcctttttgggccatatatgcaatgaaatgttacatatcttacgttccgttatcattcaacagaaacttcttgtctttccatctaattaaaaaaaaaaaattaggccaggtgtggtggctcacgcctgtaatcccagcactttgggaggccaaggtgggcagatctcttgaggtcaggagttcgagaccagcccagccaacatggtgaaaccccatctccactaaaaacaaaaattagccgggtgcggtggcgggcgcctgtaatcccagctactctggaggctgaggcaggagaatcacttgaacccggggggcagaagttgcagtgagccgagatcacgccactgtactccagcctgggtgacagagtaaaactctgtctcaaaaaaaaaaaaaatgataataattacaacaacatttaagctaacggtcaggattcttgatttattatatttgggtctagaaggtagcagtagggatcatttttgaaagttgggggatgatgtcattttggagaactcactatataagaagcacttggttgttttggacatgaaaattggggggcaggctgggcacagtggctcacgcctgtaatctcagcactttgggaggctgaggtgggcagatcacttgaggccaggagtttgagaccaacttggccaacatgatgaaacattgcctctaccaaaaatataaaaattagccaggcttggtgacacacacctgtaatccctgctactagggtgactgaggcaggacaatcacttgaacctgcgaggcggaagttgcagtgagtgaaggttgtgccactgcactccagcctggcaacagagtgagattctgtctcaaaaaacaaaaaaaaaacaaaaaaaaaattgtggggtaaatttgagtgtatgagaatcttagactattgaatgaacattaatttttttaaaatgtccacttagaactatttaaaatataaacgtaaattagggttttaattatgaatataaatgagtgcatatctgtatattttacagaaaccaaaaatttaatattatagagaaatatctgtctttaggaaaggattattcaaacataggtcagggatagtaaaactttagttttttttatttctatttttcttatttatcccaaa

SEQ ID NO: 13079 - DNA, 1106 bp, Homo sapiens
agatatcttttatttacatgttacactttaatatgtatgtttttaaattgttacaaaaaaatcaactaaattgttcacatgagaacatgtcctggcaaaaaaagaaagagaaaataagagaaaacaactaaattgttgttaatgttagataaataagaggcacttattgattcaaccacagttttctggagatcaactttaatttttgtttgtactttggtggtagcttttttcattggaaagaaatccaaaattaaaattacattgttaactaaatcttacttttttgtgtgaatttttgtaattaattttcataagacactcttgtctttaagtttcttgtttgtaaacaacacaacacaatttatcactatgaatgaaggacaccatttactcaaacagtcactaccactcaagaagaaaaaaatggttcttttcaaccaaaacagttatatttagtagctaacacctttcttccctctgttttgatgcttcgtttaagtaagtgttattatttaaaagattgccaccattgtagagtctagggagatcccatcattttagatcatttggccaagtttggggacaagcaggtaggttactgttttgtttcttcaaacatagagaccgaagtaagtaacctactattataggccagtgggtaagattcctactagtatagttaaaaccctgatgctggttttttaaaatatgttgaattattcatgtttttgggatttaggcactgcactttatacaatcaatagtctaatgatatttgttaaattaattaatgacagttcatctagaaatgacaccattaatacaggcaagactgaagttatgtcaaagggaagattactatgtgtagaccaggaaaacaaagtagttgtgcaggctgtgatctctatcaaatattgaggactgtgtgtttgataaagctcaggttaaattcatcatataaattgacattatgtgcctgagtttggtcaataagattaaatacattttatgagaaagctttaaggtacttaattattttgttaatgcttacagtatttctaataccagatagtcttaagtatctatcatagatagatattcag

SEQ ID NO: 13080 - DNA, 1032 bp, Homo sapiens
gattgagctcaggagttcaaggctggagtgagctatgatcacacaattgatctccagcctgggcagcacagtgagaccctgtctctgaaaatgaaaataaataaataaataaatctttttagagtactttgaaatttgtcgttttattgcataatataaagagattttgtacttttaatcagttcatggtgttataattgaaatgtcactgttacgcagtcataaggtaaacatttagcacttttcctttatatttacccaaaagtgaaaaccagttcttgtttacttctcaaaaaaatgaaaaagaatactttatttgtaatatctttgtagtctcattcacagaattcctaatcccccgcaacccggaggctgtaaaaatgaggataaggggttagaaatttccaagaagtgactgttgttaagatagacattgaaggacagcaaaataagagtagaattaggtatcataaagagcatagtctttgaatccaaggttcagtttaccccgaatctagatgttggatacttcaagagtagaaaattgttctatcacatcctaaaaaactgttgttttaatggtaactattgatttgacccactttaaatgggatatattatatttgcatatagaagatgaagctctagtagcttcaacgtaaaaaaaaaaaatctttgaaatgtatgctcactttggcagcacatacgctaaaattagaacagtacagagaaaactagcatggtccctgtgcaaagatgacatccaaattcatgaagtgttctgcattataatatatttttaaaaaatttataaagattaaaaaataaaaaatttataaaatactgtattgagaatttaatttccattggcataaacacaaatgatatgcacagaattacatatacatgtattaggaatcacattaagtgtttagataagggatctgttaatttgagttcgagggtgagcaacccttatccaaaaacttttttttaaagactcccttttattatgttaggctaaaattgtaa

SEQ ID NO: 13081 - DNA, 1042 bp, Homo sapiens
ccccacccccgccaacacacacacacacacacacacacacgcatgcacacacgcacacacacacacacacacacggaaagtaaccaacttgtcaaagaaaaaatacaacaaaatgaaaatagctttggcccttataatactttccatttatgttcccttcatattttttcccagtgagaaaccatatggtttgtgctatagcttctcttgaaaactttgttagctatttaacaatctcactgtaactgagtgaaagctttaatcaagaactgcccatgacatatagatgcctttggttcattggctacttctgtagttgaaaggaagttgaactatttttttggacccagtaagtttgtcctttccacttgggtgttgaaagagcttatgagcagtagctgttctgatttttgttggttgttttctctagggaacaagctaccctctgagtcagcactggacttgaagataaatcctacaattcatgaaactgactgattcgactaaaggatggatagtttgggcagcgttggacagctctatgaggggtctgtttgtttaactgaagggattgttgagttcagcaacttttaattcccctaatcataaggggttgctgttgtgaaaacagggtttgtgaaggaatcagttctggcaattaacatcagtattcttactgacttcgtttttattttattgtcaaacttctttaaagtggataaattttactgctttttttgccagcaagaatttgtatgcactgagaggtcagcatagaagctttgcagtctacttatgaatccaagtttctttttttaaaatatatgaggttataaacatttctctcaagtaaactttttgacacttggattatttcatctttacaaaggtagtatgcatttgtggcttagaatttttaagatttaatggaacttaatttgagtagtaaatattttgctagtttagtgagtatattttggcttatggctaacatgctttttagataacttttattaataagatataatgaatttttacccta
